United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 8

SEQ ID NO: 7835 - DNA, 1011 bp, Homo sapiens
cgctgttgctgccgccatacgcgctctccctgtttagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggaaatcacatgtaagtctgtgcagcgattttcaacgacgaattcttgtggctaccaacctatttggccgaggcatggacatcgagcgggtgaacattgcttttaa

SEQ ID NO: 7836 - DNA, 1552 bp, Homo sapiens; identical to SEQ ID NO: 7830

SEQ ID NO: 7837 - DNA, 1337 bp, Homo sapiens; identical to SEQ ID NO: 7825

SEQ ID NO: 7838 - DNA, 1433 bp, Homo sapiens; identical to SEQ ID NO: 7716

SEQ ID NO: 7839 - DNA, 2178 bp, Homo sapiens
ctcagctagggcctgccggttcctagtgcgtgcccagcagtcctcaggtcaccttcactaccgggccaaggaccccgtgggaactcgcagccttcgccacactcgttcctcgcgcatccacggaggggtgcctacagagaagacctgcgtggcaaaaacctaaacgaagagatgaggggcatggagaggagtaggataagagaataaagataacagtggggggcagacgttagtttcctttatatcttttgttactggcggtagcagtgaagttagaaacggttttaaaacaaatttcagacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtatatttggggagagtgctggggaggggattttggtgtgtttttgtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 7840 - DNA, 1433 bp, Homo sapiens; identical to SEQ ID NO: 7716

SEQ ID NO: 7841 - DNA, 1337 bp, Homo sapiens; identical to SEQ ID NO: 7825

SEQ ID NO: 7842 - DNA, 867 bp, Homo sapiens; identical to SEQ ID NO: 7834

SEQ ID NO: 7843 - DNA, 1433 bp, Homo sapiens; identical to SEQ ID NO: 7716

SEQ ID NO: 7844 - DNA, 1603 bp, Homo sapiens
ctcagctagggcctgccggttcctagtgcgtgcccagcagtcctcaggtcaccttcactaccgggccaaggaccccgtgggaactcgcagccttcgccacactcgttcctcgcgcatccatggaggggtgcctacagagaagacctgcgtggcaaaaacctaaacgaagagatgaggggcatggagaggagtaggataagagaataaagataacagtgggggggagacgttagtttcctttatatcttttgttactggcggtagcagtgaagttagaaacggttttaaaacaaatttcagacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggaaatcacatgtaagtctgtgcagcgattttcaacgacgaattcttgtggctaccaacctatttggccgaggcatggacatcgagcgggtgaacattgcttttaa

SEQ ID NO: 7845 - DNA, 1433 bp, Homo sapiens; identical to SEQ ID NO: 7716

SEQ ID NO: 7846 - DNA, 867 bp, Homo sapiens
agatttccctccttcgtcgctgttgctgccgccatacgcgctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcagagccatgagcacatgacctctgttacccttgacaatctgacagctgtgggggatgttctgtcgcaagcgtggggttcatgatttagatcacagaattgaagtcatttattatcggcccaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctc

SEQ ID NO: 7847 - DNA, 2178 bp, Homo sapiens; identical to SEQ ID NO: 7726

SEQ ID NO: 7848 - DNA, 999 bp, Homo sapiens
cgccatacgcgctctccctgtttagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggaaatcacatgtaagtctgtgcagcgattttcaacgacgaattcttgtggctaccaacctatttggccgaggcatggacatcgagcgggtgaacattgcttttaa

SEQ ID NO: 7849 - DNA, 1011 bp, Homo sapiens; identical to SEQ ID NO: 7835

SEQ ID NO: 7850 - DNA, 1433 bp, Homo sapiens
acatttccctccttcgtcgctgttgctgccgccatacgcgctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaact

SEQ ID NO: 7851 - DNA, 867 bp, Homo sapiens; identical to SEQ ID NO: 7834

SEQ ID NO: 7852 - DNA, 1433 bp, Homo sapiens; identical to SEQ ID NO: 7716

SEQ ID NO: 7853 - DNA, 867 bp, Homo sapiens
acatttccctccttcgtcgctgttgctgccgccatacgcgctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcagagccatgagcacatgacctctgttacccttgacaacctgacagctgtgggggatgttctgtcgcaagcgtggggttcatgatttagatcacagaattgaagtcatttattatcggcccaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctc

SEQ ID NO: 7854 - DNA, 2178 bp, Homo sapiens
ctcagctagggcctgccggttcctagtgcgtgcccagcagtcctcaggtcaccttcactaccgggccaaggaccccgtgggaactcgcagccttcgccacactcgttcctcgcgcatccacggaggggtgcctacagagaagacctgcgtggcaaaaacctaaacgaagagatgaggggcatggagaggagtaggataagagaataaagataacagtgggggggagacgttagtttcctttatatattttgttactggcggtagcagtgaagttagaaacggttttaaaacaaatttcagacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtatatttggggagagtgctggggaggggattttggtgtgtttttgtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 7855 - DNA, 747 bp, Homo sapiens
atggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggtggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacaca

SEQ ID NO: 7856 - DNA, 2778 bp, Homo sapiens
acctgacgcagtgggcgtcttgcacgtgcagccgtttaagtcgcgtgggcgcctgcgagggcttgggagagcaagccgcggagagaacttgaagccaccatgggagatgaagattgggaagcagaaatcaaccctcatatgtcttcctatgttcccatatttgagaaggataggtattctggagaaaatggagacaattttaacaggactccagcttcatcatcagaaatggatgatggaccttctcgaagagatcatttcatgaaaagtggatttgcctctgggcggaattttggaaacagagatgctggtgagtgtaataagcgagataatacatccacaatgggtggttttggagttggaaagagttttggaaacagaggtttttcaaacagcaggtttgaagatggtgatagctctggtttctggagagagtctagtaatgactgcgaagataatccaacacggaacagagggttttccaagagaggcgataatgacttagacccagacgaatgtatgcagcgcactggtggcctttttggttctagaagaccagtattaagtggcacaggtaatggtgatacttctcaaagcagaagtggcagtggaagtgaacgaggtggttacaaaggtttaaatgaagaagtaataacaggctctggaaagaattcttggaagtcagaagcagaaggaggagaaagtagtgatactcaaggaccaaaagtgacctacataccccctcctccacctgaggatgaggactccatctttgcacattatcagacaggcataaacttcgacaaatacgacactattcttgtggaagtgtctggacatgatgcaccaccagcaattctgacttttgaagaagctaatctctgtcagacactgaataacaacattgctaaagctggttatactaagcttactcctgtgcaaaaatacagtattcctatcatacttgcaggacgagatttgatggcttgcgctcaaacagggtctgggaagactgcggcttttctcctaccaattttggctcatatgatgcatgatggaataactgccagtcgttttaaagagttgcaggaaccagagtgtattattgtagcaccaactcgagaattggtcaaccagatttatttggaagccagaaaattttcttttgggacttgtgtaagagctgttgttatatatgggggaacccagctgggacattcaattcgacaaatagtacaaggctgtaatatattatgtgctactcctggaagactgatggatatcataggcaaagaaaagattggtctcaaacagatcaaatacttagttttggatgaagctgatcgcatgttggatatgggttttggtccagaaatgaagaagttaatttcttgcccaggaatgccatcaaaggaacagcgccaaacccttatgttcagtgcaacttttccagaggaaattcaaaggttggctgcagagtttttaaagtcaaattatctgtttgttgctgttggacaagtgggtggagcatgtagagatgttcagcagaccgttctccaagttggccagttctcaaaaagagaaaagctcgttgaaattctgcgaaacataggggatgaaagaactatggtctttgttgaaactaagaaaaaagcagattttattgcaacttttctttgtcaagaaaaaatatcaactacaagtattcatggtgatcgggaacagagagagcgggagcaagctcttggagattttcgctttggaaagtgcccagttcttgttgctacttcagtagctgccagagggctggatattgaaaatgtgcaacatgttatcaattttgatcttccttctaccattgatgaatatgttcatcgaattgggcgtactggtcgttgtgggaatactggcagagcaatttccttttttgatcttgaatcggataaccatttagcacagcctctagtaaaagtattgacagatgctcaacaggatgttcctgcatggttggaagaaattgcctttagtacatacattcctggcttcagtggtagtacaagaggaaacgtgtttgcatcagttgataccagaaagggcaagagcactttgaacacagctgggttttcttcttcacaagctcccaatccagtagatgatgagtcatgggattaaagccaaaacatccttcaagtctgtggttttgatgcagagaagaaaatagttttgatttttgagtttttaacagaagtataaaacttaacattctcatagctcctgtccttgtattctcactcctacacttaaaaaaaaaatccttactgactagttatgtgagatgctaaaacttacaacattgcagttactgatacaaatggtgttaactgggaatattaaagcattctaaatgtctttcttatttctggtatattctttagggggcttagacatgtttaatgtttaaatgccaagtcttactatagtgtttattgatcttataaaacaagcaaataggatatgatacacttttggttaaaaattactgggtctcatttttacttgagtctttaaaacagtagtgtgtcactataatgtgataatctttaagagaaagtagaatacttaagcctttcaaagtgattttgatttttagatcatcagatgtatgatgaaaatggttaaatgtttgtgatgggagctctgtactcaatggcataacaatgtttatttttataatatacaatctttccttgaaataaaggatgaaacacttttccctta

SEQ ID NO: 7857 - DNA, 2324 bp, Homo sapiens
aacttgaagccaccatgggagatgaagattgggaagcagaaatcaaccctcatatgtcttcctatgttcccatatttgagaaggataggtattctggagaaaatggagacaattttaacaggactccagcttcatcatcagaaatggatgatggaccttctcgaagagatcatttcatgaaaagtggatttgcctctgggcggaattttggaaacagagatgctggtgagtgtaataagcgagataatacatccacaatgggtggttttggagttggaaagagttttggaaacagaggtttttcaaacagcaggtttgaagatggtgatagctctggtttctggagagagtctagtaatgactgcgaagataatccaacacggaacagagggttttccaagagaggcgataatgacttagacccagacgaatgtatgcagcgcactggtggcctttttggttctagaagaccagtattaagtggcacaggtaatggtgatacttctcaaagcagaagtggcagtggaagtgaacgaggtggttacaaaggtttaaatgaagaagtaataacaggctctggaaagaattcttggaagtcagaagcagaaggaggagaaagtagtgatactcaaggaccaaaagtgacctacataccccctcctccacctgaggatgaggactccatctttgcacattatcagacaggcataaacttcgacaaatacgacactattcttgtggaagtgtctggacatgatgcaccaccagcaattctgacttttgaagaagctaatctctgtcagacactgaataacaacattgctaaagctggttatactaagcttactcctgtgcaaaaatacagtattcctatcatacttgcaggacgagatttgatggcttgcgctcaaacagggtctgggaagactgcggcttttctcctaccaattttggctcatatgatgcatgatggaataactgccagtcgttttaaagagttgcaggaaccagagtgtattattgtagcaccaactcgagaattggtcaaccagatttatttggaagccagaaaattttcttttgggacttgtgtaagagctgttgttatatatgggggaacccagctgggacattcaattcgacaaatagtacaaggctgtaatatattatgtgctactcctggaagactgatggatatcataggcaaagaaaagattggtctcaaacagatcaaatacttagttttggatgaagctgatcgcatgttggatatgggttttggtccagaaatgaagaagttaatttcttgcccaggaatgccatcaaaggaacagcgccaaacccttatgttcagtgcaacttttccagaggaaattcaaaggttggctgcagagtttttaaagtcaaattatctgtttgttgctgttggacaagtgggtggagcatgtagagatgttcagcagaccgttctccaagttggccagttctcaaaaagagaaaagctcgttgaaattctgcgaaacataggggatgaaagaactatggtctttgttgaaactaagaaaaaagcagattttattgcaacttttctttgtcaagaaaaaatatcaactacaagtattcatggtgatcgggaacagagagagcgggagcaagctcttggagattttcgctttggaaagtgcccagttcttgttgctacttcagtagctgccagagggctggatattgaaaatgtgcaacatgttatcaattttgatcttccttctaccattgatgaatatgttcatcgaattgggcgtactggtcgttgtgggaatactggcagagcaatttccttttttgatcttgaatcggataaccatttagcacagcctctagtaaaagtattgacagatgctcaacaggatgttcctgcatggttggaagaaattgcctttagtacatacattcctggcttcagtggtagtacaagaggaaacgtgtttgcatcagttgataccagaaagggcaagagcactttgaacacagctgggttttcttcttcacaagctcccaatccagtagatgatgagtcatgggattaaagccaaaacatccttcaagtctgtggttttgatgcagagaagaaaatagttttgatttttgagtttttaacagaagtataaaacttaacattctcatagctcctgtccttgtattctcactcctacacttaaaaaaaaaatccttactgactagttatgtgagatgctaaaacttacaacattgcagttactgatacaaatggtgttaactgggaatattaaagcattctaaatgtc

SEQ ID NO: 7858 - DNA, 2884 bp, Homo sapiens
gcagtgggcgtcttgcacgtgcagccgtttaagtcgcgtgggcgcctgcgagggcttgggagagcaagccgcggagagaacttgaagccaccatgggagatgaagattgggaagcagaaatcaaccctcatatgtcttcctatgttcccatatttgagaaggataggtattctggagaaaatggagacaattttaacaggactccagcttcatcatcagaaatggatgatggaccttctcgaagagatcatttcatgaaaagtggatttgcctctgggcggaattttggaaacagagatgctggtgagtgtaataagcgagataatacatccacaatgggtggttttggagttggaaagagttttggaaacagaggtttttcaaacagcaggtttgaagatggtgatagctctggtttctggagagagtctagtaatgactgcgaagataatccaacacggaacagagggttttccaagagaggcggctatcgagatggaaataattcagaagcttcagggccatacagaagaggtggaagaggtagtttccgaggttgccgtggaggatttggtctaggaagtccaaataatgacttagacccagacgaatgtatgcagcgcactggtggcctttttggttctagaagaccagtattaagtggcacaggtaatggtgatacttctcaaagcagaagtggcagtggaagtgaacgaggtggttacaaaggtttaaatgaagaagtaataacaggctctggaaagaattcttggaagtcagaagcagaaggaggagaaagtagtgatactcaaggaccaaaagtgacctacataccccctcctccacctgaggatgaggactccatctttgcacattatcagacaggcataaacttcgacaaatacgacactattcttgtggaagtgtctggacatgatgcaccaccagcaattctgacttttgaagaagctaatctctgtcagacactgaataacaacattgctaaagctggttatactaagcttactcctgtgcaaaaatacagtattcctatcatacttgcaggacgagatttgatggcttgcgctcaaacagggtctgggaagactgcggcttttctcctaccaattttggctcatatgatgcatgatggaataactgccagtcgttttaaagagttgcaggaaccagagtgtattattgtagcaccaactcgagaattggtcaaccagatttatttggaagccagaaaattttcttttgggacttgtgtaagagctgttgttatatatgggggaacccagctgggacattcaattcgacaaatagtacaaggctgtaatatattatgtgctactcctggaagactgatggatatcataggcaaagaaaagattggtctcaaacagatcaaatacttagttttggatgaagctgatcgcatgttggatatgggttttggtccagaaatgaagaagttaatttcttgcccaggaatgccatcaaaggaacagcgccaaacccttatgttcagtgcaacttttccagaggaaattcaaaggttggctgcagagtttttaaagtcaaattatctgtttgttgctgttggacaagtgggtggagcatgtagagatgttcagcagaccgttctccaagttggccagttctcaaaaagagaaaagctcgttgaaattctgcgaaacataggggatgaaagaactatggtctttgttgaaactaagaaaaaagcagattttattgcaacttttctttgtcaagaaaaaatatcaactacaagtattcatggtgatcgggaacagagagagcgggagcaagctcttggagattttcgctttggaaagtgcccagttcttgttgctacttcagtagctgccagagggctggatattgaaaatgtgcaacatgttatcaattttgatcttccttctaccattgatgaatatgttcatcgaattgggcgtactggtcgttgtgggaatactggcagagcaatttccttttttgatcttgaatcggataaccatttagcacagcctctagtaaaagtattgacagatgctcaacaggatgttcctgcatggttggaagaaattgcctttagtacatacattcctggcttcagtggtagtacaagaggaaacgtgtttgcatcagttgataccagaaagggcaagagcactttgaacacagctgggttttcttcttcacaagctcccaatccagtagatgatgagtcatgggattaaagccaaaacatccttcaagtctgtggttttgatgcagagaagaaaatagttttgatttttgagtttttaacagaagtataaaacttaacattctcatagctcctgtccttgtattctcactcctacacttaaaaaaaaaatccttactgactagttatgtgagatgctaaaacttacaacattgcagttactgatacaaatggtgttaactgggaatattaaagcattctaaatgtctttcttatttctggtatattctttagggggcttagacatgtttaatgtttaaatgccaagtcttactatagtgtttattgatcttataaaacaagcaaataggatatgatacacttttggttaaaaattactgggtctcatttttacttgagtctttaaaacagtagtgtgtcactataatgtgataatctttaagagaaagtagaatacttaagcctttcaaagtgattttgatttttagatcatcagatgtatgatgaaaatggttaaatgtttgtgatgggagctctgtactcaatggcataacaatgtttatttttataatatacaatctttccttgaaataaaggatgaaacacttttcccttaagttttccatc

SEQ ID NO: 7859 - DNA, 567 bp, Homo sapiens
agtgggccgcttttctacgggaactggcctgaactcggccgtacgggctccccagtaaccgacctttggccaaagtgtggatggagtaggaggagttttgaagccgtccttcgaagcctttctgcctcggggtctcagagtcccacgggtgcccaaagtctgggcttgaggcctgcagaggaggcgaaggggccttattcctggcttcttcactgcgttttctctgaacagacatgaacttgaagccaccatgggagatgaagattgggaagcagaaatcaaccctcatatgtcttcctatgttcccatatttgagaaggataggtattctggagaaaatggagacaattttaacaggactccagcttcatcatcagaaatggatgatggaccttctcgaagagatcatttcatgaaaagtggatttgcctctgggcggaattttggaaacagagatgctggtgagtgtaataagcgagataatacatccacaatgggtggttttggagttggaaagagttttggaaacagaggtttttcaaacagcaggtttgaagatggtgatag

SEQ ID NO: 7860 - DNA, 2451 bp, Homo sapiens
acctgacgcagtgggcgtcttgcacgtgcagccgtttaagtcgcgtgggcgcctgcgagggcttgggagagcaagccgcggagagaacttgaagccaccatgggagatgaagattgggaagcagaaatcaaccctcatatgtcttcctatgttcccatatttgagaaggataggtattctggagaaaatggagacaattttaacaggactccagcttcatcatcagaaatggatgatggaccttctcgaagagatcatttcatgaaaagtggatttgcctctgggcggaattttggaaacagagatgctggtgagtgtaataagcgagataatacatccacaatgggtggttttggagttggaaagagttttggaaacagaggtttttcaaacagcaggtttgaagatggtgatagctctggtttctggagaggctatcgagatggaaataattcagaagcttcagggccatacagaagaggtggaagaggtagtttccgaggttgccgtggaggatttggtctaggaagtccaaataatgacttagacccagacgaatgtatgcagcgcactggtggcctttttggttctagaagaccagtattaagtggcacaggtaatggtgatacttctcaaagcagaagtggcagtggaagtgaacgaggtggttacaaaggtttaaatgaagaagtaataacaggctctggaaagaattcttggaagtcagaagcagaaggaggagaaagtagtgatactcaaggaccaaaagtgacctacataccccctcctccacctgaggatgaggactccatctttgcacattatcagacaggcataaacttcgacaaatacgacactattcttgtggaagtgtctggacatgatgcaccaccagcaattctgacttttgaagaagctaatctctgtcagacactgaataacaacattgctaaagctggttatactaagcttactcctgtgcaaaaatacagtattcctatcatacttgcaggacgagatttgatggcttgcgctcaaacagggtctgggaagactgcggcttttctcctaccaattttggctcatatgatgcatgatggaataactgccagtcgttttaaagagttgcaggaaccagagtgtattattgtagcaccaactcgagaattggtcaaccagatttatttggaagccagaaaattttcttttgggacttgtgtaagagctgttgttatatatgggggaacccagctgggacattcaattcgacaaatagtacaaggctgtaatatattatgtgctactcctggaagactgatggatatcataggcaaagaaaagattggtctcaaacagatcaaatacttagttttggatgaagctgatcgcatgttggatatgggttttggtccagaaatgaagaagttaatttcttgcccaggaatgccatcaaaggaacagcgccaaacccttatgttcagtgcaacttttccagaggaaattcaaaggttggctgcagagtttttaaagtcaaattatctgtttgttgctgttggacaagtgggtggagcatgtagagatgttcagcagaccgttctccaagttggccagttctcaaaaagagaaaagctcgttgaaattctgcgaaacataggggatgaaagaactatggtctttgttgaaactaagaaaaaagcagattttattgcaacttttctttgtcaagaaaaaatatcaactacaagtattcatggtgatcgggaacagagagagcgggagcaagctcttggagattttcgctttggaaagtgcccagttcttgttgctacttcagtagctgccagagggctggatattgaaaatgtgcaacatgttatcaattttgatcttccttctaccattgatgaatatgttcatcgaattgggcgtactggtcgttgtgggaatactggcagagcaatttccttttttgatcttgaatcggataaccatttagcacagcctctagtaaaagtattgacagatgctcaacaggatgttcctgcatggttggaagaaattgcctttagtacatacattcctggcttcagtggtagtacaagaggaaacgtgtttgcatcagttgataccagaaagggcaagagcactttgaacacagctgggttttcttcttcacaagctcccaatccagtagatgatgagtcatgggattaaagccaaaacatccttcaagtctgtggttttgatgcagagaagaaaatagttttgatttttgagtttttaacagaagtataaaacttaacattctcatagctcctgtccttgtattctcactcctacacttaaaaaaaaaatccttactgactagttatgtgagatgctaaaacttacaacattgcagttactgatacaaatggtgttaactgggaatattaaagcattctaaatgtc

SEQ ID NO: 7861 - DNA, 566 bp, Homo sapiens
ttttctacgggaactggcctgaactcggccgtacgggctccccagtaaccgacctttggccaaagtgtggatggaaacttgaagccaccatgggagatgaagattgggaagcagaaatcaaccctcatatgtcttcctatgttcccatatttgagaaggataggtattctggagaaaatggagacaattttaacaggactccagcttcatcatcagaaatggatgatggaccttctcgaagagatcatttcatgaaaagtggatttgcctctgggcggaattttggaaacagagatgctggtgagtgtaataagcgagataatacatccacaatgggtggttttggagttggaaagagttttggaaacagaggtttttcaaacagcaggtttgaagatggtgatagctctggtttctggagagagtctagtaatgactgcgaagataatccaacacggaacagagggttttccaagagaggcggctatcgagatggaaataattcagaagcttcagggccatacagaagaggtggaagaggtagtttccgaggttgccgtggagga

SEQ ID NO: 7862 - DNA, 1984 bp, Homo sapiens
agaataaacatttctgggaatggggtctaggaatttatttttaaccaactctccagagtctagtaatgactgcgaagataatccaacacggaacagagggttttccaagagaggcgataatgacttagacccagacgaatgtatgcagcgcactggtggcctttttggttctagaagaccagtattaagtggcacaggtaatggtgatacttctcaaagcagaagtggcagtggaagtgaacgagattcttggaagtcagaagcagaaggaggagaaagtagtgatactcaaggaccaaaagtgacctacataccccctcctccacctgaggatgaggactccatctttgcacattatcagacaggcataaacttcgacaaatacgacactattcttgtggaagtgtctggacatgatgcaccaccagcaattctgacttttgaagaagctaatctctgtcagacactgaataacaacattgctaaagctggttatactaagcttactcctgtgcaaaaatacagtattcctatcatacttgcaggacgagatttgatggcttgcgctcaaacagggtctgggaagactgcggcttttctcctaccaattttggctcatatgatgcatgatggaataactgccagtcgttttaaagagttgcaggaaccagagtgtattattgtagcaccaactcgagaattggtcaaccagatttatttggaagccagaaaattttcttttgggacttgtgtaagagctgttgttatatatgggggaacccagctgggacattcaattcgacaaatagtacaaggctgtaatatattatgtgctactcctggaagactgatggatatcataggcaaagaaaagattggtctcaaacagatcaaatacttagttttggatgaagctgatcgcatgttggatatgggttttggtccagaaatgaagaagttaatttcttgcccaggaatgccatcaaaggaacagcgccaaacccttatgttcagtgcaacttttccagaggaaattcaaaggttggctgcagagtttttaaagtcaaattatctgtttgttgctgttggacaagtgggtggagcatgtagagatgttcagcagaccgttctccaagttggccagttctcaaaaagagaaaagctcgttgaaattctgcgaaacataggggatgaaagaactatggtctttgttgaaactaagaaaaaagcagattttattgcaacttttctttgtcaagaaaaaatatcaactacaagtattcatggtgatcgggaacagagagagcgggagcaagctcttggagattttcgctttggaaagtgcccagttcttgttgctacttcagtagctgccagagggctggatattgaaaatgtgcaacatgttatcaattttgatcttccttctaccattgatgaatatgttcatcgaattgggcgtactggtcgttgtgggaatactggcagagcaatttccttttttgatcttgaatcggataaccatttagcacagcctctagtaaaagtattgacagatgctcaacaggatgttcctgcatggttggaagaaattgcctttagtacatacattcctggcttcagtggtagtacaagaggaaacgtgtttgcatcagttgataccagaaagggcaagagcactttgaacacagctgggttttcttcttcacaagctcccaatccagtagatgatgagtcatgggattaaagccaaaacatccttcaagtctgtggttttgatgcagagaagaaaatagttttgatttttgagtttttaacagaagtataaaacttaacattctcatagctcctgtccttgtattctcactcctacacttaaaaaaaaaatccttactgactagttatgtgagatgctaaaacttacaacattgcagttactgatacaaatggtgttaactgggaatattaaagcattctaaatgtc

SEQ ID NO: 7863 - DNA, 2607 bp, Homo sapiens
acacaggcgcagtcagggaggcagggtgtgtcgagcggtttatcccgcaaccccggcgtccccggcagggatgaaagcgcagggcccacgcgaactcggcccgcagctcccggccctagaggacgcactgtccgccggcaggggcgtgcccaagacgccatgctctgggagaggttgggcacctggcaggccgccccgactccggatcagctgtctccgctgcgtacgtcttcctcttccaatgggcttggattgagccttctagcgcatattccaagtcctccaatgtcccacaatgccttgcagccggtttcgccctcggtcctggcaactgtcgcgtaaccacccatgaaagcgtccatgcctcgccgtgcgatagtatctccggaacaaatttgtccctctgcgcgatccggaactccgaggtcgttcctacgcgccgtcgttcgcctcttcacatcggattgggtctcacgcaaggatgaggcggggtttcgccgtggcgcgcatgcgtgcagcaaagaatggaggagtcggaacccgaacggaagcgggctcgcaccgacgaggtgcctgccggaggaagccgctccgaggcggaagatgaggacgacgaggactacgtgccctatgtgccgttacggcagcgccggcagctactgctccagaagctgctgcagcgaagacgcaagggagctgcggaggaagagcagcaggacagcggtagtgaaccccggggagatgaggacgacatcccgctaggccctcagtccaacgtcagcctcctggatcagcaccagcaccttaaagagaaggctgaagcgcgcaaagagtctgccaaggagaagcagctgaaggaagaagagaagatcctggagagtgttgccgagggccgagcattgatgtcagtgaaggagatggctaagggcattacgtatgatgaccccatcaaaaccagctggactccaccccgttatgttctgagcatgtctgaagagcgacatgagcgcgtgcggaagaaataccacatcctggtggagggagacggtatcccaccacccatcaagagcttcaaggaaatgaagtttcctgcagccatcctgagaggcctgaagaagaaaggcattcaccacccaacacccattcagatccagggcatccccaccattctatctggccgtgacatgataggcatcgctttcacgggttcaggcaagacactggtgttcacgttgcccgtcatcatgttctgcctggaacaagagaagaggttacccttctcaaagcgcgaggggccctatggactcatcatctgcccctcgcgggagctggcccggcagacccatggcatcctggagtactactgccgcctgctgcaggaggacagctcaccactcctgcgctgcgccctctgcattgggggcatgtccgtgaaagagcagatggagaccatccgacacggtgtacacatgatggtggccaccccggggcgcctcatggatttgctgcagaagaagatggtcagcctagacatctgtcgctacctggccctggacgaggctgaccgcatgatcgacatgggcttcgagggtgacatccgtaccatcttctcctacttcaagggccagcgacagaccctgctcttcagtgccaccatgccgaagaagattcagaactttgctaagagtgcccttgtaaagcctgtgaccatcaatgtggggcgcgctggggctgccagcctggatgtcatccaggaggtagaatatgtgaaggaggaggccaagatggtgtacctgctcgagtgcctgcagaagacacccccgcctgtactcatctttgcagagaagaaggcagacgtggacgccatccacgagtacctgctgctcaagggggttgaggccgtagccatccatgggggcaaagaccaggaggaacggactaaggccatcgaggcattccgggagggcaagaaggatgtcctagtagccacagacgttgcctccaagggcctggacttccctgccatccagcacgtcatcaattatgacatgccagaggagattgagaactatgtacaccggattggccgcaccgggcgctcgggaaacacaggcatcgccactaccttcatcaacaaagcgtgtgatgagtcagtgctgatggacctcaaagcgctgctgctagaagccaagcagaaggtgccgcccgtgctgcaggtgctgcattgcggggatgagtccatgctggacattggaggagagcgcggctgtgccttctgcgggggcctgggtcatcggatcactgactgccccaaactcgaggctatgcagaccaagcaggtcagcaacatcggtcgcaaggactacctggcccacagctccatggacttctgagccgacagtcttcccttctctccaagaggcctcagtccccaagactgccaccagtctacacatacagcagccccctggacagaatcagcatttcagctcagctggcctgggatgggccaggctggtcctggctgcctgttccctgtgctcttcagaattactgtttttgtttccttttaccccagctgccattaaagcccaaacctctagccca

SEQ ID NO: 7864 - DNA, 2658 bp, Homo sapiens
ggtggtcctggcactaagcgaggatttggctttggaggttttgccatcagtgctgggaaaaaggaggaacccaaactcccacagcagtcccacagtgcctttggggcaaccagctcttcttctggatttggaaagtcagctccaccacagcttccttctttctacaaaattggatctaagcgggccaactttgatgaagaaaatgcctattttgaagatgaggaagaagattctagcaacgttgatttaccttacattcctgctgaaaactcaccaactcgccagcaattccattccaagccagtagattctgacagcgatgatgatcccttggaggcattcatggctgaagtggaggatcaggcagctagagacatgaagaggcttgaagaaaaggacaaggaaagaaaaaacgtaaagggtattcgagatgacattgaagaggaagatgaccaagaagcttattttcgatacatggcagaaaacccaactgctggtgtggttcaggaggaagaggaagacaatctagaatatgatagtgacggaaatccaattgcacctaccaaaaaaatcattgatcctcttccccccattgatcattcagagattgactatccaccatttgaaaaaaacttttacaatgagcatgaagagataaccaacctcactccacagcagttaatagatctccggcataagctcaatcttcgggtctctggtgctgcacctcctagaccaggaagtagctttgctcattttgggtttgacgaacaacttatgcaccagattcggaaatctgaatacacacagcccactccaatacagtgccagggtgtgcctgtggcattaagtggtagagacatgattggtattgccaaaacaggtagtgggaaaactgcagccttcatttggcccatgttgattcatataatggaccagaaggagttggaaccaggtgatggaccaattgcagtgattgtgtgtcctaccagggagctttgccagcagatccatgcagaatgtaagcggtttggaaaagcatataatcttcgatcagtggccgtatatggaggagggagtatgtgggagcaggccaaggcccttcaggagggggcagagattgttgtgtgtaccccaggtcgactgatagatcatgtgaaaaagaaagctaccaatcttcaaagagtctcttaccttgtgtttgatgaagcagatcgaatgtttgacatgggatttgagtaccaagttcgatccatagcaagtcatgttcgtcctgacaggcagactctcttatttagtgcaacttttcggaagaagattgaaaagttggccagagacatcctgatcgaccctattcgagtggtgcagggagatattggagaggcaaatgaagatgtgacacagattgtggagattctccattctggacctagtaaatggaactggcttacccggcgtctggtagaatttacctcttcagggagtgtcctcctctttgttactaaaaaagccaatgctgaagagctagcgaataaccttaaacaggagggtcataatcttgggctgctccatggggatatggatcagagtgagagaaacaaggtcatttcagactttaagaaaaaggacatcccagtcctggtggccacagatgttgcagcccgtggtctggacattccttcaattaagactgtcattaactatgatgtggcacgagacattgataccctactcactcccaaggacagcaattttgctggtgacctggtccggaacttggaaggagccaatcaacacgtttctaaggaactcctagatctggcaatgcagaatgcctggtttcggaaatctcgattcaaaggagggaaaggaaaaaagctgaacattggtggaggaggcctaggctacagggagcggcctggcctgggctctgagaacatggatcgaggaaataacaatgtaatgagcaattatgaggcctacaagccttccacaggagctatgggagatcgactaacggcaatgaaagcagctttccagtcacagtacaagagtcactttgttgcagccagtttaagtaatcagaaggctggaagttctgctgctggggcaagtgggtggactagtgcagggagcttgaattctgttccaactaactcagcacaacagggccataacagtcctgacagccccgtcaccagtgccgccaagggcatcccaggctttggcaatactggcaacatcagtggtgcccctgtgacctacccgtctgccggagcccaaggagtcaacaacacagcttcagggaataacagccgagaagggactgggggcagcaacgggaaaagagagagatatactgagaaccggggcagcagccgtcacagtcacggagagactggcaatcggcatagcgatagtccacgtcacggagatggtggtcgccatggagatggataccgccatccagaaagcagcagccgtcatactgatggccatcggcacggggagaacagacatggaggaagcgcaggccggcatggggagaaccggggtgcaaatgatggtcggaatggggaaagcaggaaagaagcttttaatcgtgagagcaagatggagcccccgcctaaacgcaagaaaagtcgatgggacagttag

SEQ ID NO: 7865 - DNA, 3921 bp, Homo sapiens
tggcggtggtggcggtggcggcggcggtggtggtggtggcggcggcggcggcgaagggggcggagaggaaggagcgcggcgggaccgggccgggacagcgcgtactttgggctccgggattcgctccgcgcccgcggttgtagcagctgccgctgcagccatagcagcaggtcagtcattggcaccatgaactggaataaaggtggtcctggcactaagcgaggatttggctttggaggttttgccatcagtgctgggaaaaaggaggaacccaaactcccacagcagtcccacagtgcctttggggcaaccagctcttcttctggatttggaaagtcagctccaccacagcttccttctttctacaaaattggatctaagcgggccaactttgatgaagaaaatgcctattttgaagatgaggaagaagattctagcaacgttgatttaccttacattcctgctgaaaactcaccaactcgccagcaattccattccaagccagtagattctgacagcgatgatgatcccttggaggcattcatggctgaagtggaggatcaggcagctagagacatgaagaggcttgaagaaaaggacaaggaaagaaaaaacgtaaagggtattcgagatgacattgaagaggaagatgaccaagaagcttattttcgatacatggcagaaaacccaactgctggtgtggttcaggaggaagaggaagacaatctagaatatgatagtgacggaaatccaattgcacctaccaaaaaaatcattgatcctcttccccccattgatcattcagagattgactatccaccatttgaaaaaaacttttacaatgagcatgaagagataaccaacctcactccacagcagttaatagatctccggcataagctcaatcttcgggtctctggtgctgcacctcctagaccaggaagtagctttgctcattttgggtttgacgaacaacttatgcaccagattcggaaatctgaatacacacagcccactccaatacagtgccagggtgtgcctgtggcattaagtggtagagacatgattggtattgccaaaacaggtagtgggaaaactgcagccttcatttggcccatgttgattcatataatggaccagaaggagttggaaccaggtgatggaccaattgcagtgattgtgtgtcctaccagggagctttgccagcagatccatgcagaatgtaagcggtttggaaaagcatataatcttcgatcagtggccgtatatggaggagggagtatgtgggagcaggccaaggcccttcaggagggggcagagattgttgtgtgtaccccaggtcgactgatagatcatgtgaaaaagaaagctaccaatcttcaaagagtctcttaccttgtgtttgatgaagcagatcgaatgtttgacatgggatttgagtaccaagttcgatccatagcaagtcatgttcgtcctgacaggcagactctcttatttagtgcaacttttcggaagaagattgaaaagttggccagagacatcctgatcgaccctattcgagtggtgcagggagatattggagaggcaaatgaagatgtgacacagattgtggagattctccattctggacctagtaaatggaactggcttacccggcgtctggtagaatttacctcttcagggagtgtcctcctctttgttactaaaaaagccaatgctgaagagctagcgaataaccttaaacaggagggtcataatcttgggctgctccatggggatatggatcagagtgagagaaacaaggtcatttcagactttaagaaaaaggacatcccagtcctggtggccacagatgttgcagcccgtggtctggacattccttcaattaagactgtcattaactatgatgtggcacgagacattgatacccacacgcataggattggccgcacaggaagagcgggtgagaaaggtgtggcctataccctactcactcccaaggacagcaattttgctggtgacctggtccggaacttggaaggagccaatcaacacgtttctaaggaactcctagatctggcaatgcagaatgcctggtttcggaaatctcgattcaaaggagggaaaggaaaaaagctgaacattggtggaggaggcctaggctacagggagcggcctggcctgggctctgagaacatggatcgaggaaataacaatgtaatgagcaattatgaggcctacaagccttccacaggagctatgggagatcgactaacggcaatgaaagcagctttccagtcacagtacaagagtcactttgttgcagccagtttaagtaatcagaaggctggaagttctgctgctggggcaagtgggtggactagtgcagggagcttgaattctgttccaactaactcagcacaacagggccataacagtcctgacagccccgtcaccagtgccgccaagggcatcccaggctttggcaatactggcaacatcagtggtgcccctgtgacctacccgtctgccggagcccaaggagtcaacaacacagcttcagggaataacagccgagaagggactgggggcagcaacgggaaaagagagagatatactgagaaccggggcagcagccgtcacagtcacggagagactggcaatcggcatagcgatagtccacgtcacggagatggtggtcgccatggagatggataccgccatccagaaagcagcagccgtcatactgatggccatcggcacggggagaacagacatggaggaagcgcaggccggcatggggagaaccggggtgcaaatgatggtcggaatggggaaagcaggaaagaagcttttaatcgtgagagcaagatggagcccaagatggaacccaaagtggacagcagcaagatggacaaggtggacagcaagacagataagacagctgacggctttgctgtcccagagccgcctaaacgcaagaaaagtcgatgggacagttagaggggatgtgctaaagcgtgaaatcagttgtccttaatttttagaaagattttggtaactaggtgtctcagggctgggttggggtccaaagtgtaaggaccccctgcccttagtggagagctggagcttggagacattaccccttcatcagaaggaattttcggatgttttcttgggaagctgttttggtccttggaagcagtgagagctgggaagcttcttttggctctaggtgagttgtcatgtgggtaagttgaggttatcttgggataaagggtcttctagggcacaaaactcactctaggtttatattgtatgtagcttatattttttactaaggtgtcaccttataagcatctataaattgacttctttttcttagttgtatggccaggcagtccccattttaggagttggcttctgcaaattcaatccattgagctaactgttggggagcaatttggtagttgtagacatttgcagggaagggagatgtctgattctaaatgggagttgatgctcaggtccccagccaggtttgcatccagccctgagacatgtaggaaacacctttcagacccaggctctgaagattcccagaagccacaaggattgaagggaaaaggtgatcctggtaactgttccaggattgctccaggtttgagatggtattgctaaatttaaaattaaacaagaaacccaacaacagcttttaaagtgtcttctatctcattgtattttttttaacttgccccaatgatagaaaagtcttttgctgaaatgattttgatgatttttgtttatcgtttataaaaaggaaaagaaatatacaaactttgacttttgtgactttgtgaaggtttctttaagatgtgcattcctttctgcttgctctctagtaaatgttttactaccggg

SEQ ID NO: 7866 - DNA, 3735 bp, Homo sapiens
atgaactggaataaaggtggtcctggcactaagcgaggatttggctttggaggttttgccatcagtgctgggaaaaaggaggaacccaaactcccacagcagtcccacagtgcctttggggcaaccagctcttcttctggatttggaaagtcagctccaccacagcttccttctttctacaaaattggatctaagcgggccaactttgatgaagaaaatgcctattttgaagatgaggaagaagattctagcaacgttgatttaccttacattcctgctgaaaactcaccaactcgccagcaattccattccaagccagtagattctgacagcgatgatgatcccttggaggcattcatggctgaagtggaggatcaggcagctagagacatgaagaggcttgaagaaaaggacaaggaaagaaaaaacgtaaagggtattcgagatgacattgaagaggaagatgaccaagaagcttattttcgatacatggcagaaaacccaactgctggtgtggttcaggaggaagaggaagacaatctagaatatgatagtgacggaaatccaattgcacctaccaaaaaaatcattgatcctcttccccccattgatcattcagagattgactatccaccatttgaaaaaaacttttacaatgagcatgaagagataaccaacctcactccacagcagttaatagatctccggcataagctcaatcttcgggtctctggtgctgcacctcctagaccaggaagtagctttgctcattttgggtttgacgaacaacttatgcaccagattcggaaatctgaatacacacagcccactccaatacagtgccagggtgtgcctgtggcattaagtggtagagacatgattggtattgccaaaacaggtagtgggaaaactgcagccttcatttggcccatgttgattcatataatggaccagaaggagttggaaccaggtgatggaccaattgcagtgattgtgtgtcctaccagggagctttgccagcagatccatgcagaatgtaagcggtttggaaaagcatataatcttcgatcagtggccgtatatggaggagggagtatgtgggagcaggccaaggcccttcaggagggggcagagattgttgtgtgtaccccaggtcgactgatagatcatgtgaaaaagaaagctaccaatcttcaaagagtctcttaccttgtgtttgatgaagcagatcgaatgtttgacatgggatttgagtaccaagttcgatccatagcaagtcatgttcgtcctgacaggcagactctcttatttagtgcaacttttcggaagaagattgaaaagttggccagagacatcctgatcgaccctattcgagtggtgcagggagatattggagaggcaaatgaagatgtgacacagattgtggagattctccattctggacctagtaaatggaactggcttacccggcgtctggtagaatttacctcttcagggagtgtcctcctctttgttactaaaaaagccaatgctgaagagctagcgaataaccttaaacaggagggtcataatcttgggctgctccatggggatatggatcagagtgagagaaacaaggtcatttcagactttaagaaaaaggacatcccagtcctggtggccacagatgttgcagcccgtggtctggacattccttcaattaagactgtcattaactatgatgtggcacgagacattgatacccacacgcataggattggccgcacaggaagagcgggtgagaaaggtgtggcctataccctactcactcccaaggacagcaattttgctggtgacctggtccggaacttggaaggagccaatcaacacgtttctaaggaactcctagatctggcaatgcagaatgcctggtttcggaaatctcgattcaaaggagggaaaggaaaaaagctgaacattggtggaggaggcctaggctacagggagcggcctggcctgggctctgagaacatggatcgaggaaataacaatgtaatgagcaattatgaggcctacaagccttccacaggagctatgggagatcgactaacggcaatgaaagcagctttccagtcacagtacaagagtcactttgttgcagccagtttaagtaatcagaaggctggaagttctgctgctggggcaagtgggtggactagtgcagggagcttgaattctgttccaactaactcagcacaacagggccataacagtcctgacagccccgtcaccagtgccgccaagggcatcccaggctttggcaatactggcaacatcagtggtgcccctgtgacctacccgtctgccggagcccaaggagtcaacaacacagcttcagggaataacagccgagaagggactgggggcagcaacgggaaaagagagagatatactgagaaccggggcagcagccgtcacagtcacggagagactggcaatcggcatagcgatagtccacgtcacggagatggtggtcgccatggagatggataccgccatccagaaagcagcagccgtcatactgatggccatcggcacggggagaacagacatggaggaagcgcaggccggcatggggagaaccggggtgcaaatgatggtcggaatggggaaagcaggaaagaagcttttaatcgtgagagcaagatggagcccaagatggaacccaaagtggacagcagcaagatggacaaggtggacagcaagacagataagacagctgacggctttgctgtcccagagccgcctaaacgcaagaaaagtcgatgggacagttagaggggatgtgctaaagcgtgaaatcagttgtccttaatttttagaaagattttggtaactaggtgtctcagggctgggttggggtccaaagtgtaaggaccccctgcccttagtggagagctggagcttggagacattaccccttcatcagaaggaattttcggatgttttcttgggaagctgttttggtccttggaagcagtgagagctgggaagcttcttttggctctaggtgagttgtcatgtgggtaagttgaggttatcttgggataaagggtcttctagggcacaaaactcactctaggtttatattgtatgtagcttatattttttactaaggtgtcaccttataagcatctataaattgacttctttttcttagttgtatggccaggcagtccccattttaggagttggcttctgcaaattcaatccattgagctaactgttggggagcaatttggtagttgtagacatttgcagggaagggagatgtctgattctaaatgggagttgatgctcaggtccccagccaggtttgcatccagccctgagacatgtaggaaacacctttcagacccaggctctgaagattcccagaagccacaaggattgaagggaaaaggtgatcctggtaactgttccaggattgctccaggtttgagatggtattgctaaatttaaaattaaacaagaaacccaacaacagcttttaaagtgtcttctatctcattgtattttttttaacttgccccaatgatagaaaagtcttttgctgaaatgattttgatgatttttgtttatcgtttataaaaaggaaaagaaatatacaaactttgacttttgtgactttgtgaaggtttctttaagatgtgcattcctttctgcttgctctctagtaaatgttttactaccggg

SEQ ID NO: 7867 - DNA, 4337 bp, Homo sapiens
caagagtgtcgctctagtagtatatgcaacagtttaaactataggcatgttcatgtaaatatggtttctgtccaacccgttttctcttgggatttttggctagccccttgacgccactttttcttcattcgcagacccactttctagatgggtcatgaacactgtccacccaactgcagtttcccgtcagagtatctgaggagcctgtgaggcgttctggagctttaaggtcaggcgccttccgggagccgtagccccggccccgcccttctgcccgcgcgttcctcactgcgcatgtcgcgtttttgttcccctccccccttcagcaacgggccgtgaggcggtggcggtggtggcggtggcggcggcggtggtggtggtggcggcggcggcggcgaagggggcggagaggaaggagcgcggcgggaccgggccgggacagcgcgtactttgggctccgggattcgctccgcgcccgcggttgtagcagctgccgctgcagccatagcagcaggacttcctcaagcgcagggactatgtcttaaggcgctttgcagagccaagctcatttctggcacataagaggtcagtcattggcaccatgaactggaataaaggtggtcctggcactaagcgaggatttggctttggaggttttgccatcagtgctgggaaaaaggaggaacccaaactcccacagcagtcccacagtgcctttggggcaaccagctcttcttctggatttggaaagtcagctccaccacagcttccttctttctacaaaattggatctaagcgggccaactttgatgaagaaaatgcctattttgaagatgaggaagaagattctagcaacgttgatttaccttacattcctgctgaaaactcaccaactcgccagcaattccattccaagccagtagattctgacagcgatgatgatcccttggaggcattcatggctgaagtggaggatcaggcagctagagacatgaagaggcttgaagaaaaggacaaggaaagaaaaaacgtaaagggtattcgagatgacattgaagaggaagatgaccaagaagcttattttcgatacatggcagaaaacccaactgctggtgtggttcaggaggaagaggaagacaatctagaatatgatagtgacggaaatccaattgcacctaccaaaaaaatcattgatcctcttccccccattgatcattcagagattgactatccaccatttgaaaaaaacttttacaatgagcatgaagagataaccaacctcactccacagcagttaatagatctccggcataagctcaatcttcgggtctctggtgctgcacctcctagaccaggaagtagctttgctcattttgggtttgacgaacaacttatgcaccagattcggaaatctgaatacacacagcccactccaatacagtgccagggtgtgcctgtggcattaagtggtagagacatgattggtattgccaaaacaggtagtgggaaaactgcagccttcatttggcccatgttgattcatataatggaccagaaggagttggaaccaggtgatggaccaattgcagtgattgtgtgtcctaccagggagctttgccagcagatccatgcagaatgtaagcggtttggaaaagcatataatcttcgatcagtggccgtatatggaggagggagtatgtgggagcaggccaaggcccttcaggagggggcagagattgttgtgtgtaccccaggtcgactgatagatcatgtgaaaaagaaagctaccaatcttcaaagagtctcttaccttgtgtttgatgaagcagatcgaatgtttgacatgggatttgagtaccaagttcgatccatagcaagtcatgttcgtcctgacaggcagactctcttatttagtgcaacttttcggaagaagattgaaaagttggccagagacatcctgatcgaccctattcgagtggtgcagggagatattggagaggcaaatgaagatgtgacacagattgtggagattctccattctggacctagtaaatggaactggcttacccggcgtctggtagaatttacctcttcagggagtgtcctcctctttgttactaaaaaagccaatgctgaagagctagcgaataaccttaaacaggagggtcataatcttgggctgctccatggggatatggatcagagtgagagaaacaaggtcatttcagactttaagaaaaaggacatcccagtcctggtggccacagatgttgcagcccgtggtctggacattccttcaattaagactgtcattaactatgatgtggcacgagacattgatacccacacgcataggattggccgcacaggaagagcgggtgagaaaggtgtggcctataccctactcactcccaaggacagcaattttgctggtgacctggtccggaacttggaaggagccaatcaacacgtttctaaggaactcctagatctggcaatgcagaatgcctggtttcggaaatctcgattcaaaggagggaaaggaaaaaagctgaacattggtggaggaggcctaggctacagggagcggcctggcctgggctctgagaacatggatcgaggaaataacaatgtaatgagcaattatgaggcctacaagccttccacaggagctatgggagatcgactaacggcaatgaaagcagctttccagtcacagtacaagagtcactttgttgcagccagtttaagtaatcagaaggctggaagttctgctgctggggcaagtgggtggactagtgcagggagcttgaattctgttccaactaactcagcacaacagggccataacagtcctgacagccccgtcaccagtgccgccaagggcatcccaggctttggcaatactggcaacatcagtggtgcccctgtgacctacccgtctgccggagcccaaggagtcaacaacacagcttcagggaataacagccgagaagggactgggggcagcaacgggaaaagagagagatatactgagaaccggggcagcagccgtcacagtcacggagagactggcaatcggcatagcgatagtccacgtcacggagatggtggtcgccatggagatggataccgccatccagaaagcagcagccgtcatactgatggccatcggcacggggagaacagacatggaggaagcgcaggccggcatggggagaaccggggtgcaaatgatggtcggaatggggaaagcaggaaagaagcttttaatcgtgagagcaagatggagcccaagatggaacccaaagtggacagcagcaagatggacaaggtggacagcaagacagataagacagctgacggctttgctgtcccagagccgcctaaacgcaagaaaagtcgatgggacagttagaggggatgtgctaaagcgtgaaatcagttgtccttaatttttagaaagattttggtaactaggtgtctcagggctgggttggggtccaaagtgtaaggaccccctgcccttagtggagagctggagcttggagacattaccccttcatcagaaggaattttcggatgttttcttgggaagctgttttggtccttggaagcagtgagagctgggaagcttcttttggctctaggtgagttgtcatgtgggtaagttgaggttatcttgggataaagggtcttctagggcacaaaactcactctaggtttatattgtatgtagcttatattttttactaaggtgtcaccttataagcatctataaattgacttctttttcttagttgtatggccaggcagtccccattttaggagttggcttctgcaaattcaatccattgagctaactgttggggagcaatttggtagttgtagacatttgcagggaagggagatgtctgattctaaatgggagttgatgctcaggtccccagccaggtttgcatccagccctgagacatgtaggaaacacctttcagacccaggctctgaagattcccagaagccacaaggattgaagggaaaaggtgatcctggtaactgttccaggattgctccaggtttgagatggtattgctaaatttaaaattaaacaagaaacccaacaacagcttttaaagtgtcttctatctcattgtattttttttaacttgccccaatgatagaaaagtcttttgctgaaatgattttgatgatttttgtttatcgtttataaaaaggaaaagaaatatacaaactttgacttttgtgactttgtgaaggtttctttaagatgtgcattcctttctgcttgctctctagtaaatgttttactaccggga

SEQ ID NO: 7868 - DNA, 4148 bp, Homo sapiens
atatgcaacagtttaaactataggcatgttcatgtaaatatggtttctgtccaacccgttttctcttgggatttttggctagccccttgacgccactttttcttcattcgcagacccactttctagatgggtcatgaacactgtccacccaactgcagtttcccgtcagagtatctgaggagcctgtgaggcgttctggagctttaagcaacgggccgtgaggcggtggcggtggtggcggtggcggcggcggtggtggtggtggcggcggcggcggcgaagggggcggagaggaaggagcgcggcgggaccgggccgggacagcgcgtactttgggctccgggattcgctccgcgcccgcggttgtagcagctgccgctgcagccatagcagcaggtcagtcattggcaccatgaactggaataaaggtggtcctggcactaagcgaggatttggctttggaggttttgccatcagtgctgggaaaaaggaggaacccaaactcccacagcagtcccacagtgcctttggggcaaccagctcttcttctggatttggaaagtcagctccaccacagcttccttctttctacaaaattggatctaagcgggccaactttgatgaagaaaatgcctattttgaagatgaggaagaagattctagcaacgttgatttaccttacattcctgctgaaaactcaccaactcgccagcaattccattccaagccagtagattctgacagcgatgatgatcccttggaggcattcatggctgaagtggaggatcaggcagctagagacatgaagaggcttgaagaaaaggacaaggaaagaaaaaacgtaaagggtattcgagatgacattgaagaggaagatgaccaagaagcttattttcgatacatggcagaaaacccaactgctggtgtggttcaggaggaagaggaagacaatctagaatatgatagtgacggaaatccaattgcacctaccaaaaaaatcattgatcctcttccccccattgatcattcagagattgactatccaccatttgaaaaaaacttttacaatgagcatgaagagataaccaacctcactccacagcagttaatagatctccggcataagctcaatcttcgggtctctggtgctgcacctcctagaccaggaagtagctttgctcattttgggtttgacgaacaacttatgcaccagattcggaaatctgaatacacacagcccactccaatacagtgccagggtgtgcctgtggcattaagtggtagagacatgattggtattgccaaaacaggtagtgggaaaactgcagccttcatttggcccatgttgattcatataatggaccagaaggagttggaaccaggtgatggaccaattgcagtgattgtgtgtcctaccagggagctttgccagcagatccatgcagaatgtaagcggtttggaaaagcatataatcttcgatcagtggccgtatatggaggagggagtatgtgggagcaggccaaggcccttcaggagggggcagagattgttgtgtgtaccccaggtcgactgatagatcatgtgaaaaagaaagctaccaatcttcaaagagtctcttaccttgtgtttgatgaagcagatcgaatgtttgacatgggatttgagtaccaagttcgatccatagcaagtcatgttcgtcctgacaggcagactctcttatttagtgcaacttttcggaagaagattgaaaagttggccagagacatcctgatcgaccctattcgagtggtgcagggagatattggagaggcaaatgaagatgtgacacagattgtggagattctccattctggacctagtaaatggaactggcttacccggcgtctggtagaatttacctcttcagggagtgtcctcctctttgttactaaaaaagccaatgctgaagagctagcgaataaccttaaacaggagggtcataatcttgggctgctccatggggatatggatcagagtgagagaaacaaggtcatttcagactttaagaaaaaggacatcccagtcctggtggccacagatgttgcagcccgtggtctggacattccttcaattaagactgtcattaactatgatgtggcacgagacattgatacccacacgcataggattggccgcacaggaagagcgggtgagaaaggtgtggcctataccctactcactcccaaggacagcaattttgctggtgacctggtccggaacttggaaggagccaatcaacacgtttctaaggaactcctagatctggcaatgcagaatgcctggtttcggaaatctcgattcaaaggagggaaaggaaaaaagctgaacattggtggaggaggcctaggctacagggagcggcctggcctgggctctgagaacatggatcgaggaaataacaatgtaatgagcaattatgaggcctacaagccttccacaggagctatgggagatcgactaacggcaatgaaagcagctttccagtcacagtacaagagtcactttgttgcagccagtttaagtaatcagaaggctggaagttctgctgctggggcaagtgggtggactagtgcagggagcttgaattctgttccaactaactcagcacaacagggccataacagtcctgacagccccgtcaccagtgccgccaagggcatcccaggctttggcaatactggcaacatcagtggtgcccctgtgacctacccgtctgccggagcccaaggagtcaacaacacagcttcagggaataacagccgagaagggactgggggcagcaacgggaaaagagagagatatactgagaaccggggcagcagccgtcacagtcacggagagactggcaatcggcatagcgatagtccacgtcacggagatggtggtcgccatggagatggataccgccatccagaaagcagcagccgtcatactgatggccatcggcacggggagaacagacatggaggaagcgcaggccggcatggggagaaccggggtgcaaatgatggtcggaatggggaaagcaggaaagaagcttttaatcgtgagagcaagatggagcccaagatggaacccaaagtggacagcagcaagatggacaaggtggacagcaagacagataagacagctgacggctttgctgtcccagagccgcctaaacgcaagaaaagtcgatgggacagttagaggggatgtgctaaagcgtgaaatcagttgtccttaatttttagaaagattttggtaactaggtgtctcagggctgggttggggtccaaagtgtaaggaccccctgcccttagtggagagctggagcttggagacattaccccttcatcagaaggaattttcggatgttttcttgggaagctgttttggtccttggaagcagtgagagctgggaagcttcttttggctctaggtgagttgtcatgtgggtaagttgaggttatcttgggataaagggtcttctagggcacaaaactcactctaggtttatattgtatgtagcttatattttttactaaggtgtcaccttataagcatctataaattgacttctttttcttagttgtatggccaggcagtccccattttaggagttggcttctgcaaattcaatccattgagctaactgttggggagcaatttggtagttgtagacatttgcagggaagggagatgtctgattctaaatgggagttgatgctcaggtccccagccaggtttgcatccagccctgagacatgtaggaaacacctttcagacccaggctctgaagattcccagaagccacaaggattgaagggaaaaggtgatcctggtaactgttccaggattgctccaggtttgagatggtattgctaaatttaaaattaaacaagaaacccaacaacagcttttaaagtgtcttctatctcattgtattttttttaacttgccccaatgatagaaaagtcttttgctgaaatgattttgatgatttttgtttatcgtttataaaaaggaaaagaaatatacaaactttgacttttgtgactttgtgaaggtttctttaagatgtgcattcctttctgcttgctctctagtaaatgttttactaccggga

SEQ ID NO: 7869 - DNA, 2513 bp, Homo sapiens
agtgggcgggatagagagcgtgggcgggggggctagcctcgtgcgggctccttaagtagcggctgcgtggcttccctggcacgctactcttacgacgtcacggtcaggtggtgcagagctggacggcaacgacgtcggacgcgccccttcttggaacaatgtcccaccacggaggagctcccaaggcctctacgtgggtcgttgctagtcggcgaagctcgacagtgtcccgagcgccagagaggaggccggcggaggagttgaatcgaacaggtcctgagggatatagtgtcggcagaggtggtcgctggagaggcacctctaggcccccggaggccgtggccgctggtcacgaggaactgccgctgtgttttgctttgaagagccactttgttggcgcggtaatcggtcgtggtgggtcaaaaataaagaatatacaaagtacaacaaacaccacaatccaaataatacaagaacaaccagaatcattagtcaaaatttttggcagcaaggcaatgcaaacgaaagcaaaagcagtgatagacaattttgttaaaaagctagaagaaaattacaattcagaatgcggaattgatactgcattccaaccttctgttggaaaagatggaagcacagataacaatgttgttgcaggagatcggccattgatagattgggatcaaattagagaggaaggtttgaaatggcaaaaaacaaagtgggcagatttaccaccaattaagaaaaacttttataaagagtccactgccacaagtgccatgtcaaaagtagaagcagatagttggaggaaagaaaattttaatataacgtgggatgacttgaaggatggggagaaacgacctatccccaatcctacctgcacatttgatgacgcctttcaatgttatcctgaggttatggaaaacattaaaaaggcaggttttcaaaagccaacacctattcagtcacaggcatggcccattgtgttgcaaggaatagatcttataggagtagcccagactggaacaggaaagacattgtgttatttaatgcctggatttattcatctggtccttcaacccagccttaaaggtcaaaggaatagacccggcatgttagttctaactcccactcgggaattagcacttcaagtagaaggagaatgttgcaaatattcatataaagggcttcggagtgtttgtgtatatggtggtggaaatagagatgaacaaatagaagagcttaaaaaaggtgtagatatcataattgcaactcccggaagattgaatgatctgcaaatgagtaacttcgtcaatctgaagaatataacctacttggttttagatgaagcagacaagatgttggacatgggatttgaaccccagataatgaagattttgttagatgtgcgcccagataggcagacagttatgaccagtgctacatggcctcattcagttcatcgcctcgcacaatcttatttgaaagaaccaatgattgtctatgttggtacattggatctagttgctgtaagttcagtgaagcaaaatataattgtaaccaccgaggaagagaaatggagtcacatgcaaacttttctacagagtatgtcatccacagacaaagtcattgtcttcgtttctcgaaaagctgttgcggatcacttatcaagtgacctaatacttggaaatatatcagtagagtctctgcatggagatagagaacagagagatcgggagaaagcattagagaactttaaaacaggcaaagtgagaatactaattgcaactgatctagcctctagaggacttgatgtccatgacgttacacatgtctataattttgactttccacggaatattgaagaatacgtacaccgaatagggcgcacgggaagagcagggaggactggtgtttccattacaactttgactagaaatgattggagggttgcctctgaattgattaatattctggaaagagcaaatcagagtattccagaggagcttgtatcaatggctgagaggtttaaggcacatcaacagaaaagggaaatggaaagaaaaatggaaagacctcaaggaaggcccaagaagtttcattaatgtcttctgtactagtggggtagagaattcaagattttttagaaatatagtaagacggaagtattggacatgttggcagtatgaagagaccggactgatttgactgattcttaaaataatagtgtttgaaaatatagaatccagtgttttatactttctttaataaaaatagaagtatttaaacttggaagttgtttcctggatttttattaaggagtgtagcattagaatgtttttcttttaatcttttaaactgtctcctgtaattttgctgtatgtcataaggccagtctttcagaatttaatgttcagattttgtcatggcagtgaaaaagatgttttcaaacaaagaatcagcacctgaaaaaatactgttaataaatgttcgtttctgtgataaaaagacaa

SEQ ID NO: 7870 - DNA, 1057 bp, Homo sapiens
aggtggtgcagagctggacggcaacgacgtcggacgcgccccttcttggaacaatgtcccaccacggaggagctcccaaggcctctacgtgggtcgttgctagtcggcgaagctcgacagtgtcccgagcgccagagaggaggccggcggaggagttgaatcgaacaggtcctgagggatatagtgtcggcagaggtggtcgctggagaggcacctctaggcccccggaggccgtggccgctggtcacgaggaactgccgctgtgttttgctttgaagagccactttgttggcgcggtaatcggtcgtggtgggtcaaaaataaagaatatacaaagtacaacaaacaccacaatccaaataatacaagaacaaccagaatcattagtcaaaatttttggcagcaaggcaatgcaaacgaaagcaaaagcagtgatagacaattttgttaaaaagctagaagaaaattacaattcagaatgcggaattgatactgcattccaaccttctgttggaaaagatggaagcacagataacaatgttgttgcaggagatcggccattgatagattgggatcaaattagagaggaaggtttgaaatggcaaaaaacaaagtgggcaggaaagaaaattttaatataacgtgggatgacttgaaggatggggagaaacgacctatccccaatcctacctgcacatttgatgacgcctttcaatgttatcctgaggttatggaaaacattaaaaaggcaggttttcaaaagccaacacctattcagtcacaggcatggcccattgtgttgcaaggaatagatcttataggagtagcccagactggaacaggaaagacattgtgttatttaatgcctggatttattcatctggtccttcaacccagccttaaaggtcaaaggaatagacccggcatgttagttctaactcccactcgggaattagcacttcaagtagaaggagaatgttgcaaatattcatataaagggcttcggagtgtttgtgtatatggtggtggaaatagagatgaacaaatagaagagctt

SEQ ID NO: 7871 - DNA, 2114 bp, Homo sapiens
acctcattcatttctaccggtctctagtagtgcagcttcggctggtgtcatcggtgtccttcctccgctgccgcccccgcaaggcttcgccgtcatcgaggccatttccagcgacttgtcgcacgcttttctatatacttcgttccccgccaaccgcaaccattgacgccatgtcgggttattcgagtgaccgagaccgcggccgggaccgagggtttggtgcacctcgatttggaggaagtagggcagggcccttatctggaaagaagtttggaaaccctggggagaaattagttaaaaagaagaatttttatcaagagcaccctgatttggctaggcgcacagcacaagaggtggaaacatacagaagaagcaaggaaattacagttagaggtcacaactgcccgaagccagttctaaatttttatgaagccaatttccctgcaaatgtcatggatgttattgcaagacagaatttcactgaacccactgctattcaagctcagggatggccagttgctctaagtggattggatatggttggagtggcacagactggatctgggaaaacattgtcttatttgcttcctgccattgtccacatcaatcatcagccattcctagagagaggcgatgggcctatttgtttggtgctggcaccaactcgggaactggcccaacaggtgcagcaagtagctgctgaatattgtagagcatgtcgcttgaagtctacttgtatctacggtggtgctcctaagggaccacaaatacgtgatttggagagaggtgtggaaatctgtattgcaacacctggaagactgattgactttttagagtgtggaaaaaccaatctgagaagaacaacctaccttgtccttgatgaagcagatagaatgcttgatatgggctttgaaccccaaataaggaagattgtggatcaaataagacctgataggcaaactctaatgtggagtgcgacttggccaaaagaagtaagacagcttgctgaagatttcctgaaagactatattcatataaacattggtgcacttgaactgagtgcaaaccacaacattcttcagattgtggatgtgtgtcatgacgtagaaaaggatgaaaaacttattcgtctaatggaagagatcatgagtgagaaggagaataaaaccattgtttttgtggaaaccaaaagaagatgtgatgagcttaccagaaaaatgaggagagatgggtggcctgccatgggtatccatggtgacaagagtcaacaagagcgtgactgggttctaaatgaattcaaacatggaaaagctcctattctgattgctacagatgtggcctccagagggctagatgtggaagatgtgaaatttgtcatcaattatgactaccctaactcctcagaggattatattcatcgaattggaagaactgctcgcagtaccaaaacaggcacagcatacactttctttacacctaataacataaagcaagtgagcgaccttatctctgtgcttcgtgaagctaatcaagcaattaatcccaagttgcttcagttggtcgaagacagaggttcaggtcgttccaggggtagaggaggcatgaaggatgaccgtcgggacagatactctgcgggcaaaaggggtggatttaatacctttagagacagggaaaattatgacagaggttactctagcctgcttaaaagagattttggggcaaaaactcagaatggtgtttacagtgctgcaaattacaccaatgggagctttggaagtaattttgtgtctgctggtatacagaccagttttaggactggtaatccaacagggacttaccagaatggttatgatagcactcagcaatacggaagtaatgttccaaatatgcacaatggtatgaaccaacaggcatatgcatatcctgctactgcagctgcacctatgattggttatccaatgccaacaggatattcccaataagactttagaagtatatgtaaatgtctgtttttcataattgctctttatattgtgtgttatctgacaagatagttatttaagaaacatgggaattgcagaaatgactgcagtgcagcagtaattatggtgcac

SEQ ID NO: 7872 - DNA, 2105 bp, Homo sapiens
acctcattcatttctaccggtctctagtagtgcagcttcggctggtgtcatcggtgtccttcctccgctgccgcccccgcaaggcttcgccgtcatcgaggccatttccagcgacttgtcgcacgcttttctatatacttcgttccccgccaaccgcaaccattgacgccatgtcgggttattcgagtgaccgagaccgcggccgggaccgagggtttggtgcacctcgatttggaggaagtagggcagggcccttatctggaaagaagtttggaaaccctggggagaaattagttaaaaagaagtggaatcttgatgagctgcctaaatttgagaagaatttttatcaagagcaccctgatttggctaggcgcacagcacaagaggtggaaacatacagatatttgcttcctgccattgtccacatcaatcatcagccattcctagagagaggcgatgggcctatttgtttggtgctggcaccaactcgggaactggcccaacaggtgcagcaagtagctgctgaatattgtagagcatgtcgcttgaagtctacttgtatctacggtggtgctcctaagggaccacaaatacgtgatttggagagaggtgtggaaatctgtattgcaacacctggaagactgattgactttttagagtgtggaaaaaccaatctgagaagaacaacctaccttgtccttgatgaagcagatagaatgcttgatatgggctttgaaccccaaataaggaagattgtggatcaaataagacctgataggcaaactctaatgtggagtgcgacttggccaaaagaagtaagacagcttgctgaagatttcctgaaagactatattcatataaacattggtgcacttgaactgagtgcaaaccacaacattcttcagattgtggatgtgtgtcatgacgtagaaaaggatgaaaaacttattcgtctaatggaagagatcatgagtgagaaggagaataaaaccattgtttttgtggaaaccaaaagaagatgtgatgagcttaccagaaaaatgaggagagatgggtggcctgccatgggtatccatggtgacaagagtcaacaagagcgtgactgggttctaaatgaattcaaacatggaaaagctcctattctgattgctacagatgtggcctccagagggctagatgtggaagatgtgaaatttgtcatcaattatgactaccctaactcctcagaggattatattcatcgaattggaagaactgctcgcagtaccaaaacaggcacagcatacactttctttacacctaataacataaagcaagtgagcgaccttatctctgtgcttcgtgaagctaatcaagcaattaatcccaagttgcttcagttggtcgaagacagaggttcaggtcgttccaggggtagaggaggcatgaaggatgaccgtcgggacagatactctgcgggcaaaaggggtggatttaatacctttagagacagggaaaattatgacagaggttactctagcctgcttaaaagagattttggggcaaaaactcagaatggtgtttacagtgctgcaaattacaccaatgggagctttggaagtaattttgtgtctgctggtatacagaccagttttaggactggtaatccaacagggacttaccagaatggttatgatagcactcagcaatacggaagtaatgttccaaatatgcacaatggtatgaaccaacaggcatatgcatatcctgctactgcagctgcacctatgattggttatccaatgccaacaggatattcccaataagactttagaagtatatgtaaatgtctgtttttcataattgctctttatattgtgtgttatctgacaagatagttatttaagaaacatgggaattgcagaaatgactgcagtgcagcagtaattatggtgcactttttcgctatttaagttggatatttctctacattcctgaaacaatttttaggttttttttgtactagaaaatgcaggcagtgttttcacaaaagtaaatgtacagtgatttgaaatacaataaatgaaggcaatgcatggccttccaataaaaaatatttgaagact

SEQ ID NO: 7873 - DNA, 3759 bp, Homo sapiens
atagagcggctcccagcgttccctgcggcgtaggaggcggtccagactataaaagcggctgccggaaagcggccggcacctcattcatttctaccggtctctagtagtgcagcttcggctggtgtcatcggtgtccttcctccgctgccgcccccgcaaggcttcgccgtcatcgaggccatttccagcgacttgtcgcacgcttttctatatacttcgttccccgccaaccgcaaccattgacgccatgtcgggttattcgagtgaccgagaccgcggccgggaccgagggtttggtgcacctcgatttggaggaagtagggcagggcccttatctggaaagaagtttggaaaccctggggagaaattagttaaaaagaagtggaatcttgatgagctgcctaaatttgagaagaatttttatcaagagcaccctgatttggctaggcgcacagcacaagaggtggaaacatacagaagaagcaaggaaattacagttagaggtcacaactgcccgaagccagttctaaatttttatgaagccaatttccctgcaaatgtcatggatgttattgcaagacagaatttcactgaacccactgctattcaagctcagggatggccagttgctctaagtggattggatatggttggagtggcacagactggatctgggaaaacattgtcttatttgcttcctgccattgtccacatcaatcatcagccattcctagagagaggcgatgggcctatttgtttggtgctggcaccaactcgggaactggcccaacaggtgcagcaagtagctgctgaatattgtagagcatgtcgcttgaagtctacttgtatctacggtggtgctcctaagggaccacaaatacgtgatttggagagaggtgtggaaatctgtattgcaacacctggaagactgattgactttttagagtgtggaaaaaccaatctgagaagaacaacctaccttgtccttgatgaagcagatagaatgcttgatatgggctttgaaccccaaataaggaagattgtggatcaaataagacctgataggcaaactctaatgtggagtgcgacttggccaaaagaagtaagacagcttgctgaagatttcctgaaagactatattcatataaacattggtgcacttgaactgagtgcaaaccacaacattcttcagattgtggatgtgtgtcatgacgtagaaaaggatgaaaaacttattcgtctaatggaagagatcatgagtgagaaggagaataaaaccattgtttttgtggaaaccaaaagaagatgtgatgagcttaccagaaaaatgaggagagatgggtggcctgccatgggtatccatggtgacaagagtcaacaagagcgtgactgggttctaaatgaattcaaacatggaaaagctcctattctgattgctacagatgtggcctccagagggctagatgtggaagatgtgaaatttgtcatcaattatgactaccctaactcctcagaggattatattcatcgaattggaagaactgctcgcagtaccaaaacaggcacagcatacactttctttacacctaataacataaagcaagtgagcgaccttatctctgtgcttcgtgaagctaatcaagcaattaatcccaagttgcttcagttggtcgaagacagaggttcaggtcgttccaggggtagaggaggcatgaaggatgaccgtcgggacagatactctgcgggcaaaaggggtggatttaatacctttagagacagggaaaattatgacagaggttactctagcctgcttaaaagagattttggggcaaaaactcagaatggtgtttacagtgctgcaaattacaccaatgggagctttggaagtaattttgtgtctgctggtatacagaccagttttaggactggtaatccaacagggacttaccagaatggttatgatagcactcagcaatacggaagtaatgttccaaatatgcacaatggtatgaaccaacaggcatatgcatatcctgctactgcagctgcacctatgattggttatccaatgccaacaggatattcccaataagactttagaagtatatgtaaatgtctgtttttcataattgctctttatattgtgtgttatctgacaagatagttatttaagaaacatgggaattgcagaaatgactgcagtgcagcagtaattatggtgcactttttcgctatttaagttggatatttctctacattcctgaaacaatttttaggttttttttgtactagaaaatgcaggcagtgttttcacaaaagtaaatgtacagtgatttgaaatacaataaatgaaggcaatgcatggccttccaataaaaaatatttgaagactgaattaagtggaaattgtactttattttatataatgtcatgtaaaactttgcttaagatggtctggttttttttttgtttttgtttggttttttttttccatgaaaacaaatgactgttcctttttatttaatttgggaggcagggggaatcagaaggcccttctttataatgagctattcatattgcaggagtcagaatgaattgatacaggtgaatttttagttacaggctaaattgcataaaagctttgtcagcttccagcatcaggggagtcatttaatagcctttttccttatttgctagtatggttaaatgagaaaatagtaaaatagatacaaagtcatctatatagtgtgagaacgtgggtgactttttcaaagtttataatttaaaaagctccaaataactggctttttcaagagacttatactcatgctcttggctatactgtgaattactgaaatgttgaacaaacctgtgaaagacatacattagccctttaagatggccaggagctaagcttgagtctcctttactgaatttcgttcttagtgcaggttacttgtagattctagtcttcacaggctccctggggctcttaactagtcacactgggagtcatgaatgtctttccaataattcagggaattctagagatcctcaaactgtaaggtctattcatactcaacacaaggaaaaaacctcattaaaattaatgactaatcaggaggcaacgtaaccaaaagcacagtgaatgaaagttttcatggtaggttcaacatgggtttattgctagaaagatccaggggatagctttaggtttaacttcggctcaccaacgtaactttctaatcatttatttcagtaatagctagaagtgggtctgaatgttttcccagagtctgatacgtgtttttttttgccagaagagaggtcttcaggagacttcatttaaattctgattattaaactgaggctttaattgatgttaatgccttatgtcaaatgtaaagttagaatttgctagggctgggatagggagtgatatttctaggacttagacattgaaaactaattcagcctgtagtaacctggatggttttcaatggcatggttagtcaaattcatggttttaaacttagaagcagctttcgggggagagggtaggttggagcatttattacatattttactgtttaatgtcttaaccgtgggccttttaatttgtaaacactgaaatgattgttgggctgtggaaaacatttacctatttaccttggaagttttaaaagacagtccactttttagcatgtgtgttgtgtccagcctgtggtcgtcttaactaataaatgtgatttttctccc

SEQ ID NO: 7874 - DNA, 6359 bp, Homo sapiens
agtctgcgcaggcgccgtagaactgtggcgctttctgggtaaagatggacgtccacgatctctttcgccggctcggcgcgggggccaaattcgacacgagacgcttctcggcagacgcagctcgattccagataggaaaaaggaaatatgactttgattcttcggaggtgcttcagggactggacttttttggaaacaagaagtctgtcccaggtgtgtgtggagcatcacaaacacatcagaagccccaaaatggagagaaaaaagaagagagcctaactgaaaggaagagggagcagagcaagaaaaaaaggaagacgatgacttcagaaattgcttcccaagaagaaggtgctactatacagtggatgtcatctgtagaagcaaagattgaagacaaaaaagttcagagagaaagtaaactaacttccggaaagttggagaatctcagaaaagaaaagataaacttcttgcggaataaacacaaaattcacgtccaaggaaccgatcttcctgacccaattgctacatttcagcaacttgaccaggaatataaaatcaattctcgactacttcagaacattctagatgcaggtttccaaatgcctacgccaatccaaatgcaagccatcccagttatgctgcatggtcgggaacttctggcttctgctccaactggatctggaaaaacattagcttttagcattcctattttaatgcagctgaaacaacccgcaaataaaggcttcagagccctgattatatcaccaacacgagaacttgccagccagattcacagagagttaataaaaatttctgagggaacaggattcaggatacacatgatccacaaagcagcagtggcagccaagaaatttggacctaaatcatctaaaaagtttgatattcttgtgactactccaaatcgactaatctatttattaaagcaagatccccccggaatcgacctagcaagtgttgagtggcttgtagtagacgaatcagataaactgtttgaagatggcaaaactgggttcagagaccagctggcttccattttcctggcctgcacatcccacaaggtccgaagagctatgttcagtgcaacttttgcatatgatgttgaacagtggtgcaaactcaacctggacaatgtcatcagtgtgtccattggagcaaggaattctgcagtagaaactgtagaacaagagcttctctttgttggatctgagaccggaaaacttctggccatgagagaacttgttaaaaagggtttcaatccacctgttcttgtttttgttcagtccattgaaagggctaaagaactttttcatgagctcatatatgaaggtattaatgtggatgttattcatgcagagagaacacaacaacagagagataacacagtccacagtttcagagcaggaaaaatctgggttctgatttgtacagccttgctagcaagagggattgattttaaaggtgtgaacttggtgatcaactatgactttccaactagctcagtggaatatatccacaggataggtcgaactggaagagcagggaataagggaaaagcaattacatttttcactgaggatgataagccattattaagaagcgttgctaatgttatacagcaggctgggtgtcctgtaccagaatacataaaaggttttcagaaactactaagcaaacaaaagaaaaagatgattaagaaaccattggaaagggagagcattagtacaactccaaaatgtttcttagaaaaagctaaggataaacagaaaaaggtcactggtcagaacagcaagaagaaagtagctcttgaagacaaaagttaaaaacagactttaaaaatactgtcccagaaatgtaattttatgatcccagcatgaatgttattttcatggaatacttgaagtcttacagtcacctgtaccaaacatttgaaatcaactacaagtacatgggactggtgataaatgatcctaaactatcaagtcagtttcaatttgtaggtgccttttttttttcctgtagagatgagggtcttgccatgttgtccaggctggtcttgaactcctgacctcacacaatcctcctgccttagcctcctgagtaactgagattacaggcacaagctgctgcacccagctctgtaggtgacttttaaatgattatacaatggaaataacattcattgacatttctgtggtttgaatccagagagatacttcttatagaaaaacaaatgtttatgctaaaaataacaccaaaatgtggtgaactcttaaggacttttcccttcaagtgtgaaggaaggtgtgatgaatgctgtggagaggcatctggaacagaaattcaaaataaagccttgacattaaataccccttccactgctcactttgtggatggtagcatgagctgtctaccaagaagaaacctgctgctctcttaattttaatatttcctaatttgttgatggccttttgtgttgtgaaccacaacaaagagaggcctcttttgtggctggttattccagttccctgggattttaaattctttggtctattaagtatccttgtattggatacgtaataccttagtgctgtcataatgttgtacaagatcatgatcagcttctccctttcttcattttctgtgatttaaccatgttctttcctgtctctttccatttaagatattttatttgaatactgataaacattttatcctgataaggaagaatgttcttgttacttgatatacctctgtcttcattctcttacagcttatctttccttaggttgatggtgcctcatttaataagtagatctctacttaagctaaaggattatgatcatatggtgttggagactattagctattagatttttctcaaaatatgagttttgtacaatggaatgaaaaagtgacttcatatacgtaagactggtgcctaagaatgacttgaatgttatcagtactaccacagaactataatatacattgccttttctcagcagcatttgaattcaacttatttatttcctctatttgtagctttttgttctagagtcagaacaggtggactttgctttgaatattttagatgggacaaaaattgttcatcttcggaatttatttaaagaaagatctactggtacagggtgtaaaaatacttacaagaatatgatttttttgtttgttcatgcaaacagatcctttacccaatatatattctggaggtaggtatactggtgcaacccatttgccagctgtgtgactttgagtaagttcttaatttctcagagtttcagtgttctcatctataaaattatgtctccaattgtgagtacctagcactgtacctgatacatagtaaactcacaataaatatttcttaaacatagattttgttaggaatacaggcttgataacacagtccttacccttacaatgtaatgttagagataaaggagcaaatagagtcacgcatcacttaatgacagagatatgttctgagaaatgcatcgttaggtgatattgtcattgtgtaaacatcatgttgtttacttccacaaacctagatggtatagcctaccagtacacctaggctatatggtatagtctgttgctcctaggctacaaacccgtatagcatgttactgtcctgcatgctatagacagttggaacatgtagacttgtataaacactgcacacttaacctatactaaatttattgaaaatatttttcttggccaggcgtagtggctcatgcctgtaatcctaacacttcgggaggcctaggcgggcaggttgtctgagctcaggagtttagagaccagcccgggcaacatggcaaaaccccatctctactaaaaaaaataccaaaaaaagttagccgggtgtggtggcatagtcccggctactcaggagtctgaggcaggagaatagcttgaacctgtgaggcggaggttgcagtaagccgagatcgcgctactgcactccagcctgggcgacagggcaagactgtcttgaaaataaacacacacacacacattatatatattatgtattatatatattagatatatattttttcttcaataaattaaccttagcttactgtaacttttactttatgagtttttttgttttgttttgttttttttttttgagaaacagggtctgttacctaatttggagtttagtggcacaatcatggcccactgcagccttgacctcttagactcaagtgatcctcaaacctcagcctcccgagtagctggtactataggtgcgggccaccaacactcagctaatttttaaattttgtagagacgaggtcttgcttgttgtccagttgggttttttagacttttttttttttttttttttggagatggagtcttgctctgttgcccaggctggagtgcagtggcatgatctcggctcactgcaacctctgactcctgggttcaagtgattctcctgcctcagcctcccgagttgctgggactacaggcatgcgccaccacacccagctaatttttgtatttttagtgacagggtttcaccatgttggccaggctggtctcaaactcctgacctggagtgagccactatatctggcctttataaacttttttgattcttgtcataacacttagcctaaaatgcaaatgtacagctgtagaaaaatactttatttctttatatccttattctagaagctttttttctattaatttttgtttgtttgttttgttttactatttacttctaaaacttttttgttaaaaaccatggcacaaacacacacattatgctaggcatacaaaaggtcaggatcatcagtctcactgtcttccacccccacttctcatcccaccattgtatctgctgtctgtggctgaccaaaacatcatcatgtagcacatgactagtgtggcaagtgctctgttagatgtaaggccatgatgctaaagcatcacaagagggcatctaacccagattggggatgtcatggaaggccgacatcctgagttgaatcctgcaaatgtaaaaaccaataggcaaagaagaggaacaaaaaggattccaggacaaactgaggtcacatctatgatccttgactttattgtgtctgtttaaagtatctacagtaacctgtatcaacttagtcagtgtattaatactaaatttagctccttcaaagcagttggaactatgtgctacataaatttcagcttcacacaaggaagggaaggagtgaaattagtgaacaggcagttacagcaaaagaaaaaacataaaaattgaatagctggctctggtgaaatgagcaaggactttagagtcaaactggcctggatttgaatcctgatcctcattgcttgtagctgtatgatctggacaaatgacagtagctgtttctaaccttgattttctcatctgtaagatgccaattgtaactcctaaggatactgaggattttttaaaatgcgtgtacagttcctgaccagtggtttgtgcctaataacttattacaaattattacccagtaaaaaccttgagacaagagtgaaaacgtaaagctaattaatccattacttgttagcaagcaaactacgtgcttgagaaaattactcaactttcatgttttacttccagacagtagtttgattaaaagaaaaaaaaaaatcacagcccaggcatgtggctcacaccctggcacttggaggccgaggtgggagcatagcttgagcctagcagtttgaaactagcctgggcaacatagatcctatctctacaaaaaaaaaaaaaaaaaaaaaaaaattggcccggtgtggtggtgcatgcctgcggtcccagctactcaggaggctgaggcgagaggatcgcttgagccagggaggctgaggctgctgtgagccatgatcatgccactgcactccagcctggacaacagagcaagaccctgtctcaaaaaaaaaaaaaaatcagtaaaaaatatgccgaaatagcttcagagtaattatgaattgccttccaaaaaccactgttttgcacttgcctgcaagaataggaaaaacaaaaggactgtaaggtggcaggatggcagaaccaaacaagagtagtacaccttggagttttttcgaaatatgggttgggtttttgggctcttggttgatttaaaataaaatttaaatgccttcagcgtctgtgataggtgccaacatgaagctaccgagttccagagaaagaggggagagctgatcactcatcagtgctgcgagactatcaaagggcccttcaggacctatctgttctttgtgtgtaaagagtaaca

SEQ ID NO: 7875 - DNA, 3881 bp, Homo sapiens
cgcaggcgccgtagaactgtggcgctttctgggtaaagatggacgtccacgatctctttcgccggctcggcgcgggggccaaattcgacacgagacgcttctcggcagacgcagctcgattccagataggaaaaaggaaatatgactttgattcttcggaggtgcttcagggactggacttttttggaaacaagaagtctgtcccaggtgtgtgtggagcatcacaaacacatcagaagccccaaaatggagagaaaaaagaagagagcctaactgaaaggaagagggagcagagcaagaaaaaaaggaagacgatgacttcagagacagggtttcaccatgttagccagtatggtctcgatctcctgacctcgtgattcacccaccttgggctcccaaagtgctgggattacagatgtgagccaccacgcccagccagaaattgcttcccaagaagaaggtgctactatacagtggatgtcatctgtagaagcaaagattgaagacaaaaaagttcagagagaaagtaaactaacttccggaaagttggagaatctcagaaaagaaaagataaacttcttgcggaataaacacaaaattcacgtccaaggaaccgatcttcctgacccaattgctacatttcagcaacttgaccaggaatataaaatcaattctcgactacttcagaacattctagatgcaggtttccaaatgcctacgccaatccaaatgcaagccatcccagttatgctgcatggtcgggaacttctggcttctgctccaactggatctggaaaaacattagcttttagcattcctattttaatgcagctgaaacaacccgcaaataaaggcttcagagccctgattatatcaccaacacgagaacttgccagccagattcacagagagttaataaaaatttctgagggaacaggattcaggatacacatgatccacaaagcagcagtggcagccaagaaatttggacctaaatcatctaaaaagtttgatattcttgtgactactccaaatcgactaatctatttattaaagcaagatccccccggaatcgacctagcaagtgttgagtggcttgtagtagacgaatcagataaactgtttgaagatggcaaaactgggttcagagaccagctggcttccattttcctggcctgcacatcccacaaggtccgaagagctatgttcagtgcaacttttgcatatgatgttgaacagtggtgcaaactcaacctggacaatgtcatcagtgtgtccattggagcaaggaattctgcagtagaaactgtagaacaagagcttctctttgttggatctgagaccggaaaacttctggccatgagagaacttgttaaaaagggtttcaatccacctgttcttgtttttgttcagtccattgaaagggctaaagaactttttcatgagctcatatatgaaggtattaatgtggatgttattcatgcagagagaacacaacaacagagagataacacagtccacagtttcagagcaggaaaaatctgggttctgatttgtacagccttgctagcaagagggattgattttaaaggtgtgaacttggtgatcaactatgactttccaactagctcagtggaatatatccacaggataggtcgaactggaagagcagggaataagggaaaagcaattacatttttcactgaggatgataagccattattaagaagcgttgctaatgttatacagcaggctgggtgtcctgtaccagaatacataaaaggttttcagaaactactaagcaaacaaaagaaaaagatgattaagaaaccattggaaagggagagcattagtacaactccaaaatgtttcttagaaaaagctaaggataaacagaaaaaggtcactggtcagaacagcaagaagaaagtagctcttgaagacaaaagttaaaaacagactttaaaaatactgtcccagaaatgtaattttatgatcccagcatgaatgttattttcatggaatacttgaagtcttacagtcacctgtaccaaacatttgaaatcaactacaagtacatgggactggtgataaatgatcctaaactatcaagtcagtttcaatttgtaggtgccttttttttttcctgtagagatgagggtcttgccatgttgtccaggctggtcttgaactcctgacctcacacaatcctcctgccttagcctcctgagtaactgagattacaggcacaagctgctgcacccagctctgtaggtgacttttaaatgattatacaatggaaataacattcattgacatttctgtggtttgaatccagagagatacttcttatagaaaaacaaatgtttatgctaaaaataacaccaaaatgtggtgaactcttaaggacttttcccttcaagtgtgaaggaaggtgtgatgaatgctgtggagaggcatctggaacagaaattcaaaataaagccttgacattaaataccccttccactgctcactttgtggatggtagcatgagctgtctaccaagaagaaacctgctgctctcttaattttaatatttcctaatttgttgatggccttttgtgttgtgaaccacaacaaagagaggcctcttttgtggctggttattccagttccctgggattttaaattctttggtctattaagtatccttgtattggatacgtaataccttagtgctgtcataatgttgtacaagatcatgatcagcttctccctttcttcattttctgtgatttaaccatgttctttcctgtctctttccatttaagatattttatttgaatactgataaacattttatcctgataaggaagaatgttcttgttacttgatatacctctgtcttcattctcttacagcttatctttccttaggttgatggtgcctcatttaataagtagatctctacttaagctaaaggattatgatcatatggtgttggagactattagctattagatttttctcaaaatatgagttttgtacaatggaatgaaaaagtgacttcatatacgtaagactggtgcctaagaatgacttgaatgttatcagtactaccacagaactataatatacattgccttttctcagcagcatttgaattcaacttatttatttcctctatttgtagctttttgttctagagtcagaacaggtggactttgctttgaatattttagatgggacaaaaattgttcatcttcggaatttatttaaagaaagatctactggtacagggtgtaaaaatacttacaagaatatgatttttttgtttgttcatgcaaacagatcctttacccaatatatattctggaggtaggtatactggtgcaacccatttgccagctgtgtgactttgagtaagttcttaatttctcagagtttcagtgttctcatctataaaattatgtctccaattgtgagtacctagcactgtacctgatacatagtaaactcacaataaatatttcttaaacatagattttgttaggaatacaggcttgataacacagtccttacccttacaatgtaatgttagagataaaggagcaaatagagtcacgcatcacttaatgacagagatatgttctgagaaatgcatcgttaggtgatattgtcattgtgtaaacatcatgttgtttacttccacaaacctagatggtatagcctaccagtacacctaggctatatggtatagtctgttgctcctaggctacaaacccgtatagcatgttactgtcctgcatgctatagacagttggaacatgtagacttgtataaacactgcacacttaacctatactaaatttattgaaaatatttttcttggccaggcg

SEQ ID NO: 7876 - DNA, 4377 bp, Homo sapiens
ccttctgcgttcccagcgcgcggcccgaatggcggccgacaagggcccggcggctggacctcggtcgcgagctgccatggcccagtggaggaagaagaaagggctccggaagcgccgaggcgcggcctcccaggcccgcggcagcgactcggaggacggcgagtttgagatccaggcggaagatgacgcccgggcccggaagctgggacctggaagacccctgcccaccttccccacctcggaatgcacctcggatgtggagccggacacccgggagatggtgcgtgcccagaacaagaagaagaagaagtctggaggcttccagtccatgggcctgagctacccggtgttcaaaggcatcatgaagaaggggtacaaggtgccaacacccatccagaggaagaccatcccggtgatcttggatggcaaggacgtggtggccatggcccggacgggcagtggcaagacagcctgcttcctcctcccaatgttcgagcggctcaagacccacagtgcccagaccggggcccgcgccctcatcctctcgccgacccgagagctggccctgcagaccctgaagttcactaaggagctaggcaagttcactggcctcaagactgccctgatcctgggtggagacaggatggaagaccagtttgcagccctgcacgaaaatcccgacataattattgccacgcccggacggttggtgcatgtggctgtggaaatgagcctgaagctgcagagtgtggaatacgtggtgttcgatgaagctgaccggctttttgaaatgggtttcgcagagcagctgcaggagatcatcgcccgcctccccgggggccaccagacggtgctgttctccgccacgctgcccaaactgctggtggaatttgcccgggctggcctcacggagcccgtgctcatccggcttgacgtggataccaagctcaacgagcagctgaagacctccttcttcctcgtgcgggaggacaccaaggctgccgtgctgctccacctgctgcacaacgtggtgcggccccaggaccagaccgtggtgtttgtggccacgaagcaccacgccgagtacctcactgagctgctgacgacccagcgggtgagctgcgcccacatctacagtgccctagacccgacagcccgcaagatcaatctcgccaaattcacgcttggcaagtgctccactctcattgtgactgacctggccgcccgaggcctggacatcccgctgctggacaatgtcatcaactacagcttccccgccaagggcaaactcttcctgcaccgcgtgggccgtgtggctcgggctggccgaagtggcacagcctactccttggtggcccctgatgaaatcccctacctgctggatctgcacctgttcctgggccgctccctcaccctcgcccgacccctcaaggagccctcaggtgtggccggtgtggatggcatgctgggtcgggtgccacagagtgtggtggacgaggaggacagtggtctgcagagcaccctggaggcatcgctggagctacggggcctggcccgcgttgctgataacgcccagcagcagtatgtgcgctcacgcccggcgccctcgcctgagtccatcaagagggccaaggagatggaccttgtggggctgggcctgcaccccctcttcagctcgcgttttgaggaggaggagctgcagcggctgaggctggtggacagcataaagaactaccgctcccgggcgactatctttgagatcaacgcctccagccgagacctgtgcagccaggtgatgcgcgccaagcggcagaaggaccgcaaggccatcgcccgcttccagcagggacagcaggggcggcaggagcagcaggagggcccagtgggcccagccccgagccgcccagcactgcaggagaagcagcctgagaaggaggaggaggaggaggcgggagagagtgtggaggacattttctcagaggtcgtgggccggaagcggcagcggtcaggacccaacaggggagccaagaggcggagggaggaggcccggcagcgggaccaggaattctacatcccctaccggcccaaggactttgacagcgagcggggcctgagcatcagcggggaagggggagcctttgagcagcaggcagctggcgctgtcctggacttgatgggggatgaagcccagaacctgacgaggggccggcagcagctcaagtgggaccgtaagaagaagcggtttgtgggacagtcaggacaggaagacaagaagaagattaagacagagagcggccgctacatcagcagctcctacaagcgagacctctatcagaagtggaaacagaaacagaaaattgatgatcgtgactcggacgaagaaggggcatctgaccggcgaggcccagagcgaagaggtgggaagcgagaccgtggccaaggtgcatcccggccccacgccccaggcacccctgcaggccgagtccgcccggaactcaagaccaagcagcagatcctgaagcagcggcgccgggcccagaagctgcacttcctgcagcgtggtggcctcaagcagctctctgcccgcaaccgccgccgcgtccaggagctgcagcagggcgccttcggccggggtgcccgctccaagaagggcaagatgcggaagaggatgtgaggaccaggacccagccccgtggctccttgattggccttagggtgggcatcagcagacgttcccgtgcaccactgtgtgcctggccctgtgctgggcactgggggcactccctgcaggagccatcatctgtgaaaaggagcactgtatggccacagaagggcagcagctgcgtcagcctaagacagagacatttgaacagggccttgaagggtgtgcaggagttcgccagcaaagccaggcaggccaagacttgagttggcaactcagctgctgctgcttccatgtgttctgggttcagaggtcatggctgcaccggtcagagccctgagtgcctcagggtttggcaatggaatttttaatgtaataaatctttattgagcactgctggtggccaggagtgcggtctacttggggaactggaatggagagacccaggtactaaaatcccagctaacgtggcagaggagttgcgggtctcctgagggtgagttctgctgccttgtccatttagcgatgaggaaagtgaagctcagagcacaaaccaggtgccagaggcgggagttggtcccccttcctcccactggacatggttgcagctgggagtgggctgggggaggggaacaggatgcccagcccagggggcaaggacacagctgctcccctctggctatgaagaggttaacgcggcccctccacacctggaggtcagaacctggcctgtcctctgtcttcttgccacccaccccctgtttgaggttctgagaaggtcaagggcagccccagcagctggattctcaggctgggcccctcacctggcagagtccatagtggagggggccttggtgatctctcatctagcatggaccctgttctgagacctgacaaagagttttttttcatgccccaaccaccctggcagggagggcctggtctgatctcattttagaggcagttgccccacacatagccccttgaccttcccatcacctcctcatcagggcctgcatttatggagtgcttgctatgtgcccctcatggcaggcccacagcactctgaacaggcacagccctcccatcttcccaatgaggaaacggattcaggaagagccactcagtccacaccccattggaaatgtgggccctcctatctcagggtctctcaggggttccctctcccgctgctcacctgtgtcagggctaggaggcaggggctgcaggctcagcctgacccaggccggccagcatggcagagaggtcctgcatgaacagcttcacctgggggggcccagcacgaagtcacatcccagccccagagtcactgtccagcccccacccctcaacacgcgggggaggccgaaaggtagggcggggactggagatcccctcattaaaagaacagtgatgatggtggttcccagaggtggtgactgagatcctaaaccgttctgggttttgaaagcctcaggccaaccttcccaactgctgcgtgagcagacaccttcacagcttcctcgctgctgtcacctgcactatccaattagtattttcatttacatcaatcagctttattttcttgtaactggatcagtcatattcattggtttgtgacctactcttatctccgtgggtggctctccttttgttttaattaacttctttatgaatatgaacttaataaataccatggatccattgtaaaaact

SEQ ID NO: 7877 - DNA, 4380 bp, Homo sapiens
ccttctgcgttcccagcgcgcggcccgaatggcggccgacaagggcccggcggctggacctcggtcgcgagctgccatggcccagtggaggaagaagaaagggctccggaagcgccgaggcgcggcctcccaggcccgcggcagcgactcggaggacggcgagtttgagatccaggcggaagatgacgcccgggcccggaagctgggacctggaagacccctgcccaccttccccacctcggaatgcacctcggatgtggagccggacacccgggagatggtgcgtgcccagaacaagaagaagaagaagtctggaggcttccagtccatgggcctgagctacccggtgttcaaaggcatcatgaagaaggggtacaaggtgccaacacccatccagaggaagaccatcccggtgatcttggatggcaaggacgtggtggccatggcccggacgggcagtggcaagacagcctgcttcctcctcccaatgttcgagcggctcaagacccacagtgcccagaccggggcccgcgccctcatcctctcgccgacccgagagctggccctgcagaccctgaagttcactaaggagctaggcaagttcactggcctcaagactgccctgatcctgggtggagacaggatggaagaccagtttgcagccctgcacgaaaatcccgacataattattgccacgcccggacggttggtgcatgtggctgtggaaatgagcctgaagctgcagagtgtggaatacgtggtgttcgatgaagctgaccggctttttgaaatgggtttcgcagagcagctgcaggagatcatcgcccgcctccccgggggccaccagacggtgctgttctccgccacgctgcccaaactgctggtggaatttgcccgggctggcctcacggagcccgtgctcatccggcttgacgtggataccaagctcaacgagcagctgaagacctccttcttcctcgtgcgggaggacaccaaggctgccgtgctgctccacctgctgcacaacgtggtgcggccccaggaccagaccgtggtgtttgtggccacgaagcaccacgccgagtacctcactgagctgctgacgacccagcgggtgagctgcgcccacatctacagtgccctagacccgacagcccgcaagatcaatctcgccaaattcacgcttggcaagtgctccactctcattgtgactgacctggccgcccgaggcctggacatcccgctgctggacaatgtcatcaactacagcttccccgccaagggcaaactcttcctgcaccgcgtgggccgtgtggctcgggctggccgaagtggcacagcctactccttggtggcccctgatgaaatcccctacctgctggatctgcacctgttcctgggccgctccctcaccctcgcccgacccctcaaggagccctcaggtgtggccggtgtggatggcatgctgggtcgggtgccacagagtgtggtggacgaggaggacagtggtctgcagagcaccctggaggcatcgctggagctacggggcctggcccgcgttgctgataacgcccagcagcagtatgtgcgctcacgcccggcgccctcgcctgagtccatcaagagggccaaggagatggaccttgtggggctgggcctgcaccccctcttcagctcgcgttttgaggaggaggagctgcagcggctgaggctggtggacagcataaagaactaccgctcccgggcgactatctttgagatcaacgcctccagccgagacctgtgcagccaggtgatgcgcgccaagcggcagaaggaccgcaaggccatcgcccgcttccagcagggacagcaggggcggcaggagcagcaggagggcccagtgggcccagccccgagccgcccagcactgcaggagaagcagcctgagaaggaggaggaggaggaggcgggagagagtgtggaggacattttctcagaggtcgtgggccggaagcggcagcggtcaggacccaacaggggagccaagaggcggagggaggaggcccggcagcgggaccaggaattctacatcccctaccggcccaaggactttgacagcgagcggggcctgagcatcagcggggaagggggagcctttgagcagcaggcagctggcgctgtcctggacttgatgggggatgaagcccagaacctgacgaggggccggcagcagctcaagtgggaccgtaagaagaagcggtttgtgggacagtcaggacaggaagacaagaagaagattaagacagagagcggccgctacatcagcagctcctacaagcgagacctctatcagaagtggaaacagaaacagaaaattgatgatcgtgactcggacgaagaaggggcatctgaccggcgaggcccagagcgaagaggtgggaagcgagaccgtggccaagcaggtgcatcccggccccacgccccaggcacccctgcaggccgagtccgcccggaactcaagaccaagcagcagatcctgaagcagcggcgccgggcccagaagctgcacttcctgcagcgtggtggcctcaagcagctctctgcccgcaaccgccgccgcgtccaggagctgcagcagggcgccttcggccggggtgcccgctccaagaagggcaagatgcggaagaggatgtgaggaccaggacccagccccgtggctccttgattggccttagggtgggcatcagcagacgttcccgtgcaccactgtgtgcctggccctgtgctgggcactgggggcactccctgcaggagccatcatctgtgaaaaggagcactgtatggccacagaagggcagcagctgcgtcagcctaagacagagacatttgaacagggccttgaagggtgtgcaggagttcgccagcaaagccaggcaggccaagacttgagttggcaactcagctgctgctgcttccatgtgttctgggttcagaggtcatggctgcaccggtcagagccctgagtgcctcagggtttggcaatggaatttttaatgtaataaatctttattgagcactgctggtggccaggagtgcggtctacttggggaactggaatggagagacccaggtactaaaatcccagctaacgtggcagaggagttgcgggtctcctgagggtgagttctgctgccttgtccatttagcgatgaggaaagtgaagctcagagcacaaaccaggtgccagaggcgggagttggtcccccttcctcccactggacatggttgcagctgggagtgggctgggggaggggaacaggatgcccagcccagggggcaaggacacagctgctcccctctggctatgaagaggttaacgcggcccctccacacctggaggtcagaacctggcctgtcctctgtcttcttgccacccaccccctgtttgaggttctgagaaggtcaagggcagccccagcagctggattctcaggctgggcccctcacctggcagagtccatagtggagggggccttggtgatctctcatctagcatggaccctgttctgagacctgacaaagagttttttttcatgccccaaccaccctggcagggagggcctggtctgatctcattttagaggcagttgccccacacatagccccttgaccttcccatcacctcctcatcagggcctgcatttatggagtgcttgctatgtgcccctcatggcaggcccacagcactctgaacaggcacagccctcccatcttcccaatgaggaaacggattcaggaagagccactcagtccacaccccattggaaatgtgggccctcctatctcagggtctctcaggggttccctctcccgctgctcacctgtgtcagggctaggaggcaggggctgcaggctcagcctgacccaggccggccagcatggcagagaggtcctgcatgaacagcttcacctgggggggcccagcacgaagtcacatcccagccccagagtcactgtccagcccccacccctcaacacgcgggggaggccgaaaggtagggcggggactggagatcccctcattaaaagaacagtgatgatggtggttcccagaggtggtgactgagatcctaaaccgttctgggttttgaaagcctcaggccaaccttcccaactgctgcgtgagcagacaccttcacagcttcctcgctgctgtcacctgcactatccaattagtattttcatttacatcaatcagctttattttcttgtaactggatcagtcatattcattggtttgtgacctactcttatctccgtgggtggctctccttttgttttaattaacttctttatgaatatgaacttaataaataccatggatccattgtaaaaact

SEQ ID NO: 7878 - DNA, 4538 bp, Homo sapiens
gcgacttcggcggcgccacgagagcgggcagcggaggagattgacgtgagtgaattcagatataactcaagcttgttagagggctttttaaaaataaaaagttgattccgtgcaagagagcaagttactgctgcttaccgttcagagacttacaggtgcttgcctgcattgcaataaaggactcatttattgagcaagacttatatttatctcttcattttggagagcctaataaactgttattacagtttctctactgactttcaaaagttttgaagtttgaaagacctttgcaattaaaacagcatgagcacggccagaacagagaaccctgttataatgggtctgtccagtcaaaatggtcagctgagaggccctgtgaaacccactggtggccctggaggagggggcacacagacacagcaacagatgaaccagctgaaaaacaccaacacaatcaataatggcactcagcagcaagcacagagtatgaccaccactattaaacctggtgatgactggaaaaagactttaaaactccctccaaaggatctaagaatcaaaacttcggatgtgacctccacaaaaggaaatgagtttgaagattactgtttgaaacgggagttactgatgggaatttttgaaatgggctgggaaaagccatctcctattcaggaggagagcattcccattgctttatctggtagggatatcttagctagagcaaaaaatggaacaggcaagagcggtgcctacctcattcccttacttgaacggctagacctgaagaaggacaatatacaagcaatggtgattgttcccactagagaacttgctctacaggtcagtcaaatttgcatccaggtcagcaaacacatgggaggggccaaagtgatggcaaccacaggaggaaccaatttacgagatgacataatgaggcttgatgatacagtgcacgtggtgattgctacccctgggagaatcctggatcttattaagaaaggagtagcaaaggttgatcatgtccagatgatagtattggatgaggcagataagttgctgtcacaggattttgtgcagataatggaggatattattctcacgctacctaaaaacaggcagattttactatattccgctactttccctcttagtgtacagaagttcatgaattcccatttgcagaaaccctatgagattaacctgatggaggaactaactctgaagggagtaacccagtactacgcatatgtaactgagcgccaaaaagtacactgcctcaacacacttttctccaggcttcagataaaccagtcgatcattttctgtaactcctctcagcgagttgaattgctagccaagaagatttctcaactgggttattcttgcttctatattcatgctaaaatgaggcaggaacatcgaaatcgtgtatttcatgatttccgaaatggcttatgccgcaatcttgtttgcactgatctgtttacccgaggtattgatatacaagctgtgaatgtggtaataaactttgatttcccaaagctggcagagacctatctccatcgtattggaagatcaggtcgctttggtcatcttggcttagccatcaacttgatcacatatgatgatcgcttcaacctgaaaagtattgaggagcagctgggaacagaaattaaacctattccgagcaacattgataagagcctgtatgtggcagaataccacagcgagcctgtagaagatgagaaaccttaacaagcatgctttgacaaattacaaaaggctcgtttggatctgtgacacatcgttttggggggaatgctcctctctttgtgggtttttcatcttttattttggaactatgaagacttaaaagagctcagacattttctttttttaactggtgaagagaaaaaggctgaaaagaaggaatataccttttttgttccacttgtttgcactgtgtgctgactgaacattagttgcactaactgctggtttttaaaaaatgttttctggggaaaggggacaaggaaggaaaagaaagaagagaaggggagaaaccctaaaaagagaagaatcttaatgaacacacaagcttgtcaatgatttcaaaattctccaacagctgactctcgtgcatttcaacttctccctgattcctcatccgttttttaagcctgaagagcttattacttatttgtgcgaagtgccttatgctatgagaccattcagaatatcatcttttagacacagcccgaggaatcaacaatagtaactctttctttccgtttttttttctttttcttttaaaaaatgtcttcttattttggtttcaggttgaagtctcttccctttctacccagtactcgagcccagggctagaagttgaaactcactagtaatgttaaacaccattttttttttctttttggggaggagttgatatgcaactgcagttcatccgcactgtaaatacatgtatttaaaaaaacaatcccaagtaaaaatttcttctgggctgagtagataaaaaacatcatcgctcccaaaggaaagagcagtctatcattgcaggagccatatgacaagcctttgtgctctatagcagacactaaagactgggttacatatgcctccagtagtagtatggcacttgatgtgtagacatgtcagagcttggccctctttcctctgtggcaaagcgtgtcccatagaaaattgggtgtgtatacttgtataactttgtaaataagttttttttctgggttcatatatatatatatatatacatatatatatatttttttttggatgaaggttgctgggattaaggggattagagtgattatgggagcagctaaagatgagaggggctcagttttacgcaacactaaattctagaaagtactttggcctcgtgctgtagagagcagatttctatggtaccctgtgttagtaaaggggcccagaaatctgggatgtactgtttgctgccacactgtctcatctagtacctttggagtaggtttaccagagagagcaaggaagcttcaaaacattgataattcaacatttattttgagaagctctgattttgcttcttccccctttctaaaagtttgaggaatatttcaagctctgcaacagggggcaaagattaatctaccttgcagtgtaggaattctattgagtggcagtgtcattgagcagtatatatataaagcacagatttgcatttcagaatattagccagtaccagctttggtaatgttagcagttctggagcttaattttctgtggatcatttcctgtagtgtgtaaatgtgttgccctctgcccgctttgatacataaacttttgcaggaatgggcaacctgagagctgttaactttcatgctacagaaagctgcttgccattctcttgcattgtgacaagaattgttacctgtcattttgcactgtaaattgctggcagatgctttacagtcaatagtgttgctttaaattgtgcccctcccaacatgcttgatgtttggcctgatctccaggcaaaaggagtgagatgaatcaaaaccagtgaacttttttttttaatgtttttaattcccttttaacccagtgtactaggtcaatcaggaggcatctggaaagggggggaaaaaagcaaaaaacaaaattaaaaaaaattgatttccatattttatttttcaaaaccctaaaatattacaaaataagtcccgcatatactttaatgttttaactcttttggacaaaggaatcaattacttgaagttgcttttttgactctgcctacttctgagcaaactatttgcgactcacccacaattgccttggagatcaaaatcctacagatgcctcctgatgggacatagccctaactccttaacaactgtagcaagaactgcacggtacaaacccaaaaaagaacaagctcatctatttggaacccaagcctcatattttctgtccagtcaatgttggttactaaatagaaaacctaattaaggaagtaacttttttccagggaggggtgggagagggaatttaaaaggtgtcaacttttgaccaaaaaaattgtgcccttgtaccgatgcagctctctttctcccccacctcttgcgagataagagggatcattcatgtagaagaaaagagtataaatgcaattctgtatctcgctagagaacgtgtgggtgactaaacaaaaagtgcagtctccttcaccaactttagactgcgtggtgccacatgcctgtgggtccctcttaaagcacagacttaaaatggaaagtattactgaagtatagcctctaatgaggagtggcacttaaactatctgggacaccactactggacacggtcttgtagaggcagctgtccagttttggtgcttgactcttgaataggaattgttaaatggaaagatgctctgaggactaggtcaaagcctggtctttttttttttttttttttttttctttcttttttgggccctcataataagcattgtt

SEQ ID NO: 7879 - DNA, 1813 bp, Homo sapiens
attttgggagcttcgagtcaacaataaaggaccgagggtgccgagcgggagtggcctcgttggtaggacacgggcccgagtcgcgaggcttgggattgacgtgagtgaattcagatataactcaagcttgttagagggctttttaaaaataaaaagttgattccgtgcaagagagcaagttactgctgcttaccgttcagagacttacaggtgcttgcctgcattgcaataaaggactcatttattgagcaagacttatatttatctcttcattttggagagcctaataaactgttattacagtttctctactgactttcaaaagttttgaagtttgaaagacctttgcaattaaaacagcatgagcacggccagaacagagaaccctgttataatgggtctgtccagtcaaaatggtcagctgagaggccctgtgaaacccactggtggccctggaggagggggcacacagacacagcaacagatgaaccagctgaaaaacaccaacacaatcaataatggcactcagcagcaagcacagagtatgaccaccactattaaacctggtgatgactggaaaaagactttaaaactccctccaaaggatctaagaatcaaaacttcggatgtgacctccacaaaaggaaatgagtttgaagattactgtttgaaacgggagttactgatgggaatttttgaaatgggctgggaaaagccatctcctattcaggaggagagcattcccattgctttatctggtagggatatcttagctagagcaaaaaatggaacaggcaagagcggtgcctacctcattcccttacttgaacggctagacctgaagaaggacaatatacaagcaatggtgattgttcccactagagaacttgctctacaggtcagtcaaatttgcatccaggtcagcaaacacatgggaggggccaaagtgatggcaaccacaggaggaaccaatttacgagatgacataatgaggcttgatgatacagtgcacgtggtgattgctacccctgggagaatcctggatcttattaagaaaggagtagcaaaggttgatcatgtccagatgatagtattggatgaggcagataagttgctgtcacaggattttgtgcagataatggaggatattattctcacgctacctaaaaacaggcagattttactatattccgctactttccctcttagtgtacagaagttcatgaattcccatttgcagaaaccctatgagattaacctgatggaggaactaactctgaagggagtaacccagtactacgcatatgtaactgagcgccaaaaagtacactgcctcaacacacttttctccaggcttcagataaaccagtcgatcattttctgtaactcctctcagcgagttgaattgctagccaagaagatttctcaactgggttattcttgcttctatattcatgctaaaatgaggcaggaacatcgaaatcgtgtatttcatgatttccgaaatggcttatgccgcaatcttgtttgcactgatctgtttacccgaggtattgatatacaagctgtgaatgtggtaataaactttgatttcccaaagctggcagagacctatctccatcgtattggaagatcaggtcgctttggtcatcttggcttagccatcaacttgatcacatatgatgatcgcttcaacctgaaaagtattgaggagcagctgggaacagaaattaaacctattccgagcaacattgataagagcctgtatgtggcagaataccacagcgagcctgtagaagatgagaaaccttaa

SEQ ID NO: 7880 - DNA, 2541 bp, Homo sapiens
acgggcccgagtcgcgaggcttgggattgacgtgagtgaattcagatataactcaagcttgttagagggctttttaaaaataaaaagttgattccgtgcaagagagcaagttactgctgcttaccgttcagagacttacaggtgcttgcctgcattgcaataaaggactcatttattgagcaagacttatatttatctcttcattttggagagcctaataaactgttattacagtttctctactgactttcaaaagttttgaagtttgaaagacctttgcaattaaaacagcatgagcacggccagaacagagaaccctgttataatgggtctgtccagtcaaaatggtcagctgagaggccctgtgaaacccactggtggccctggaggagggggcacacagacacagcaacagatgaaccagctgaaaaacaccaacacaatcaataatggcactcagcagcaagcacagagtatgaccaccactattaaacctggtgatgactggaaaaagactttaaaactccctccaaaggatctaagaatcaaaacttcggatgtgacctccacaaaaggaaatgagtttgaagattactgtttgaaacgggagttactgatgggaatttttgaaatgggctgggaaaagccatctcctattcaggaggagagcattcccattgctttatctggtagggatatcttagctagagcaaaaaatggaacaggcaagagcggtgcctacctcattcccttacttgaacggctagacctgaagaaggacaatatacaagcaatggtgattgttcccactagagaacttgctctacaggtcagtcaaatttgcatccaggtcagcaaacacatgggaggggccaaagtgatggcaaccacaggaggaaccaatttacgagatgacataatgaggcttgatgatacagtgcacgtggtgattgctacccctgggagaatcctggatcttattaagaaaggagtagcaaaggttgatcatgtccagatgatagtattggatgaggcagataagttgctgtcacaggattttgtgcagataatggaggatattattctcacgctacctaaaaacaggcagattttactatattccgctactttccctcttagtgtacagaagttcatgaattcccatttgcagaaaccctatgagattaacctgatggaggaactaactctgaagggagtaacccagtactacgcatatgtaactgagcgccaaaaagtacactgcctcaacacacttttctccaggcttcagataaaccagtcgatcattttctgtaactcctctcagcgagttgaattgctagccaagaagatttctcaactgggttattcttgcttctatattcatgctaaaatgaggcaggaacatcgaaatcgtgtatttcatgatttccgaaatggcttatgccgcaatcttgtttgcactgatctgtttacccgaggtattgatatacaagctgtgaatgtggtaataaactttgatttcccaaagctggcagagacctatctccatcgtattggaagatcaggtcgctttggtcatcttggcttagccatcaacttgatcacatatgatgatcgcttcaacctgaaaagtattgaggagcagctgggaacagaaattaaacctattccgagcaacattgataagagcctgtatgtggcagaataccacagcgagcctgtagaagatgagaaaccttaacaagcatgctttgacaaattacaaaaggctcgtttggatctgtgacacatcgttttggggggaatgctcctctctttgtgggtttttcatcttttattttggaactatgaagacttaaaagagctcagacattttctttttttaactggtgaagagaaaaaggctgaaaagaaggaatataccttttttgttccacttgtttgcactgtgtgctgactgaacattagttgcactaactgctggtttttaaaaaatgttttctggggaaaggggacaaggaaggaaaagaaagaagagaaggggagaaaccctaaaaagagaagaatcttaatgaacacacaagcttgtcaatgatttcaaaattctccaacagctgactctcgtgcatttcaacttctccctgattcctcatccgttttttaagcctgaagagcttattacttatttgtgcgaagtgccttatgctatgagaccattcagaatatcatcttttagacacagcccgaggaatcaacaatagtaactctttctttccgtttttttttctttttcttttaaaaaatgtcttcttattttggtttcaggttgaagtctcttccctttctacccagtactcgagcccagggctagaagttgaaactcactagtaatgttaaacaccattttttttttctttttggggaggagttgatatgcaactgcagttcatccgcactgtaaatacatgtatttaaaaaaacaatcccaagtaaaaatttcttctgggctgagtagataaaaaacatcatcgctcccaa

SEQ ID NO: 7881 - DNA, 2883 bp, Homo sapiens
tcagccaggcggcgacttcggcggcgccacgagagcgggcagcggaggagattgacgtgagtgaattcagatataactcaagcttgttagagggctttttaaaaataaaaagttgattccgtgcaagagagcaagttactgctgcttaccgttcagagacttacaggtgcttgcctgcattgcaataaaggactcatttattgagcaagacttatatttatctcttcattttggagagcctaataaactgttattacagtttctctactgactttcaaaagttttgaagtttgaaagacctttgcaattaaaacagcatgagcacggccagaacagagaaccctgttataatgggtctgtccagtcaaaatggtcagctgagaggccctgtgaaacccactggtggccctggaggagggggcacacagacacagcaacagatgaaccagctgaaaaacaccaacacaatcaataatggcactcagcagcaagcacagagtatgaccaccactattaaacctggtgatgactggaaaaagactttaaaactccctccaaaggatctaagaatcaaaacttcggatgtgacctccacaaaaggaaatgagtttgaagattactgtttgaaacgggagttactgatgggaatttttgaaatgggctgggaaaagccatctcctattcaggaggagagcattcccattgctttatctggtagggatatcttagctagagcaaaaaatggaacaggcaagagcggtgcctacctcattcccttacttgaacggctagacctgaagaaggacaatatacaagcaatggtgattgttcccactagagaacttgctctacaggtcagtcaaatttgcactgtgtgctgactgaacattagttgcactaactgctggtttttaaaaaatgttttctggggaaaggggacaaggaaggaaaagaaagaagagaaggggagaaaccctaaaaagagaagaatcttaatgaacacacaagcttgtcaatgatttcaaaattctccaacagctgactctcgtgcatttcaacttctccctgattcctcatccgttttttaagcctgaagagcttattacttatttgtgcgaagtgccttatgctatgagaccattcagaatatcatcttttagacacagcccgaggaatcaacaatagtaactctttctttccgtttttttttctttttcttttaaaaaatgtcttcttattttggtttcaggttgaagtctcttccctttctacccagtactcgagcccagggctagaagttgaaactcactagtaatgttaaacaccattttttttttctttttggggaggagttgatatgcaactgcagttcatccgcactgtaaatacatgtatttaaaaaaacaatcccaagtaaaaatttcttctgggctgagtagataaaaaacatcatcgctcccaaaggaaagagcagtctatcattgcaggagccatatgacaagcctttgtgctctatagcagacactaaagactgggttacatatgcctccagtagtagtatggcacttgatgtgtagacatgtcagagcttggccctctttcctctgtggcaaagcgtgtcccatagaaaattgggtgtgtatacttgtataactttgtaaataagttttttttctgggttcatatatatatatatatatacatatatatatatttttttttggatgaaggttgctgggattaaggggattagagtgattatgggagcagctaaagatgagaggggctcagttttacgcaacactaaattctagaaagtactttggcctcgtgctgtagagagcagatttctatggtaccctgtgttagtaaaggggcccagaaatctgggatgtactgtttgctgccacactgtctcatctagtacctttggagtaggtttaccagagagagcaaggaagcttcaaaacattgataattcaacatttattttgagaagctctgattttgcttcttccccctttctaaaagtttgaggaatatttcaagctctgcaacagggggcaaagattaatctaccttgcagtgtaggaattctattgagtggcagtgtcattgagcagtatatatataaagcacagatttgcatttcagaatattagccagtaccagctttggtaatgttagcagttctggagcttaattttctgtggatcatttcctgtagtgtgtaaatgtgttgccctctgcccgctttgatacataaacttttgcaggaatgggcaacctgagagctgttaactttcatgctacagaaagctgcttgccattctcttgcattgtgacaagaattgttacctgtcattttgcactgtaaattgctggcagatgctttacagtcaatagtgttgctttaaattgtgcccctcccaacatgcttgatgtttggcctgatctccaggcaaaaggagtgagatgaatcaaaaccagtgaacttttttttttaatgtttttaattcccttttaacccagtgtactaggtcaatcaggaggcatctggaaagggggggaaaaaagcaaaaaacaaaattaaaaaaaattgatttccatattttatttttcaaaaccctaaaatattacaaaataagtcccgcatatactttaatgttttaactcttttggacaaaggaatcaattacttgaagttgcttttttgactctgcctacttctgagcaaactatttgcgactcacccacaattgccttggagatcaaaatcctacagatgcctcctgatgggacatagccctaactccttaacaactgtagcaagaactgcacggtacaaacccaaaaaagaacaagctcatctatttggaaccc

SEQ ID NO: 7882 - DNA, 6071 bp, Homo sapiens
aggaaaccgaaactcccgccggatgcataaaagactggctgcggtggctcagagcgccgagtcctaggccaggtctggggtaacctggaacttccacctgggctctgcgctaggtctctgtttcactccctccccgcggggcgcgcagctcgcgggtctttggacaccaccggtcctgagtccgcggactgccattttcattaagaactgccacttagaggtaccaaaataaagggtatttgctacctttaatacttgccagttcaggttggaggcacaggcagcagcaagaatggaaagaaatgttcttacaacattttcacaggaaatgtcccagttaattttgaatgaaatgccaaaagctgaatattccagtttattcaatgattttgttgaatctgaattttttttgattgatggggattcattacttatcacatgtatctgtgagatatcatttaagcctgggcagaacctccatttcttctatctggttgaacgctatcttgtggatcttattagcaaaggaggacaattcaccatagttttcttcaaggatgccgagtatgcgtatttcaacttccctgaacttctttctttgagaactgctttaattcttcatcttcagaagaataccaccattgatgttcgaacaacattttcgagatgcttatcaaaagagtggggaagtttcttggaagagagttacccatatttcctgatagttgcagacgaaggcctgaacgatctacaaacacagcttttcaactttttaatcattcattcttgggcaaggaaggtcaacgttgtactttcctcagggcaagaatctgatgttctttgcctttatgcataccttcttccaagcatgtacagacaccagattttttcctggaagaataagcagaacattaaagatgcttatacaaccctgcttaaccagttggaaagatttaagctttcagcattagcacctctttttggaagtttaaaatggaataatattacggaagaggcacacaagactgtatctctgcttacacaagtctggccagaaggatctgacattcggcgtgtcttttgtgttacttcatgctcattatctttgagaatgtaccatcgctttttaggaaacagagagccctcctctggtcaggaaactgagatccaacaggtgaacagtaattgcttaaccctgcaggagatggaagatttgtgtaaactgcattgtctcactgtggtttttctactccatctgcctctttctcaaagagcttgtgctagagtcatcacttcccattgggctgaggacatgaagcctttattacaaatgaaaaagtggtgtgaatatttcatcttaagaaatatacatacttttgaattttggaatctgaatttaattcacctttctgacttaaatgatgagcttttgttgaagaatattgctttttactatgaaaatgaaaatgtaaaaggcctacatttgaatttgggagataccattatgaaagattatgaatatctctggaataccgtatcaaagttggtcagagactttgaggttggacagccatttcctctgagaacaacaaaagtttgttttcttgaaaagaaaccatcaccaatcaaagacagctccaatgaaatggtgcccaatttgggttttattccaacgtcatcttttgtggttgataaatttgctggagatattttgaaagatttgccttttctaaagagtgatgatcctattgttacttcactggttaaacaaaaggaatttgatgaacttgtgcactggcattctcataaacccctgagtgatgattatgacaggtccaggtgtcagtttgatgaaaaatctagagaccctcgtgttcttagatctgtgcaaaagtatcatgttttccaacggttttatgggaattcattagaaacagtctcttcgaaaatcatcgtgactcaaactattaagtcaaagaaggattttagtgggcccaagagcaaaaaggcacacgagaccaaggctgaaataattgctagagagaataagaaaaggttatttgccagggaagaacaaaaggaagagcaaaagtggaatgctttgtcattttctattgaagagcaattgaaagaaaatttacactctggaataaagagcctggaagattttttgaaatcctgtaaaagtagctgtgtgaaacttcaggttgaaatggtggggttaactgcttgcttgaaagcctggaaagaacattgccgaagtgaagaaggtaaaaccacgaaagatttaagtatagctgttcaggtgatgaaaaggatccactccttgatggaaaaatactcagaacttttacaagaagatgatcggcaactcatagccagatgccttaagtatttaggatttgatgagttggcaagttctttacatccagcccaggatgcagaaaatgatgtaaaagtgaagaaaaggaataaatattcagttggcattgggccagctcggttccaactgcaatacatgggccattatttgatacgagatgagagaaaagacccagatcccagggtccaggattttattcccgacacatggcagcgagagctccttgatgttgtggataagaatgagtcagcagtgattgttgccccaacgtcctcaggcaaaacctatgcctcctactactgtatggagaaagtgctgaaggagagcgacgacggggtggtcgtgtacgttgcacccacaaaggcccttgttaatcaagtggcagcaactgttcagaatcgttttacgaaaaatctgccaagtggtgaagttctctgtggtgttttcaccagggagtatcgtcatgatgccttaaactgtcaggtacttattacagtgcctgcctgctttgaaattctgctgcttgctcctcatcgccaaaactgggtgaaaaagatcagatatgttatatttgatgaggttcattgtcttggtggagaaattggagcagaaatctgggaacatctccttgtcatgatccgatgtccctttttggctctttcagctaccataagtaatcctgaacatctcaccgagtggctacaatcggtaaaatggtactggaaacaagaagacaaaataattgaaaataataccgcttctaaaagacatgtgggtcgtcaggccggctttcccaaagactacttgcaagtaaaacaatcgtataaagttagacttgtgctctatggagagaggtataatgatctagagaagcatgtatgttcaataaaacatggtgacattcattttgatcattttcacccatgtgctgcactaacaacagatcatattgaaaggtatggattccctcctgatcttaccctttcacctcgagaaagcatccagctgtatgatgccatgtttcaaatttggaaaagttggcctcgggcccaggaactgtgcccagaaaacttcattcattttaacaataaattagtcattaaaaagatggatgctaggaaatatgaagagagtctaaaggcagaattaacaagttggattaaaaatggcaacgtagagcaggccagaatggtacttcagaatcttagtcctgaagcagatttgagtccagaaaacatgatcaccatgtttccacttctagttgaaaaactaaggaaaatggagaagttacctgcactattttttttattcaagttaggagctgtagaaaacgcagctgaaagtgtgagcactttcctaaagaaaaagcaggagacaaaaaggcctcccaaagctgataaagaagcccatgtcatggctaacaaacttcgaaaagttaaaaaatccatagagaaacaaaagatcatagatgaaaagagccagaaaaaaaccagaaatgtggatcaaagcctaatacatgaagctgaacatgataatctagtgaagtgtctagagaagaacctggaaatcccacaggactgcacatatgctgatcaaaaagcagtggacactgagactttgcagaaggtatttggtcgagtaaaatttgaaagaaaaggtgaagaattgaaagccttggcagaaaggggtattggatatcatcacagtgctatgagtttcaaagaaaaacaattagttgaaatcctctttagaaaaggatatcttagggtggtgacagctactggaacacttgctttaggtgtcaacatgccttgtaaatctgtggtttttgctcaaaactcagtctatctggatgcgttgaattatagacagatgtctggccgtgctggaagaagaggtcaagacctgatgggagatgtatatttctttgatattccattccccaaaataggaaaactcataaaatccaatgttcctgagctgagaggacacttccctctcagcataaccctggtcctgcgactcatgctgctggcttccaagggagatgacccagaggatgccaaggcaaaggtgctatcagtgctaaagcattcattgctgtccttcaagcaacccagagtcatggacatgttaaaactttacttcctgttttctttgcagttcctggtgaaagagggctatttagatcaagaaggtaatcctatggggtttgctggacttgtatcacatttgcattatcatgaaccttctaatcttgtttttgtcagttttcttgtaaatggactcttccatgatctctgtcagccaaccaggaaaggctcaaaacatttttctcaagacgttatggaaaagctagtattagtattggcacatctctttggaagaagatattttccaccaaagttccaagatgcacacttcgagttttatcaatcaaaggtgttccttgatgatctccctgaggattttagtgatgctttagatgaatataacatgaaaattatggaggactttaccactttcctacgaattgtttccaaactggctgatatgaatcaggaatatcaactcccattgtcaaaaatcaaattcacaggtaaagaatgtgaagactctcaactcgtatctcatttgatgagctgcaaggaaggaagagtagcaatttcaccatttgtttgtctgtctgggaactttgatgatgatttgcttcgactagaaactccaaaccatgttactctaggcacaatcggtgtcaatcgctctcaggctccagtgctgttgtcacagaaatttgataaccgaggaaggaaaatgtcgcttaatgcctatgcactggatttctacaaacatggttccttgataggattagtccaggataacaggatgaatgaaggagatgcttattatttgttgaaggattttgcactcaccattaaatctatcagtgtttccttgcgtgagctatgtgaaaatgaagacgacaacgttgtcttagcctttgaacaactgagtacaactttttgggaaaagttaaacaaagtctaaaaacaaagtctatgcaaaccacttaaaaataattccatagtagtttttcaggtcacgtttttgattcttatgcttcttgccagaaatacattatgataaagtggaaatacattacgatgaagtggaaagagcaaacactttggaatcaaacagagttgcaatcaaacctgccatgttctgtcatgaatactcacaaattatttagtatacctgaatcttggtttctttttataactgagtaataatggttacatctcaggtagtttgaggattgactaaaaaaatgcgagaatgttgtatgtgactgaataacaatttttactctgcgaagccaaagtaaatataatattatcagtaactttatccccagtgtcagtatttataaaatgtttattaaggctagaaaaaatgaatacaatatcctgaaggtgaaatatattctcttcaattagcataaatatgatttacataagttagctatacagctattgagatagtactttctagtaaacttaaactactttttaaacatacattttgtgatgatttaacaaaaatatagagaatgatttgctttattgtaattgtatataagtgactggaaaagcacaaagaaataaagtgggttcgatctgtttac

SEQ ID NO: 7883 - DNA, 534 bp, Homo sapiens
aaaccgaaactcccgccggatgcataaaagactggctgcggtggctcagagcgccgagtcctaggccaggactgccattttcattaagaactgccacttagaggtaccaaaataaagggtatttgctacctttaatacttgccagttcaggttggaggcacaggcagcagcaagaatggaaagaaatgttcttacaacattttcacaggaaatgtcccagttaattttgaatgaaatgccaaaagctgaatattccagtttattcaatgattttgttgaatctgaattttttttgattgatggggattcattacttatcacatgtatctgtgagatatcatttaagcctgggcagaacctccatttcttctatctggttgaacgctatcttgtggatcttattagcaaaggaggacaattcaccatagttttcttcaaggatgccgagtatgcgtatttcaacttccctgaacttctttctttgagaactgctttaattcttcatcttcagaagaataccaccattgatgttcg

SEQ ID NO: 7884 - DNA, 3901 bp, Homo sapiens
aggaaaccgaaactcccgccggatgcataaaagactggctgcggtggctcagagcgccgagtcctaggccaggtctggggtaacctggaacttccacctgggctctgcgctaggtctctgtttcactccctccccgcggggcgcgcagctcgcgggtctttggacaccaccggtcctgagtccgcggactgccattttcattaagaactgccacttagaggtaccaaaataaagggtatttgctacctttaatacttgccagttcaggttggaggcacaggcagcagcaagaatggaaagaaatgttcttacaacattttcacaggaaatgtcccagttaattttgaatgaaatgccaaaagctgaatattccagtttattcaatgattttgttgaatctgaattttttttgattgatggggattcattacttatcacatgtatctgtgagatatcatttaagcctgggcagaacctccatttcttctatctggttgaacgctatcttgtggatcttattagcaaaggaggacaattcaccatagttttcttcaaggatgccgagtatgcgtatttcaacttccctgaacttctttctttgagaactgctttaattcttcatcttcagaagaataccaccattgatgttcgaacaacattttcgagatgcttatcaaaagagtggggaagtttcttggaagagagttacccatatttcctgatagttgcagacgaaggcctgaacgatctacaaacacagcttttcaactttttaatcattcattcttgggcaaggaaggtcaacgttgtactttcctcagggcaagaatctgatgttctttgcctttatgcataccttcttccaagcatgtacagacaccagattttttcctggaagaataagcagaacattaaagatgcttatacaaccctgcttaaccagttggaaagatttaagctttcagcattagcacctctttttggaagtttaaaatggaataatattacggaagaggcacacaagactgtatctctgcttacacaagtctggccagaaggatctgacattcggcgtgtcttttgtgttacttcatgctcattatctttgagaatgtaccatcgctttttaggaaacagagagccctcctctggtcaggaaactgagatccaacaggtgaacagtaattgcttaaccctgcaggagatggaagatttgtgtaaactgcattgtctcactgtggtttttctactccatctgcctctttctcaaagagcttgtgctagagtcatcacttcccattgggctgaggacatgaagcctttattacaaatgaaaaagtggtgtgaatatttcatcttaagaaatatacatacttttgaattttggaatctgaatttaattcacctttctgacttaaatgatgagcttttgttgaagaatattgctttttactatgaaaatgaaaatgtaaaaggcctacatttgaatttgggagataccattatgaaagattatgaatatctctggaataccgtatcaaagttggtcagagactttgaggttggacagccatttcctctgagaacaacaaaagtttgttttcttgaaaagaaaccatcaccaatcaaagacagctccaatgaaatggtgcccaatttgggttttattccaacgtcatcttttgtggttgataaatttgctggagatattttgaaagatttgccttttctaaagagtgatgatcctattgttacttcactggttaaacaaaaggaatttgatgaacttgtgcactggcattctcataaacccctgagtgatgattatgacaggtccaggtgtcagtttgatgaaaaatctagagaccctcgtgttcttagatctgtgcaaaagtatcatgttttccaacggttttatgggaattcattagaaacagtctcttcgaaaatcatcgtgactcaaactattaagtcaaagaaggattttagtgggcccaagagcaaaaaggcacacgagaccaaggctgaaataattgctagagagaataagaaaaggttatttgccagggaagaacaaaaggaagagcaaaagtggaatgctttgtcattttctattgaagagcaattgaaagaaaatttacactctggaataaagagcctggaagattttttgaaatcctgtaaaagtagctgtgtgaaacttcaggttgaaatggtggggttaactgcttgcttgaaagcctggaaagaacattgccgaagtgaagaaggtaaaaccacgaaagatttaagtatagctgttcaggtgatgaaaaggatccactccttgatggaaaaatactcagaacttttacaagaagatgatcggcaactcatagccagatgccttaagtatttaggatttgatgagttggcaagttctttacatccagcccaggatgcagaaaatgatgtaaaagtgaagaaaaggaataaatattcagttggcattgggccagctcggttccaactgcaatacatgggccattatttgatacgagatgagagaaaagacccagatcccagggtccaggattttattcccgacacatggcagcgagagctccttgatgttgtggataagaatgagtcagcagtgattgttgccccaacgtcctcaggcaaaacctatgcctcctactactgtatggagaaagtgctgaaggagagcgacgacggggtggtcgtgtacgttgcacccacaaaggcccttgttaatcaagtggcagcaactgttcagaatcgttttacgaaaaatctgccaagtggtgaagttctctgtggtgttttcaccagggagtatcgtcatgatgccttaaactgtcaggtacttattacagtgcctgcctgctttgaaattctgctgcttgctcctcatcgccaaaactgggtgaaaaagatcagatatgttatatttgatgaggttcattgtcttggtggagaaattggagcagaaatctgggaacatctccttgtcatgatccgatgtccctttttggctctttcagctaccataagtaatcctgaacatctcaccgagtggctacaatcggtaaaatggtactggaaacaagaagacaaaataattgaaaataataccgcttctaaaagacatgtgggtcgtcaggccggctttcccaaagactacttgcaagtaaaacaatcgtataaagttagacttgtgctctatggagagaggtataatgatctagagaagcatgtatgttcaataaaacatggtgacattcattttgatcattttcacccatgtgctgcactaacaacagatcatattgaaaggtatggattccctcctgatcttaccctttcacctcgagaaagcatccagctgtatgatgccatgtttcaaatttggaaaagttggcctcgggcccaggaactgtgcccagaaaacttcattcattttaacaataaattagtcattaaaaagatggatgctaggaaatatgaagagagtctaaaggcagaattaacaagttggattaaaaatggcaacgtagagcaggccagaatggtacttcagaatcttagtcctgaagcagatttgagtccagaaaacatgatcaccatgtttccacttctagttgaaaaactaaggaaaatggagaagttacctgcactattttttttattcaagttaggagctgtagaaaacgcagctgaaagtgtgagcactttcctaaagaaaaagcaggagacaaaaaggcctcccaaagctgataaagaagcccatgtcatggctaacaaacttcgaaaagttaaaaaatccatagagaaacaaaagatcatagatgaaaagagccagaaaaaccagaaatgtggatcaaagcctaatacatga

SEQ ID NO: 7885 - DNA, 1605 bp, Homo sapiens
ggaggaagttataaagagggtacgagggggccagctggagagccatgcagtccaagcgggattgtgagctgtggtgtgagagggtgaatccagagaacaaggcggcgctggaggcgtgggtcagggagacaggcatccgcctggtgcaggtgaacgggcagaggaagtatggcgggccacccccaggctgggtgggcagcccgccgccagctgggtcagaggtgttcatcgggcggctgcctcaggacgtgtacgagcaccagcttatcccgctgttccagcgcgtgggccgcctctacgagttccgcctgatgatgaccttcagcggcctgaaccgcggcttcgcctatgcccgctacagctcgaggcgcggcgcgcaggccgccatcgccacgctgcacaaccatccgctgcggccgtcctgcccgctgctcgtgtgccgcagcaccgagaagtgtgagctgagcgttgacggcctgccgccgaatctgacccgcagcgcgctgctgctcgcgctgcagccgctgggtcccggcttgcaggaggcgcggctgctgcccagccccggaccggcgcccgggcagatcgctctgctcaaattcagctcgcaccgggccgctgccatggccaaaaaggccctggtggaagggcagtcacacctctgtggagagcaggtggctgtggagtggctcaagccagacctgaagcagcgacttcgccagcagcttgtgggtcccttcttgcggtccccacagccagagggcagccagttggctttggcaagggacaagttagggttccaaggggctcgggctaccctgcagttgctgtgccaacgaatgaagctgggcagccctgtgttcctcaccaagtgtttgggcataggacctgctggctggcaccgcttctggtaccaggtggtgattcctgggcatccggtgcccttcagcggcctcatctgggttgtgctgaccctagatggccgggatgggcatgaggtggccaaggatgctgtgtctgtacggctgctgcaggcactcagtgagtctggggccaacctcctgtggtctgctggggctgaggcaggtaccatggttaaacagtgactccattctttctccacaggcaccctgaatgggcatgcagagcctgtgtcaggccccatcccagcaggcctgggtggccactttctgacccccaaaggtggggaggggcatgggcccaggcccatcagcctccctgctgggacagggacctatggcacctgggggcagcttaggtttgggttaagttgtggtgaggggccttgccctcccgctcccagcccagggtccaacctgacccagtgatcttccatggccgttccttgtcccacccccacccgatcataccttcccccctctgccacagcttagcatgaatcttctttattgtcctgatttgtcctctttgttggtttttatttgtggggaagggcagctgagccaaaggggtcagaaattctgccctttgcctccaccacatggcattctggttttggtttctgtatagttttgggtctttctatgctggttgtatttatattaaacccctggttagtatata

SEQ ID NO: 7886 - DNA, 2590 bp, Homo sapiens
agaaagcaatgtttgagcaccagctatgctgagattccctcgttcagtattcgttgagcacccagtgtgtgagagcgcctggttttgccctcaaggagcttagagtggagtttacaggaatgaatcactgattagcggcaggcctaagtgtgggcactgtcgcaccacacacccagatactactccaggcacgggcattaggggctcccacaggctggacaggccttggactttcctggttgaaccgtgaggccgcggtgtcagtccacactccactgtgggtggcgggttcggccccgcgaggaggcgccgctctcaaaccccacggtcccgcgcagcgaagaggcgaggcggccgcggaaggcaggcgcagcccactcttcccgagaggccccgacatctcccggataatctggagctttcaaaatgtttgccaaagcaaccaggaattttcttagagaagttgatgctgatggtgacctgattgcagtatcaaatctgaatgactctgataagttacagcttctaagtctggtgacaaaaaagaagagattctggtgctggcagagacccaagtaccagtttttatccctcacccttggcgatgtactcatagaagaccaatttccgagtccagtggtcgtggagtcggactttgtgaaatacgagggcaagtttgcaaaccacgtgagtggaaccctggagactgcactggggaaggtcaagctgaacctggggggcagcagccgcgtagagagccagtcttcatttggaaccctgaggaagcaggaggtggatttgcagcagctcatcagagactctgccgagagaacaataaatctgagaaaccctgtgctccagcaggtgctggaaggaaggaatgaggtcctgtgcgttttgacacagaagatcacgacgatgcagaagtgtgtgatctctgagcacatgcaggtcgaggagaagtgtggtggcatcgtgggcatccagaccaagacggtgcaggtgtcagcgacggaggatgggaatgtcaccaaggactccaacgtggtgctggagatcccagctgccaccaccattgcctacggtgtcattgagttatacgtgaaactggacggccagttcgagttctgccttctccgagggaagcaaggtggcttcgagaacaagaagagaattgactctgtctacctggaccccctggtctttcgagagtttgcattcatagacatgccagatgctgcgcatgggatatcttcccaggatggaccattaagtgttttaaagcaagcgaccctgctcctggagaggaatttccatccatttgcggagctgcctgagccacaacagacagctttgagtgacatcttccaggcggtcctatttgatgatgaactactcatggtcctggaaccagtgtgcgatgacctggtcagcggcctctcgcccacagtggcggtgctgggggagctgaagccccggcagcagcaggaccttgtggccttcctgcagctggtggggtgcagcttacagggtgggtgtccgggccccgaggatgcaggcagcaagcagctgtttatgacagcctacttcttggtcagtgccctcgcagaaatgccagatagcgcagcagctctgctgggcacttgctgcaaactccagatcattcccacactgtgccacttgcttcgtgctctgtctgatgatggagtatctgatcttgaagacccaaccttgactcccctgaaagatacagaaaggtttgggattgtgcagcgcttgtttgcctcagctgacattagtctggagagactgaagtcatctgtgaaagctgtcattctgaaggactctaaagtcttcccactgcttctttgtataaccctgaatggactctgtgctttaggcagagaacattcatgatgtcatatgtgaactagaagtacgtgttactggccaaggctatttttcagaactgttaaaggtcatatgcacgttaaaagttgaccaatgaaatgaatttacagaacagtttaagaagtggtgacattttgcatgatgaatgacctgacttttagccaccaggtactctttaaacagttttccttatcagaggccctcctgtgctggtgacccagcatctgagttaggttccagcatgtaaagagctgggagggcggagaattcttagcatacattcagacgttttttctgcacaataataagtccatctgtcacttgcattccactttttgttacatagaaagagtctgaccctttaatccaaaaggtctttttacattgtgaatgctgtgggaaggcaatttctctgcacacaagaggctacgttttggaagtgatgtatgttatttgatgactgaaaatgaactgtaaatgctcctagagtatattcctctgctgaacaaaattaaacttcaaaaaaatctaacagtaacacacccctgcttgggaccctagctatatgcattttatgtgaccttgccatgcttcagtgaacatactaattctatgtctagcacatgttgatttcctatgtattctgggtattctattaaaggaaactttgaactatgtc

SEQ ID NO: 7887 - DNA, 1689 bp, Homo sapiens
ggggcgcccggaccgagcaaaggtcccggcgggcgggccctctctccgccctccccaagcgcccgccccccgccggcccagcgcaggctcctccgactccgccagcgcagggggcgcggctgccggggacccagcagcgggcgcgcggataatctggagctttcaaaatgtttgccaaagcaaccaggaattttcttagagaagttgatgctgatggtgacctgattgcagtatcaaatctgaatgactctgataagttacagcttctaagtctggtgacaaaaaagaagagattctggtgctggcagagacccaagtaccagtttttatccctcacccttggcgatgtactcatagaagaccaatttccgagtccagtggtcgtggagtcggactttgtgaaatacgagggcaagtttgcaaaccacgtgagtggaaccctggagactgcactggggaaggtcaagctgaacctggggggcagcagccgcgtagagagccagtcttcatttggaaccctgaggaagcaggaggtggatttgcagcagctcatcagagactctgccgagagaacaataaatctgagaaaccctgtgctccagcaggtgctggaaggaaggaatgaggtcctgtgcgttttgacacagaagatcacgacgatgcagaagtgtgtgatctctgagcacatgcaggtcgaggagaagtgtggtggcatcgtgggcatccagaccaagacggtgcaggtgtcagcgacggaggatgggaatgtcaccaaggactccaacgtggtgctggagatcccagctgccaccaccattgcctacggtgtcattgagttatacgtgaaactggacggccagttcgagttctgccttctccgagggaagcaaggtggcttcgagaacaagaagagaattgactctgtctacctggaccccctggtctttcgagagtttgcattcatagacatgccagatgctgcgcatgggatatcttcccaggatggaccattaagtgttttaaagcaagcgaccctgctcctggagaggaatttccatccatttgcggagctgcctgagccacaacagacagctttgagtgacatcttccaggcggtcctatttgatgatgaactactcatggtcctggaaccagtgtgcgatgacctggtcagcggcctctcgcccacagtggcggtgctgggggagctgaagccccggcagcagcaggaccttgtggccttcctgcagctggtggggtgcagcttacagggtgggtgtccgggccccgaggatgcaggcagcaagcagctgtttatgacagcctacttcttggtcagtgccctcgcagaaatgccagatagcgcagcagctctgctgggcacttgctgcaaactccagatcattcccacactgtgccacttgcttcgtgctctgtctgatgatggagtatctgatcttgaagacccaaccttgactcccctgaaagatacagaaaggtttgggattgtgcagcgcttgtttgcctcagctgacattagtctggagagactgaagtcatctgtgaaagctgtcattctgaaggactctaaagtcttcccactgcttctttgtataaccctgaatggactctgtgctttaggcagagaacattcatgatgtcatatgtgaactagaagtacgtgttact

SEQ ID NO: 7888 - DNA, 2265 bp, Homo sapiens
aggagcttagagtggagtttacaggaatgaatcactgattagcggcaggcctaagtgtgggcactgtcgcaccacacacccagatactactccaggcacgggcattaggggctcccacaggctggacaggccttggactttcctggttgaaccgtgaggccgcggtgtcagtccacactccactgtgggtggcgggttcggccccgcgaggaggcgccgctctcaaaccccacggtcccgcgcagcgaagaggcgaggcggccgcggaaggcaggcgcagcccactcttcccgagaggccccgacatctcccggtggtcgtggagtcggactttgtgaaatacgagggcaagtttgcaaaccacgtgagtggaaccctggagactgcactggggaaggtcaagctgaacctggggggcagcagccgcgtagagagccagtcttcatttggaaccctgaggaagcaggaggtggatttgcagcagctcatcagagactctgccgagagaacaataaatctgagaaaccctgtgctccagcaggtgctggaaggaaggaatgaggtcctgtgcgttttgacacagaagatcacgacgatgcagaagtgtgtgatctctgagcacatgcaggtcgaggagaagtgtggtggcatcgtgggcatccagaccaagacggtgcaggtgtcagcgacggaggatgggaatgtcaccaaggactccaacgtggtgctggagatcccagctgccaccaccattgcctacggtgtcattgagttatacgtgaaactggacggccagttcgagttctgccttctccgagggaagcaaggtggcttcgagaacaagaagagaattgactctgtctacctggaccccctggtctttcgagagtttgcattcatagacatgccagatgctgcgcatgggatatcttcccaggatggaccattaagtgttttaaagcaagcgaccctgctcctggagaggaatttccatccatttgcggagctgcctgagccacaacagacagctttgagtgacatcttccaggcggtcctatttgatgatgaactactcatggtcctggaaccagtgtgcgatgacctggtcagcggcctctcgcccacagtggcggtgctgggggagctgaagccccggcagcagcaggaccttgtggccttcctgcagctggtggggtgcagcttacagggtgggtgtccgggccccgaggatgcaggcagcaagcagctgtttatgacagcctacttcttggtcagtgccctcgcagaaatgccagatagcgcagcagctctgctgggcacttgctgcaaactccagatcattcccacactgtgccacttgcttcgtgctctgtctgatgatggagtatctgatcttgaagacccaaccttgactcccctgaaagatacagaaaggtttgggattgtgcagcgcttgtttgcctcagctgacattagtctggagagactgaagtcatctgtgaaagctgtcattctgaaggactctaaagtcttcccactgcttctttgtataaccctgaatggactctgtgctttaggcagagaacattcatgatgtcatatgtgaactagaagtacgtgttactggccaaggctatttttcagaactgttaaaggtcatatgcacgttaaaagttgaccaatgaaatgaatttacagaacagtttaagaagtggtgacattttgcatgatgaatgacctgacttttagccaccaggtactctttaaacagttttccttatcagaggccctcctgtgctggtgacccagcatctgagttaggttccagcatgtaaagagctgggagggcggagaattcttagcatacattcagacgttttttctgcacaataataagtccatctgtcacttgcattccactttttgttacatagaaagagtctgaccctttaatccaaaaggtctttttacattgtgaatgctgtgggaaggcaatttctctgcacacaagaggctacgttttggaagtgatgtatgttatttgatgactgaaaatgaactgtaaatgctcctagagtatattcctctgctgaacaaaattaaacttcaaaaaaatctaacagtaacacacccctgcttgggaccctagctatatgcattttatgtgaccttgccatgcttcagtgaacatactaattctatgtctagcacatgttgatttcctatgtattctgggtattctattaaaggaaactttgaactatg

SEQ ID NO: 7889 - DNA, 2818 bp, Homo sapiens
gttctatagtcctattaatcagtctttagtgagcctatgtcctgggctgtgaaacttagttccctccccccattatgtggggcagaatggctagaggggactggagttgagttaggctctgataaaaccccaatcgtttaggctttggtgaaacagtttctcttgaagacaggcctcgttaagaacagaatgctctggcatgtttcaaaatggctacgttccccgcctcccgctgcaagaatgaggggagtttttctgatattccctgtgagaacctggttagagctcctagaggtaaaactcacagaagtgtagagagtttctaactctcagacttgtccaccctgagcttccagcagttcatcagttacagttcagggtttcccatgcaagcaatggttcctgtggtttctgctctgtttctgtcacccaggctggagtacagtggcacgatcacagctcactgcaccctcaacttcccaggctcaggtgattctcctgcatcagcctcccgagtagctgggactacaggtgtggacacattgagaagtcactatctatgaactaggaagcaggatctcaccagacatcgaatctgctgatgccttcatcttggacttctctctcagcctccagaactataatctggagctttcaaaatgtttgccaaagcaaccaggaattttcttagagaagttgatgctgatggtgacctgattgcagtatcaaatctgaatgactctgataagttacagcttctaagtctggtgacaaaaaagaagagattctggtgctggcagagacccaagtaccagtttttatccctcacccttggcgatgtactcatagaagaccaatttccgagtccagtggtcgtggagtcggactttgtgaaatacgagggcaagtttgcaaaccacgtgagtggaaccctggagactgcactggggaaggtcaagctgaacctggggggcagcagccgcgtagagagccagtcttcatttggaaccctgaggaagcaggaggtggatttgcagcagctcatcagagactctgccgagagaacaataaatctgagaaaccctgtgctccagcaggtgctggaaggaaggaatgaggtcctgtgcgttttgacacagaagatcacgacgatgcagaagtgtgtgatctctgagcacatgcaggtcgaggagaagtgtggtggcatcgtgggcatccagaccaagacggtgcaggtgtcagcgacggaggatgggaatgtcaccaaggactccaacgtggtgctggagatcccagctgccaccaccattgcctacggtgtcattgagttatacgtgaaactggacggccagttcgagttctgccttctccgagggaagcaaggtggcttcgagaacaagaagagaattgactctgtctacctggaccccctggtctttcgagagtttgcattcatagacatgccagatgctgcgcatgggatatcttcccaggatggaccattaagtgttttaaagcaagcgaccctgctcctggagaggaatttccatccatttgcggagctgcctgagccacaacagacagctttgagtgacatcttccaggcggtcctatttgatgatgaactactcatggtcctggaaccagtgtgcgatgacctggtcagcggcctctcgcccacagtggcggtgctgggggagctgaagccccggcagcagcaggaccttgtggccttcctgcagctggtggggtgcagcttacagggtgggtgtccgggccccgaggatgcaggcagcaagcagctgtttatgacagcctacttcttggtcagtgccctcgcagaaatgccagatagcgcagcagctctgctgggcacttgctgcaaactccagatcattcccacactgtgccacttgcttcgtgctctgtctgatgatggagtatctgatcttgaagacccaaccttgactcccctgaaagatacagaaaggtttgggattgtgcagcgcttgtttgcctcagctgacattagtctggagagactgaagtcatctgtgaaagctgtcattctgaaggactctaaagtcttcccactgcttctttgtataaccctgaatggactctgtgctttaggcagagaacattcatgatgtcatatgtgaactagaagtacgtgttactggccaaggctatttttcagaactgttaaaggtcatatgcacgttaaaagttgaccaatgaaatgaatttacagaacagtttaagaagtggtgacattttgcatgatgaatgacctgacttttagccaccaggtactctttaaacagttttccttatcagaggccctcctgtgctggtgacccagcatctgagttaggttccagcatgtaaagagctgggagggcggagaattcttagcatacattcagacgttttttctgcacaataataagtccatctgtcacttgcattccactttttgttacatagaaagagtctgaccctttaatccaaaaggtctttttacattgtgaatgctgtgggaaggcaatttctctgcacacaagaggctacgttttggaagtgatgtatgttatttgatgactgaaaatgaactgtaaatgctcctagagtatattcctctgctgaacaaaattaaacttcaaaaaaatctaacagtaacacacccctgcttgggaccctagctatatgcattttatgtgaccttgccatgcttcagtgaacatactaattctatgtctagcacatgttgatttcctatgtattctgggtattctattaaaggaaactttgaact

SEQ ID NO: 7890 - DNA, 2847 bp, Homo sapiens
gaaactcctaggcagcagaggcccacgactacttcctcctgagtgccgttcagtggcctgtgtccaggctctgaagggctccaagaagctggtgctgtctgtgtactcagcagggcgcatccctgggggctacgtcaccaaccacatctacacctgggtggacccgcagggccgcagcatctccccaccctcgggcctgccccagccccacggtggtgccctgaggcagcaggagggtgaccggaggagcaccctgcacctcctgcaaggaggggatgagaaaaaggtgaacctggtgctgggggacggccggtccctgggcctcacgatccgtgggggagctgagtacggccttggcatttacatcactggcgtggacccaggctctgaagcagaaggcagcgggctcaaggttggggaccagattctagaagtgaatgggcggagctttctcaacatcctacacgacgaggctgtcaggctgcttaagtcatctcggcacctcatcctgacagtgaaggacgtcgggaggctgccccgtgcccgcaccactgtggacgagaccaagtggatcgccagttcccggatcagggagaccatggcgaactcggcagggtttcttggcgatctcacaacagaaggaataaacaagccaggattttacaagggcccagccggctcccaggtgaccctgagcagcctggggaaccagacacgagtgctgctggaggagcaggctcggcacctgctgaacgagcaggaacacgccaccatggcctactacctggatgagtaccgtggtggcagcgtctctgtggaggccctcgtcatggccctgttcaagctgctcaacacccacgccaagttctcactcctctctgaggtgagaggcaccatttccccgcaagacctagaacgcttcgaccacctggtgctgaggcgtgagattgagtccatgaaggcgcggcagcccccaggccccggggctggggacacctactccatggtctcctacagtgacacgggttcatccacaggcagccacggcacctccaccaccgtcagctcggccaggaacactctggacctggaggaaactggcgaggctgtccagggcaatatcaacgccctcccagatgtgtccgtggatgatgtcagatccacctcccaggggctgtcaagcttcaagccactgcctcgcccaccacctctggcccaaggcaacgacctcccactaggccagccaaggaagctggggagagaggacctccagccaccttcctccatgccttcctgctcgggcactgtcttctcggctccacagaaccgcagcccgccagcgggcaccgcacccaccccagggacctcctctgcacaggacttgccctcttcccccatctatgcctccgtctcccctgccaaccccagctccaagaggccgctggacgcccatctggccctggtcaaccaacaccccatcggccccttcccacgggtccagtcacccccgcacctgaaaagcccctctgcagaggccacagtggctgggggctgccttctgcccccatcaccctctggccacccagaccagacaggcacaaaccagcactttgtcatggtggaggtccaccgccccgacagcgagccagacgtcaatgaagtgagggcgctgccccagacgcgcacagcctctacgctctcccacctctcggacagcgggcagactctaagcgaggacagtggtgtggatgctggcgaggcagaggccagcgccccaggccgaggaaggcagtcggtgtccaccaagagcaggagtagcaaggagctgcctcggaacgagaggcccacagatggggccaacaaaccgcctggacttctggagcccacgtccactctggtccgtgtgaagaaaagtgcggccaccctgggcatcgccatcgagggtggcgccaacacccgccagcccctgcctaggattgtcactattcagagaggcggctcagctcacaactgtgggcagctcaaggtgggccacgtgattctggaagtgaatgggctgacgcttcggggcaaggagcaccgggaggccgcccgcattatcgccgaggccttcaagactaaggaccgtgactacattgactttctggtcactgagttcaatgtgatgctctagaggccaaggcctgagggcctcccaccactgcccagcccctggtcccagtccctttccaccgttggcttcatcaagctccttgcggggttggggctgcatggccagggtggcaggaagacatcccccctccatcccagcccactggaccagaactgggagaggaagagagcaggacaaggcagacagaaggtcaggtcaggaactggtgctgtactgggtacacagtaggcgcccaggacaagtgggttgcaagacaggaagaaaggaaaaggaagggcagagtgctggtttctccaggttgggttgggggcactgctgtcccccctccagctaggacccagcccatccccagatgcctgagcctttgtccaaagtgaggtcactcgagaattcatggacacggcccccagtcagggggcatcttgcaagacctttagtgccacaaataagcatcgagcacctccccattcacacccccattcctcctggctccttatcccccatggtgtttattatttatttccctccccatgcccctggggaccccaaggccccagcttccctctgcacccccagcctatcccagaggccttgcaggtgaccagcagtgtcattgtatttatatacagagcttatgactttaatttttcaataaagaaatctgaacaaggtta

SEQ ID NO: 7891 - DNA, 3566 bp, Homo sapiens
gtctccgcgaccccctaggatccagccactgtacccgtgctccccaaacccaggctccagccgtcgtctccgcgctcccggggatccagctgtcgcgccagtacccgcgaggacagcggcaccgcccacaccccgcgcgctcagagcccggccgggcctcggcgtggagatgaacgcgccgctggacggcctgtcggtgagctcgtcctccaccggctcgctgggctcggcggccggggcgggcggcggcgggggcgcggggctgcggttactgtctgccaacgtgcgccagctgcaccaagcgctgaccgcgctgctgagcgaggcggagcgggagcagttcacccactgcctgaacgcttaccacgcgcgccgcaacgtcttcgacctggtgcgcaccctgcgcgtgctgctggacagtccggtcaagcggcgcctgctgcccatgcttcgtctggtcatcccgcgctccgaccagctgctcttcgaccaatacacggccgagggcctctacctgcccgccaccaccccctacaggcagcccgcctggggcggccccgacagcgcggggccaggggaggtgcgcctggtgagtttgcggcgtgccaaggcccacgagggcttgggcttcagcatccgtgggggctcggagcacggcgtgggcatctacgtgtctctggtggaaccaggctctctagctgagaaggaaggactgcgggtcggggaccagattctgcgcgtcaacgacaaatccctggcccgggtgacccacgcggaggccgtcaaggctctgaagggctccaagaagctggtgctgtctgtgtactcagcagggcgcatccctgggggctacgtcaccaaccacatctacacctgggtggacccgcagggccgcagcatctccccaccctcgggcctgccccagccccacggtggtgccctgaggcagcaggagggtgaccggaggagcaccctgcacctcctgcaaggaggggatgagaaaaaggtgaacctggtgctgggggacggccggtccctgggcctcacgatccgtgggggagctgagtacggccttggcatttacatcactggcgtggacccaggctctgaagcagaaggcagcgggctcaaggttggggaccagattctagaagtgaatgggcggagctttctcaacatcctacacgacgaggctgtcaggctgcttaagtcatctcggcacctcatcctgacagtgaaggacgtcgggaggctgccccgtgcccgcaccactgtggacgagaccaagtggatcgccagttcccggatcagggagaccatggcgaactcggcagggtttcttggcgatctcacaacagaaggaataaacaagccaggattttacaagggcccagccggctcccaggtgaccctgagcagcctggggaaccagacacgagtgctgctggaggagcaggctcggcacctgctgaacgagcaggaacacgccaccatggcctactacctggatgagtaccgtggtggcagcgtctctgtggaggccctcgtcatggccctgttcaagctgctcaacacccacgccaagttctcactcctctctgaggtgagaggcaccatttccccgcaagacctagaacgcttcgaccacctggtgctgaggcgtgagattgagtccatgaaggcgcggcagcccccaggccccggggctggggacacctactccatggtctcctacagtgacacgggttcatccacaggcagccacggcacctccaccaccgtcagctcggccaggaacactctggacctggaggaaactggcgaggctgtccagggcaatatcaacgccctcccagatgtgtccgtggatgatgtcagatccacctcccaggggctgtcaagcttcaagccactgcctcgcccaccacctctggcccaaggcaacgacctcccactaggccagccaaggaagctggggagagaggacctccagccaccttcctccatgccttcctgctcgggcactgtcttctcggctccacagaaccgcagcccgccagcgggcaccgcacccaccccagggacctcctctgcacaggacttgccctcttcccccatctatgcctccgtctcccctgccaaccccagctccaagaggccgctggacgcccatctggccctggtcaaccaacaccccatcggccccttcccacgggtccagtcacccccgcacctgaaaagcccctctgcagaggccacagtggctgggggctgccttctgcccccatcaccctctggccacccagaccagacaggcacaaaccagcactttgtcatggtggaggtccaccgccccgacagcgagccagacgtcaatgaagtgagggcgctgccccagacgcgcacagcctctacgctctcccacctctcggacagcgggcagactctaagcgaggacagtggtgtggatgctggcgaggcagaggccagcgccccaggccgaggaaggcagtcggtgtccaccaagagcaggagtagcaaggagctgcctcggaacgagaggcccacagatggggccaacaaaccgcctggacttctggagcccacgtccactctggtccgtgtgaagaaaagtgcggccaccctgggcatcgccatcgagggtggcgccaacacccgccagcccctgcctaggattgtcactattcagagaggcggctcagctcacaactgtgggcagctcaaggtgggccacgtgattctggaagtgaatgggctgacgcttcggggcaaggagcaccgggaggccgcccgcattatcgccgaggccttcaagactaaggaccgtgactacattgactttctggtcactgagttcaatgtgatgctctagaggccaaggcctgagggcctcccaccactgcccagcccctggtcccagtccctttccaccgttggcttcatcaagctccttgcggggttggggctgcatggccagggtggcaggaagacatcccccctccatcccagcccactggaccagaactgggagaggaagagagcaggacaaggcagacagaaggtcaggtcaggaactggtgctgtactgggtacacagtaggcgcccaggacaagtgggttgcaagacaggaagaaaggaaaaggaagggcagagtgctggtttctccaggttgggttgggggcactgctgtcccccctccagctaggacccagcccatccccagatgcctgagcctttgtccaaagtgaggtcactcgagaattcatggacacggcccccagtcagggggcatcttgcaagacctttagtgccacaaataagcatcgagcacctccccattcacacccccattcctcctggctccttatcccccatggtgtttattatttatttccctccccatgcccctggggaccccaaggccccagcttccctctgcacccccagcctatcccagaggccttgcaggtgaccagcagtgtcattgtatttatatacagagcttatgactttaatttttcaataaagaaatctgaacaaggtt

SEQ ID NO: 7892 - DNA, 1718 bp, Homo sapiens
agttcgcaaagtccgggcttgcggccgggcggcgcagaggcgcggaggctccccgggcggctgcatcccggggctgccccggacatgccccgcaccccttgtcggacgcccgcgccgcttcaccggctgccactccccggagtgctctgggactagagcgccctccgccccaacttctgactttggggtcccccagccctagaggaacgggcgcccggctgggggagccccgggcatggtgtgacggggcagtcaggtcagctttgcggcgcccccaaactccagccacccgtcgtctccgtgccctccagaatgtagctgctgaccccgcgccccccggactccagcagcagtctccgccacctccgggctccagcagccaactcttgtgtctctcaggaacccgccgacgtctccgcgtcccccggattccaggttcgcgacccccgccgtcttcgcgcctccgggactctagcagcggtctccgcgaccccctaggatccagccactgtacccgtgctccccaaacccaggctccagccgtcgtctccgcgctcccggggatccagctgtcgcgccagtacccgcgaggacagcggcaccgcccacaccccgcgcgctcagagcccggccgggcctcggcgtggagatgaacgcgccgctggacggcctgtcggtgagctcgtcctccaccggctcgctgggctcggcggccggggcgggcggcggcgggggcgcggggctgcggttactgtctgccaacgtgcgccagctgcaccaagcgctgaccgcgctgctgagcgaggcggagcgggagcagttcacccactgcctgaacgcttaccacgcgcgccgcaacgtcttcgacctggtgcgcaccctgcgcgtgctgctggacagtccggtcaagcggcgcctgctgcccatgcttcgtctggtcatcccgcgctccgaccagctgctcttcgaccaatacacggccgagggcctctacctgcccgccaccaccccctacaggcagcccgcctggggcggccccgacagcgcggggccaggggaggtgcgcctggtgagtttgcggcgtgccaaggcccacgagggcttgggcttcagcatccgtgggggctcggagcacggcgtgggcatctacgtgtctctggtggaaccaggctctctagctgagaaggaaggactgcgggtcggggaccagattctgcgcgtcaacgacaaatccctggcccgggtgacccacgcggaggccgtcaaggctctgaagggctccaagaagctggtgctgtctgtgtactcagcagggcgcatccctgggggctacgtcaccaaccacatctacacctgggtggacccgcagggccgcagcatctccccaccctcgggcctgccccagccccacggtggtgccctgaggcagcaggagggtgaccggaggagcaccctgcacctcctgcaaggaggggatgagaaaaaggtgagtggggtggggaaaggaggccagcctctcagacaccgtattctccctccgaacccagaacagcagagctgcttggaggccgcaagaagaggctggttctgtccaggctctgtcttccctcaagtctgtactgaagggtggtgttttttctttgcttttctttttgacctgtgtagtgtatgttataatacaggctaagctgccacaataaaagagcttaaatactgtg

SEQ ID NO: 7893 - DNA, 3278 bp, Homo sapiens
catgacctgggcacatccctctcctctcttggcctcagtttccccatggaaagctgaaatacaccatccaactgtctcattctttatttgtccccaaattacttaactcattctatagaccttagttgcttcatccaaaaagtggggaccataaccctgccctcatcccagatctgtgcagatgaaagagagggagggagagggaaagagagagatgctttggggtgtatttggccagaggccaccaggctggatcccatgaagaaatctgggtgagagggtcttaaagtcataaactgagatccagttgccaggtggctgcatagttgccaacagtgtaatgtgtcaccttttgatcttcatcagaaatctcaggctggtggccacctggccaaatacactgcagagcatgtctgtctgtctgtctgtctgtgtctctctgtgtgtgtgtgtgtgtgtgtgtgtgtgtgtgtgtgtgtgtgtgtctcccccttcccttcctttcacctgcatagtattaaacattttcaaagttacttgccaacatctagaaagataccaggttttctataaaaaaaaaaactggatttctggatgcttcttaaaaatcaggaagtctggcagcctgagcccacatcggctggagctgagccgcacctgcgagttgcatctgggatctccagttcaccggcccctaagctcctgagggttggcctgaccctgaggttgcctgtcaatcaccatttcttccctccactccttgtgttacctgcctggtcctgcggggttggcaacaactcaggagcccacctcgggtggttttggaggtgccgtgcacactgctgattgggaggctggacgctgccagtctgtccggagtttcctttacccctgagtagcccccagactgaactggcagcgagtggaggccacgatgcatggttctcttgaagctttgctcttcctgccccaagtcaccctgtcccttgcccacgcccatttgatctgctcaaatgcacaactggagatgtgtgtctttccccacaggtttcttggcgatctcacaacagaaggaataaacaagccaggattttacaagggcccagccggctcccaggtgaccctgagcagcctggggaaccagacacgagtgctgctggaggagcaggctcggcacctgctgaacgagcaggaacacgccaccatggcctactacctggatgagtaccgtggtggcagcgtctctgtggaggccctcgtcatggccctgttcaagctgctcaacacccacgccaagttctcactcctctctgaggtgagaggcaccatttccccgcaagacctagaacgcttcgaccacctggtgctgaggcgtgagattgagtccatgaaggcgcggcagcccccaggccccggggctggggacacctactccatggtctcctacagtgacacgggttcatccacaggcagccacggcacctccaccaccgtcagctcggccaggaacactctggacctggaggaaactggcgaggctgtccagggcaatatcaacgccctcccagatgtgtccgtggatgatgtcagatccacctcccaggggctgtcaagcttcaagccactgcctcgcccaccacctctggcccaaggcaacgacctcccactaggccagccaaggaagctggggagagaggacctccagccaccttcctccatgccttcctgctcgggcactgtcttctcggctccacagaaccgcagcccgccagcgggcaccgcacccaccccagggacctcctctgcacaggacttgccctcttcccccatctatgcctccgtctcccctgccaaccccagctccaagaggccgctggacgcccatctggccctggtcaaccaacaccccatcggccccttcccacgggtccagtcacccccgcacctgaaaagcccctctgcagaggccacagtggctgggggctgccttctgcccccatcaccctctggccacccagaccagacaggcacaaaccagcactttgtcatggtggaggtccaccgccccgacagcgagccagacgtcaatgaagtgagggcgctgccccagacgcgcacagcctctacgctctcccacctctcggacagcgggcagactctaagcgaggacagtggtgtggatgctggcgaggcagaggccagcgccccaggccgaggaaggcagtcggtgtccaccaagagcaggagtagcaaggagctgcctcggaacgagaggcccacagatggggccaacaaaccgcctggacttctggagcccacgtccactctggtccgtgtgaagaaaagtgcggccaccctgggcatcgccatcgagggtggcgccaacacccgccagcccctgcctaggattgtcactattcagagaggcggctcagctcacaactgtgggcagctcaaggtgggccacgtgattctggaagtgaatgggctgacgcttcggggcaaggagcaccgggaggccgcccgcattatcgccgaggccttcaagactaaggaccgtgactacattgactttctggtcactgagttcaatgtgatgctctagaggccaaggcctgagggcctcccaccactgcccagcccctggtcccagtccctttccaccgttggcttcatcaagctccttgcggggttggggctgcatggccagggtggcaggaagacatcccccctccatcccagcccactggaccagaactgggagaggaagagagcaggacaaggcagacagaaggtcaggtcaggaactggtgctgtactgggtacacagtaggcgcccaggacaagtgggttgcaagacaggaagaaaggaaaaggaagggcagagtgctggtttctccaggttgggttgggggcactgctgtcccccctccagctaggacccagcccatccccagatgcctgagcctttgtccaaagtgaggtcactcgagaattcatggacacggcccccagtcagggggcatcttgcaagacctttagtgccacaaataagcatcgagcacctccccattcacacccccattcctcctggctccttatcccccatggtgtttattatttatttccctccccatgcccctggggaccccaaggccccagcttccctctgcacccccagcctatcccagaggccttgcaggtgaccagcagtgtcattgtatttatatacagagcttatgactttaatttttcaataaagaaatctgaacaaggtt

SEQ ID NO: 7894 - DNA, 1202 bp, Homo sapiens
aaactacttggtgaaaccatgctttgtatttttaagatgtataattatatttaaaaacaagcaatgcttaattttgtgcctgattttcctctttaaaaatggatttatctgggggttgcagttgatgacgttttgattttaatatgtttgctgctgctaccaagagctttgtcaagcaagttggagatggagggagattagttcctgttccaagcctcagtgaagctgacaaatatcaacctctaagtctggtggtaaaaaagaagcgatgctttctgtttcctagatataaatttacttcaacaccttttacactgaaagatattctcctaggagacagagaaatttcagctggtatttcatcttatcaattactgaattatgaagatgaatcagatgtttcactctatggaaggcgaggtaaccatattgtaaatgacgttgggattaacgttgctggatcagattccattgcagtgaaagcttcatttggtatagtaaccaaacatgaagtggaagtatcaacattactcaaagaaattactacacgaaaaattaactttgaccacagcttgatacgtcagtcaaggagcagcagaaaggcagtattgtgtgtggtcatggagagcatccgaaccacacgacagtgctcactgtctgtgcatgctggaattcgaggggaagcaatgcggtttcactttatggatgaacagaatcccaagggaagggacaaagctattgttttcccagcacatacaaccatagctttcagtgtttttgaactcttcatatacctggatggtgcctttgacctttgtgtcacttcagtgtcaaaaggaggatttgaaagggaagaaacggcaacatttgcactgctgtacaggttgagaaatatcctatttgaaagaaatagaagagtgatggatgtcatttctcgttcacagctttacttggatgatcttttttctgactactatgacaaacctctcagcatgactgatatttcactcaaagaagggacccatatccgagttaacttacttaatcacaacattcccaaagggccttgcatactctgtggaatggggaacttcaaaagggagacagtttatgggtgctttcagtgttctgttgatggtcagaagtatgtgagacttcatgcagttccttgttttgatatttggcacaagaggatgaaataa

SEQ ID NO: 7895 - DNA, 1531 bp, Homo sapiens
tttcttgccgggagagagggattagagggattgtccggcgtgggtctagggtcgttgaggcctaaagttaagcctttgtggggaggacggattgggggctgggtcactttaagaaaaagattctaaaattacgaaggcagaattccagggagtctcccgggcctggtcctgaagcttgagaccccggatatatacgctccagggggctgcggtgcgctcttcgggtccccgagccctgtgtttaggaacacgcggggacgtccaaacacccgctcctctcccgccgggcgggctcctttgtcttctgggctttcgtcgcgagatggaacgctggttgatgacgttttgattttaatatgtttgctgctgctaccaagagctttgtcaagcaagttggagatggagggagattagttcctgttccaagcctcagtgaagctgacaaatatcaacctctaagtctggtggtaaaaaagaagcgatgctttctgtttcctagatataaatttacttcaacaccttttacactgaaagatattctcctaggagacagagaaatttcagctggtatttcatcttatcaattactgaattatgaagatgaatcagatgtttcactctatggaaggcgaggtaaccatattgtaaatgacgttgggattaacgttgctggatcagattccattgcagtgaaagcttcatttggtatagtaaccaaacatgaagtggaagtatcaacattactcaaagaaattactacacgaaaaattaactttgaccacagcttgatacgtcagtcaaggagcagcagaaaggcagtattgtgtgtggtcatggagagcatccgaaccacacgacagtgctcactgtctgtgcatgctggaattcgaggggaagcaatgcggtttcactttatggatgaacagaatcccaagggaagggacaaagctattgttttcccagcacatacaaccatagctttcagtgtttttgaactcttcatatacctggatggtgcctttgacctttgtgtcacttcagtgtcaaaaggaggatttgaaagggaagaaacggcaacatttgcactgctgtacaggttgagaaatatcctatttgaaagaaatagaagagtgatggatgtcatttctcgttcacagctttacttggatgatcttttttctgactactatgacaaacctctcagcatgactgatatttcactcaaagaagggacccatatccgagttaacttacttaatcacaacattcccaaagggccttgcatactctgtggaatggggaacttcaaaagggagacagtttatgggtgctttcagtgttctgttgatggtcagaagtatgtgagacttcatgcagttccttgttttgatatttggcacaagaggatgaaataaaatgaaaaatgaatacaccgtgttggtgttttaggtgcagttgtgccacaaaccttccctaaattatctaggtttgctttgatgaattaaattaaaatgagaaaagcaaaaagaaa

SEQ ID NO: 7896 - DNA, 2994 bp, Homo sapiens
tcgccgccgccattttagctgttggttccggccgcaccgtgtgggctgtagtagcgggaggggtgggggtcctccagagttaagtggctgtcctcgactgtgcccatacagcagccagctttcttccttaataactgcccgttcgaagagtgcgaggatgtccaagcggcaccggttggacctaggggaggattacccctctggcaagaagcgtgcggggaccgatgggaaggatcgagatcgagaccgggatcgtgaagatcggtctaaagatcgagaccgagaacgtgatagaggagatagagagcgagagagggagaaagaaaaggagaaggagttgcgagcttcaacaaatgctatgcttatcagtgctggattaccacctttgaaagcttcccattcagctcactcaacccactcagcacattcaacgcattcaacacattctgctcattcaacgcatgccggacatgcaggtcacacgtcacttccacagtgcattaatccgttcaccaacttaccccatactcctcgatactatgatattctaaagaaacgtcttcagctccctgtttgggaatacaaggataggtttacagatattctggttagacatcagtcctttgtactggttggtgagactgggtctggtaaaacaacacagattccacagtggtgtgtggagtacatgcgatcattaccaggacccaagagaggagttgcctgtacccaacccaggagagtggctgcaatgagtgtggctcagagagttgctgatgagatggatgtgatgttgggccaggaagttggttactccattcgatttgaagactgcagtagtgcaaaaaccattcttaagtatatgactgatgggatgttacttcgtgaagctatgaatgatcccctcctggagcgttatggtgtaataattcttgatgaggctcatgagaggacactggctacagatattctaatgggtgttctgaaggaagttgtaagacagagatcagatttaaaggttatagttatgagcgctactctagatgcaggaaaattccagatttactttgataactgtcctctcctaactattcctgggcgtacacatcctgttgagatcttctatactccagaaccagagagagattatcttgaagcagcaattcgaacagttatccagattcatatgtgtgaagaggaagagggagatcttcttcttttcttaactggtcaagaggaaattgatgaagcctgtaagagaataaagcgtgaagttgatgatttgggccctgaagttggtgacattaaaatcattccattgtattctacacttccacctcagcagcagcaacgcatttttgagcctccacctcccaaaaaacagaatggagcaattggaagaaaggtagttgtgtcaactaacatagcagagacgtctttgacaatagatggtgtggtgtttgtgattgatcctggatttgcgaaacagaaggtctacaatcctcgaatcagagttgagtcccttttggtgacagctattagtaaagcttcagctcagcaaagggctggtcgagctggacgtaccagacctggaaaatgcttcagactttacacagagaaagcttataaaacagaaatgcaggataacacctatcctgagattttgcgttctaatttaggatcagttgtgttacaattgaagaaacttggtattgatgacttggtacattttgattttatggatccaccagctcctgaaactctgatgagagccctggaacttttgaattacctggctgctttaaatgatgatggagatctgactgaattgggatccatgatggcagagtttcctctagatccacagctcgcaaaaatggttattgcaagttgtgactacaactgttctaatgaggtcctatctattactgctatgttgtcagtcccacagtgttttgttcgccccacggaggccaagaaagccgcagatgaggccaagatgagatttgcccacatagatggagatcatctgacactgctgaacgtctaccatgcttttaaacaaaatcatgaatcggttcagtggtgttatgacaacttcattaactacaggtccctgatgtccgcagacaatgtacgccagcagctatctcgaattatggacagatttaatttgcctcgtcgaagtactgactttacaagcagggactattatattaatataagaaaagctttggttactgggtattttatgcaggtggcacatttagaacgaacagggcattacttaactgtgaaagataaccaggtggttcagttgcatccctctactgttcttgaccacaaacctgaatgggtgctttataatgagtttgttctaacaacaaagaattacatccggacatgtacagatatcaagccagaatggttggtgaaaattgcccctcaatattatgacatgagcaatttcccacagtgtgaagcaaagagacagttggaccgcatcattgccaaacttcaatccaaggaatattcacagtactgaattcagtgcttagaactgaagttattgagaggacagctttaaaagatgaatgaactcaaaagttcgagttgtgctcttcacgttggttcgataatggcctttatttgaaagctttttaatttttctttacagtaaatattccattctgatttcataaattaaacatttatgcctcccttttgtgttgacactgtagctcatactggaaaagtcgatcaatgttttgcagtttattgaaagtagttctatatataacaatgttataagcatttctttagaaatggttgaaaatgcttctaaaatgtgattatcgaccatggtatgcatgatcgttgtaattgttgacattccttttagaagttgtgaaatgttacaacttgtgcttatgtagacacaatcttctgtctcagtacagaggcactgacttcaataaagtctatttatactaa

SEQ ID NO: 7897 - DNA, 2556 bp, Homo sapiens
agctgttggttccggccgcaccgtgtgggctgtagtagcgggaggggtgggggtcctccagagttaagtggctgtcctcgactgtgcccatacagcagccagctttcttccttaataactgcccgttcgaagagtgcgaggatgtccaagcggcaccggttggacctaggggaggattacccctctggcaagaagcgtgcggggaccgatgggaaggatcgagatcgagaccgagaacgtgatagaggagatagagagcgagagagggagaaagaaaaggagaaggagttgcgagcttcaacaaatgctatgcttatcagtgctggattaccacctttgaaagcttcccattcagctcactcaacccactcagcacattcaacgcattcaacacattctgctcattcaacgcatgccggacatgcaggtcacacgtcacttccacagtgcattaatccgttcaccaacttaccccatactcctcgatactatgatattctaaagaaacgtcttcagctccctgtttgggaatacaaggataggtttacagatattctggttagacatcagtcctttgtactggttggtgagactgggtctggtaaaacaacacagattccacagtggtgtgtggagtacatgcgatcattaccaggacccaagagaggagttgcctgtacccaacccaggagagtggctgcaatgagtgtggctcagagagttgctgatgagatggatgtgatgttgggccaggaagttggttactccattcgatttgaagactgcagtagtgcaaaaaccattcttaagtatatgactgatgggatgttacttcgtgaagctatgaatgatcccctcctggagcgttatggtgtaataattcttgatgaggctcatgagaggacactggctacagatattctaatgggtgttctgaaggaagttgtaagacagagatcagatttaaaggttatagttatgagcgctactctagatgcaggaaaattccagatttactttgataactgtcctctcctaactattcctgggcgtacacatcctgttgagatcttctatactccagaaccagagagagattatcttgaagcagcaattcgaacagttatccagattcatatgtgtgaagaggaagagggagatcttcttcttttcttaactggtcaagaggaaattgatgaagcctgtaagagaataaagcgtgaagttgatgatttgggccctgaagttggtgacattaaaatcattccattgtattctacacttccacctcagcagcagcaacgcatttttgagcctccacctcccaaaaaacagaatggagcaattggaagaaaggtagttgtgtcaactaacatagcagagacgtctttgacaatagatggtgtggtgtttgtgattgatcctggatttgcgaaacagaaggtctacaatcctcgaatcagagttgagtcccttttggtgacagctattagtaaagcttcagctcagcaaagggctggtcgagctggacgtaccagacctggaaaatgcttcagactttacacagagaaagcttataaaacagaaatgcaggataacacctatcctgagattttgcgttctaatttaggatcagttgtgttacaattgaagaaacttggtattgatgacttggtacattttgattttatggatccaccagctcctgaaactctgatgagagccctggaacttttgaattacctggctgctttaaatgatgatggagatctgactgaattgggatccatgatggcagagtttcctctagatccacagctcgcaaaaatggttattgcaagttgtgactacaactgttctaatgaggtcctatctattactgctatgttgtcagtcccacagtgttttgttcgccccacggaggccaagaaagccgcagatgaggccaagatgagatttgcccacatagatggagatcatctgacactgctgaacgtctaccatgcttttaaacaaaatcatgaatcggttcagtggtgttatgacaacttcattaactacaggtccctgatgtccgcagacaatgtacgccagcagctatctcgaattatggacagatttaatttgcctcgtcgaagtactgactttacaagcagggactattatattaatataagaaaagctttggttactgggtattttatgcaggtggcacatttagaacgaacagggcattacttaactgtgaaagataaccaggtggttcagttgcatccctctactgttcttgaccacaaacctgaatgggtgctttataatgagtttgttctaacaacaaagaattacatccggacatgtacagatatcaagccagaatggttggtgaaaattgcccctcaatattatgacatgagcaatttcccacagtgtgaagcaaagagacagttggaccgcatcattgccaaacttcaatccaaggaatattcacagtactgaattcagtgcttagaactgaagttattgagaggacagctttaaaagatgaatgaactcaaa

SEQ ID NO: 7898 - DNA, 1933 bp, Homo sapiens
ctgaacaatatgtgcctttttgactcttcagaggctgtgaatttctggtcttggaagatcacagtggagcaattggacagataggattttatccttcatatcccttgcaaaagatctctaagaacccatggagagccagccagcgcaagagtgtctgatgcagatgtttttgcccatcgagccagcctgctttgtggaatggctggggacttcaccatcacagttaggcgtggtgatggtggatgaggcacacgaaaggaccctacacacagacattctctttggattgatcaaggatgttgctcgcttccgacctgagctcaaggtcctggtggcttcagccacaatggacactgcccgtttttccaccttctttgatgacgcccctgtgtttcgaatccccggacgcaggtttcctgtggacatcttctacaccaaggctccagaggctgactacttggaagcttgtgtagtatctgtgttgcagatccatgtgacccagccccctggggatatcctggtgttcctgacaggacaggaggagattgaggctgcctgtgagatgctccaggatcgctgccgccgcctgggctccaaaatccgggagctcctggtgctgcccatttatgccaatctgccctctgacatgcaggcccgtatcttccagcccacaccacctggggcacgaaaggtggttgtggcaacgaacattgctgagacatcactcaccattgagggcatcatttatgtgctggatccagggttctgtaagcagaagagctacaacccccgcacaggcatggaatcgctcactgtcacaccctgcagcaaggcctcagccaatcagcgagctggcagggcaggtcgggtggctgcagggaagtgcttccgcctgtataccgcctgggcctatcagcacgagcttgaggaaaccacagtgcctgagatccagaggaccagcttgggcaatgtcgtgttgctgctcaagagcttagggatccatgacctaatgcactttgatttcctggaccctccaccatatgagacactgctgctggctttggagcagctgtatgctctgggagccctcaaccaccttggggagctcaccacgtctggtcgaaagatggcagagctgccggtggaccccatgctgtccaaaatgatcttagcctctgagaagtacagctgttcagaggagatcctgacagtggctgccatgctctctgtcaacaactccatcttctaccgaccaaaggacaaggtcgtccatgctgacaatgcccgtgtcaacttctttctccctggcggtgaccacctggttctgctaaatgtttacacacagtgggctgagagtggttactcttcccagtggtgctatgagaactttgtacagttcagatcgatgcgccgagcccgggatgtgcgggaacagctggaagggctcttggaacgtgtggaagttggtctcagttcctgccagggggactatatccgtgtacgcaaggccatcactgctggttacttttaccacacggcacggttgactcggagtggctaccgcacagtgaaacagcagcagacagtcttcattcatcccaactcctccctctttgagcaacagccacgctggctgctctaccacgaacttgtcttgaccaccaaagagttcatgagacaggtactggagattgagagcagttggcttctggaggtggctccccattattataaggccaaggagctagaagatccccatgctaagaaaatgcccaaaaaaataggcaaaacacgagaagagctagggtaagagaaggacgtaaacagaacctgacaccagctccttttccttctatacattatttaatacctattaaataaaattatttttggaataaagcttgtgggaacatttgggatctagagaaagtga

SEQ ID NO: 7899 - DNA, 3445 bp, Homo sapiens
ggccgaaaaagtacagccccttccgggctccgcggtacgggaagacagctttgggatgtcggaagatcctagaggtcccaaggtagctgacttgcgaagctgaggctccagccgagggctccaggcctctgaccggcccagcagtgagcgcggctgcccgacgcttcagggccgggagcagggagcgtgagtcgccatggcgacgccggcgggtctggagcgctgggttcaggacgagctgcactcggtgttggggctgagcgagcggcacgtcgcccagtttctgatcggtaccgcacagcgctgcacctctgccgaggagttcgtgcagcgcctacgagacactgataccttggatctcagtgggccggcccgggacttcgccctgagactctggaacaaggtaccacgaaaggcagtggtagaaaagccagctcgggcagcagagcgagaggcccgggccctgctggagaagaaccgatcttataggttactggaagacagtgaagagagcagtgaggagactgtgagtagggctggaagcagcctccagaagaaacgtaaaaagcggaaacacctcaggaagaagcgtgaggaagaagaggaggaagaggcttctgagaaagggaagaagaaaacaggggggagtaaacagcagacagagaagccagagtcggaagatgagtgggaacggacagagcgtgaacgccttcaggacctggaggagcgtgatgcctttgctgagcgggttcgacagcgggacaaggatcggactcgaaatgtcctggaacggtcagacaagaaggcttatgaagaggctcagaagcgcctcaagatggccgaggaagaccggaaggccatggtccctgagctgcggaagaaatctcgccgagagtacctggctaagcgggagcgagagaagcttgaggacctggaggcggagctggctgatgaggagttcctttttggggacgtggagctgagccggcacgagcggcaggagctcaaatataagcggcgagtgcgggatctcgcccgggagtaccgggcagctggggagcaggagaagctggaggccaccaatcgctaccacatgcccaaggaaacccgaggacagccagcccgagctgtggatctagtggaggaggaatcaggagcccctggggaggagcagcggcgctgggaggaggcgcggcttggggcagcgtccctgaagtttggggcccgagatgctgcctctcaggagcccaagtatcaactggtgctggaggaggaggagaccattgagtttgtccgggccactcagctccagggtgatgaggagccgtcagctccacccacttcaactcaggcccagcagaaagagtccatccaggccgtccgccgcagcctcccggtgttcccatttcgagaggagctcctggctgctattgcaaatcaccaagtcctcatcattgaaggcgagacaggctcagggaagaccacccagatcccgcagtatctctttgaggagggttatacaaacaagggtatgaagattgcctgcacccaaccccggagagtggctgccatgagtgtggccgcccgagtggcccgggagatgggtgtgaagcttgggaatgaggttggctacagcatccgctttgaggactgcacatcagagcgaactgtcctccgctacatgacagatgggatgcttctccgggagttcctctctgagcctgacctggcgagttacagcgtggtgatggtggatgaggcacacgaaaggaccctacacacagacattctctttggattgatcaaggatgttgctcgcttccgacctgagctcaaggtcctggtggcttcagccacaatggacactgcccgtttttccaccttctttgatgacgcccctgtgtttcgaatccccggacgcaggtttcctgtggacatcttctacaccaaggctccagaggctgactacttggaagcttgtgtagtatctgtgttgcagatccatgtgacccagccccctggggatatcctggtgttcctgacaggacaggaggagattgaggctgcctgtgagatgctccaggatcgctgccgccgcctgggctccaaaatccgggagctcctggtgctgcccatttatgccaatctgccctctgacatgcaggcccgtatcttccagcccacaccacctggggcacgaaaggtggttgtggcaacgaacattgctgagacatcactcaccattgagggcatcatttatgtgctggatccagggttctgtaagcagaagagctacaacccccgcacaggcatggaatcgctcactgtcacaccctgcagcaaggcctcagccaatcagcgagctggcagggcaggtcgggtggctgcagggaagtgcttccgcctgtataccgcctgggcctatcagcacgagcttgaggaaaccacagtgcctgagatccagaggaccagcttgggcaatgtcgtgttgctgctcaagagcttagggatccatgacctaatgcactttgatttcctggaccctccaccatatgagacactgctgctggctttggagcagctgtatgctctgggagccctcaaccaccttggggagctcaccacgtctggtcgaaagatggcagagctgccggtggaccccatgctgtccaaaatgatcttagcctctgagaagtacagctgttcagaggagatcctgacagtggctgccatgctctctgtcaacaactccatcttctaccgaccaaaggacaaggtcgtccatgctgacaatgcccgtgtcaacttctttctccctggcggtgaccacctggttctgctaaatgtttacacacagtgggctgagagtggttactcttcccagtggtgctatgagaactttgtacagttcagatcgatgcgccgagcccgggatgtgcgggaacagctggaagggctcttggaacgtgtggaagttggtctcagttcctgccagggggactatatccgtgtacgcaaggccatcactgctggttacttttaccacacggcacggttgactcggagtggctaccgcacagtgaaacagcagcagacagtcttcattcatcccaactcctccctctttgagcaacagccacgctggctgctctaccacgaacttgtcttgaccaccaaagagttcatgagacaggtactggagattgagagcagttggcttctggaggtggctccccattattataaggccaaggagctagaagatccccatgctaagaaaatgcccaaaaaaataggcaaaacacgagaagagctagggtaagagaaggacgtaaacagaacctgacaccagctccttttccttctatacattatttaatacctattaaataaaattatttttggaataaagcttgtgggaacatttgggatctagagaaagtga

SEQ ID NO: 7900 - DNA, 1933 bp, Homo sapiens
ctgaacaatatgtgcctttttgactcttcagaggctgtgaatttctggtcttggaagatcacagtggagcaattggacagataggattttatccttcatatcccttgcaaaagatctctaagaacccatggagagccagccagcgcaagagtgtctgatgcagatgtttttgcccatcgagccagcctgctttgtggaatggctggggacttcaccatcacagttaggcgtggtgatggtggatgaggcacacgaaaggaccctacacacagacattctctttggattgatcaaggatgttgctcgcttccgacctgagctcaaggtcctggtggcttcagccacaatggacactgcccgtttttccaccttctttgatggcgcccctgtgtttcgaatccccggacgcaggtttcctgtggacatcttctacaccaaggctccagaggctgactacttggaagcttgtgtagtatctgtgttgcagatccatgtgacccagccccctggggatatcctggtgttcctgacaggacaggaggagattgaggctgcctgtgagatgctccaggatcgctgccgccgcctgggctccaaaatccgggagctcctggtgctgcccatttatgccaatctgccctctgacatgcaggcccgtatcttccagcccacaccacctggggcacgaaaggtggttgtggcaacgaacattgctgagacatcactcaccattgagggcatcatttatgtgctggatccagggttctgtaagcagaagagctacaacccccgcacaggcatggaatcgctcactgtcacaccctgcagcaaggcctcagccaatcagcgagctggcagggcaggtcgggtggctgcagggaagtgcttccgcctgtataccgcctgggcctatcagcacgagcttgaggaaaccacagtgcctgagatccagaggaccagcttgggcaatgtcgtgttgctgctcaagagcttagggatccatgacctaatgcactttgatttcctggaccctccaccatatgagacactgctgctggctttggagcagctgtatgctctgggagccctcaaccaccttggggagctcaccacgtctggtcgaaagatggcagagctgccggtggaccccatgctgtccaaaatgatcttagcctctgagaagtacagctgttcagaggagatcctgacagtggctgccatgctctctgtcaacaactccatcttctaccgaccaaaggacaaggtcgtccatgctgacaatgcccgtgtcaacttctttctccctggcggtgaccacctggttctgctaaatgtttacacacagtgggctgagagtggttactcttcccagtggtgctatgagaactttgtacagttcagatcgatgcgccgagcccgggatgtgcgggaacagctggaagggctcttggaacgtgtggaagttggtctcagttcctgccagggggactatatccgtgtacgcaaggccatcactgctggttacttttaccacacggcacggttgactcggagtggctaccgcacagtgaaacagcagcagacagtcttcattcatcccaactcctccctctttgagcaacagccacgctggctgctctaccacgaacttgtcttgaccaccaaagagttcatgagacaggtactggagattgagagcagttggcttctggaggtggctccccattattataaggccaaggagctagaagatccccatgctaagaaaatgcccaaaaaaataggcaaaacacgagaagagctagggtaagagaaggacgtaaacagaacctgacaccagctccttttccttctatacattatttaatacctattaaataaaattatttttggaataaagcttgtgggaacatttgggatctagagaaagtga

SEQ ID NO: 7901 - DNA, 3445 bp, Homo sapiens
ggccgaaaaagtacagccccttccgggctccgcggtacgggaagacagctttgggatgtcggaagatcctagaggtcccaaggtagctgacttgcgaagctgaggctccagccgagggctccaggcctctgaccggcccagcagtgagcgcggctgcccgacgcttcagggccgggagcagggagcgtgagtcgccatggcgacgccggcgggtctggagcgctgggttcaggacgagctgcactcggtgttggggctgagcgagcggcacgtcgcccagtttctgatcggtaccgcacagcgctgcacctctgccgaggagttcgtgcagcgcctacgagacactgataccttggatctcagtgggccggcccgggacttcgccctgagactctggaacaaggtaccacgaaaggcagtggtagaaaagccagctcgggcagcagagcgagaggcccgggccctgctggagaagaaccgatcttataggttactggaagacagtgaagagagcagtgaggagactgtgagtagggctggaagcagcctccagaagaaacgtaaaaagcggaaacacctcaggaagaagcgtgaggaagaagaggaggaagaggcttctgagaaagggaagaagaaaacaggggggagtaaacagcagacagagaagccagagtcggaagatgagtgggaacggacagagcgtgaacgccttcaggacctggaggagcgtgatgcctttgctgagcgggttcgacagcgggacaaggatcggactcgaaatgtcctggaacggtcagacaagaaggcttatgaagaggctcagaagcgcctcaagatggccgaggaagaccggaaggccatggtccctgagctgcggaagaaatctcgccgagagtacctggctaagcgggagcgagagaagcttgaggacctggaggcggagctggctgatgaggagttcctttttggggacgtggagctgagccggcacgagcggcaggagctcaaatataagcggcgagtgcgggatctcgcccgggagtaccgggcagctggggagcaggagaagctggaggccaccaatcgctaccacatgcccaaggaaacccgaggacagccagcccgagctgtggatctagtggaggaggaatcaggagcccctggggaggagcagcggcgctgggaggaggcgcggcttggggcagcgtccctgaagtttggggcccgagatgctgcctctcaggagcccaagtatcaactggtgctggaggaggaggagaccattgagtttgtccgggccactcagctccagggtgatgaggagccgtcagctccacccacttcaactcaggcccagcagaaagagtccatccaggccgtccgccgcagcctcccggtgttcccatttcgagaggagctcctggctgctattgcaaatcaccaagtcctcatcattgaaggcgagacaggctcagggaagaccacccagatcccgcagtatctctttgaggagggttatacaaacaagggtatgaagattgcctgcacccaaccccggagagtggctgccatgagtgtggccgcccgagtggcccgggagatgggtgtgaagcttgggaatgaggttggctacagcatccgctttgaggactgcacatcagagcgaactgtcctccgctacatgacagatgggatgcttctccgggagttcctctctgagcctgacctggcgagttacagcgtggtgatggtggatgaggcacacgaaaggaccctacacacagacattctctttggattgatcaaggatgttgctcgcttccgacctgagctcaaggtcctggtggcttcagccacaatggacactgcccgtttttccaccttctttgatggcgcccctgtgtttcgaatccccggacgcaggtttcctgtggacatcttctacaccaaggctccagaggctgactacttggaagcttgtgtagtatctgtgttgcagatccatgtgacccagccccctggggatatcctggtgttcctgacaggacaggaggagattgaggctgcctgtgagatgctccaggatcgctgccgccgcctgggctccaaaatccgggagctcctggtgctgcccatttatgccaatctgccctctgacatgcaggcccgtatcttccagcccacaccacctggggcacgaaaggtggttgtggcaacgaacattgctgagacatcactcaccattgagggcatcatttatgtgctggatccagggttctgtaagcagaagagctacaacccccgcacaggcatggaatcgctcactgtcacaccctgcagcaaggcctcagccaatcagcgagctggcagggcaggtcgggtggctgcagggaagtgcttccgcctgtataccgcctgggcctatcagcacgagcttgaggaaaccacagtgcctgagatccagaggaccagcttgggcaatgtcgtgttgctgctcaagagcttagggatccatgacctaatgcactttgatttcctggaccctccaccatatgagacactgctgctggctttggagcagctgtatgctctgggagccctcaaccaccttggggagctcaccacgtctggtcgaaagatggcagagctgccggtggaccccatgctgtccaaaatgatcttagcctctgagaagtacagctgttcagaggagatcctgacagtggctgccatgctctctgtcaacaactccatcttctaccgaccaaaggacaaggtcgtccatgctgacaatgcccgtgtcaacttctttctccctggcggtgaccacctggttctgctaaatgtttacacacagtgggctgagagtggttactcttcccagtggtgctatgagaactttgtacagttcagatcgatgcgccgagcccgggatgtgcgggaacagctggaagggctcttggaacgtgtggaagttggtctcagttcctgccagggggactatatccgtgtacgcaaggccatcactgctggttacttttaccacacggcacggttgactcggagtggctaccgcacagtgaaacagcagcagacagtcttcattcatcccaactcctccctctttgagcaacagccacgctggctgctctaccacgaacttgtcttgaccaccaaagagttcatgagacaggtactggagattgagagcagttggcttctggaggtggctccccattattataaggccaaggagctagaagatccccatgctaagaaaatgcccaaaaaaataggcaaaacacgagaagagctagggtaagagaaggacgtaaacagaacctgacaccagctccttttccttctatacattatttaatacctattaaataaaattatttttggaataaagcttgtgggaacatttgggatctagagaaagtga

SEQ ID NO: 7902 - DNA, 1933 bp, Homo sapiens; identical to SEQ ID NO: 7898

SEQ ID NO: 7903 - DNA, 892 bp, Homo sapiens
tttgggatgtcggaagatcctagaggtcccaaggtaccacgaaaggcagtggtagaaaagccagctcgggcagcagagcgagaggcccgggccctgctggagaagaaccgatcttataggttactggaagacagtgaagagagcagtgaggagactgtgagtagggctggaagcagcctccagaagaaacgtaaaaagcggaaacacctcaggaagaagcgtgaggaagaagaggaggaagaggcttctgagaaagggaagaagaaaacaggggggagtaaacagcagacagagaagccagagtcggaagatgagtgggaacggacagagcgtgaacgccttcaggacctggaggagcgtgatgcctttgctgagcgggttcgacagcgggacaaggatcggactcgaaatgtcctggaacggtcagacaagaaggcttatgaagaggctcagaagcgcctcaagatggccgaggaagaccggaaggccatggtccctgagctgcggaagaaatctcgccgagagtacctggctaagcgggagcgagagaagcttgaggacctggaggcggagctggctgatgaggagttcctttttggggacgtggagctgagccggcacgagcggcaggagctcaaatataagcggcgagtgcgggatctcgcccgggagtaccgggcagctggggagcaggagaagctggaggccaccaatcgctaccacatgcccaaggaaacccgaggacagccagcccgagctgtggatctagtggaggaggaatcaggagcccctggggaggagcagcggcgctgggaggaggcgcggcttggggcagcgtccctgaagtttggggcccgagatgctgcctctcaggagcccaagtatcaactgg

SEQ ID NO: 7904 - DNA, 3445 bp, Homo sapiens; identical to SEQ ID NO: 7899

SEQ ID NO: 7905 - DNA, 3445 bp, Homo sapiens; identical to SEQ ID NO: 7899

SEQ ID NO: 7906 - DNA, 3445 bp, Homo sapiens; identical to SEQ ID NO: 7899

SEQ ID NO: 7907 - DNA, 892 bp, Homo sapiens; identical to SEQ ID NO: 7903

SEQ ID NO: 7908 - DNA, 892 bp, Homo sapiens; identical to SEQ ID NO: 7903

SEQ ID NO: 7909 - DNA, 1933 bp, Homo sapiens; identical to SEQ ID NO: 7898

SEQ ID NO: 7910 - DNA, 892 bp, Homo sapiens; identical to SEQ ID NO: 7903

SEQ ID NO: 7911 - DNA, 892 bp, Homo sapiens; identical to SEQ ID NO: 7903

SEQ ID NO: 7912 - DNA, 892 bp, Homo sapiens; identical to SEQ ID NO: 7903

SEQ ID NO: 7913 - DNA, 892 bp, Homo sapiens; identical to SEQ ID NO: 7903

SEQ ID NO: 7914 - DNA, 1933 bp, Homo sapiens; identical to SEQ ID NO: 7898

SEQ ID NO: 7915 - DNA, 892 bp, Homo sapiens; identical to SEQ ID NO: 7903

SEQ ID NO: 7916 - DNA, 2203 bp, Homo sapiens
ggccgaaaaagtacagccccttccgggctccgcggtacgggaagacagctttgggatgtcggaagatcctagaggtcccaaggtagctgacttgcgaagctgaggctccagccgagggctccaggcctctgaccggcccagcagtgagcgcggctgcccgacgcttcagggccgggagcagggagcgtgagtcgccatggcgacgccggcgggtctggagcgctgggttcaggacgagctgcactcggtgttggggctgagcgagcggcacgtcgcccagtttctgatcggtaccgcacagcgctgcacctctgccgaggagttcgtgcagcgcctacgagacactgataccttggatctcagtgggccggcccgggacttcgccctgagactctggaacaaggtaccacgaaaggcagtggtagaaaagccagctcgggcagcagagcgagaggcccgggccctgctggagaagaaccgatcttataggttactggaagacagtgaagagagcagtgaggagactgtgagtagggctggaagcagcctccagaagaaacgtaaaaagcggaaacacctcaggaagaagcgtgaggaagaagaggaggaagaggcttctgagaaagggaagaagaaaacaggggggagtaaacagcagacagagaagccagagtcggaagatgagtgggaacggacagagcgtgaacgccttcaggacctggaggagcgtgatgcctttgctgagcgggttcgacagcgggacaaggatcggactcgaaatgtcctggaacggtcagacaagaaggcttatgaagaggctcagaagcgcctcaagatggccgaggaagaccggaaggccatggtccctgagctgcggaagaaatctcgccgagagtacctggctaagcgggagcgagagaagcttgaggacctggaggcggagctggctgatgaggagttcctttttggggacgtggagctgagccggcacgagcggcaggagctcaaatataagcggcgagtgcgggatctcgcccgggagtaccgggcagctggggagcaggagaagctggaggccaccaatcgctaccacatgcccaaggaaacccgaggacagccagcccgagctgtggatctagtggaggaggaatcaggagcccctggggaggagcagcggcgctgggaggaggcgcggcttggggcagcgtccctgaagtttggggcccgagatgctgcctctcaggagcccaagtatcaactggtgctggaggaggaggagaccattgagtttgtccgggccactcagctccagggtgatgaggagccgtcagctccacccacttcaactcaggcccagcagaaagagtccatccaggccgtccgccgcagcctcccggtgttcccatttcgagaggagctcctggctgctattgcaaatcaccaagtcctcatcattgaaggcgagacaggctcagggaagaccacccagatcccgcagtatctctttgaggagggttatacaaacaagggtatgaagattgcctgcacccaaccccggagagtggctgccatgagtgtggccgcccgagtggcccgggagatgggtgtgaagcttgggaatgaggttggctacagcatccgctttgaggactgcacatcagagcgaactgtcctccgctacatgacagatgggatgcttctccgggagttcctctctgagcctgacctggcgagttacagcgtggtgatggtggatgaggcacacgaaaggaccctacacacagacattctctttggattgatcaaggatgttgctcgcttccgacctgagctcaaggtcctggtggcttcagccacaatggacactgcccgtttttccaccttctttgatgacgcccctgtgtttcgaatccccggacgcaggtttcctgtggacatcttctacaccaaggctccagaggctgactacttggaagcttgtgtagtatctgtgttgcagatccatgtgacccagccccctggggatatcctggtgttcctgacaggacaggaggagattgaggctgcctgtgagatgctccaggatcgctgccgccgcctgggctccaaaatccgggagctcctggtgctgcccatttatgccaatctgccctctgacatgcaggcccgtatcttccagcccacaccacctggggcacgaaag

SEQ ID NO: 7917 - DNA, 3445 bp, Homo sapiens; identical to SEQ ID NO: 7899

SEQ ID NO: 7918 - DNA, 1933 bp, Homo sapiens; identical to SEQ ID NO: 7898

SEQ ID NO: 7919 - DNA, 1933 bp, Homo sapiens; identical to SEQ ID NO: 7898

SEQ ID NO: 7920 - DNA, 691 bp, Homo sapiens
ctgaacaatatgtgcctttttgactcttcagaggctgtgaatttctggtcttggaagatcacagtggagcaattggacagataggattttatccttcatatcccttgcaaaagatctctaagaacccatggagagccagccagcgcaagagtgtctgatgcagatgtttttgcccatcgagccagcctgctttgtggaatggctggggacttcaccatcacagttaggcgtggtgatggtggatgaggcacacgaaaggaccctacacacagacattctctttggattgatcaaggatgttgctcgcttccgacctgagctcaaggtcctggtggcttcagccacaatggacactgcccgtttttccaccttctttgatgacgcccctgtgtttcgaatccccggacgcaggtttcctgtggacatcttctacaccaaggctccagaggctgactacttggaagcttgtgtagtatctgtgttgcagatccatgtgacccagccccctggggatatcctggtgttcctgacaggacaggaggagattgaggctgcctgtgagatgctccaggatcgctgccgccgcctgggctccaaaatccgggagctcctggtgctgcccatttatgccaatctgccctctgacatgcaggcccgtatcttccagcccacaccacctggggcacgaaag

SEQ ID NO: 7921 - DNA, 3445 bp, Homo sapiens; identical to SEQ ID NO: 7899

SEQ ID NO: 7922 - DNA, 576 bp, Homo sapiens
gaagatcctagaggtcccaaggtagctgacttgcgaagctgaggctccagccgagggctccaggcctctgaccggcccagcagtgagcgcggctgcccgacgcttcagggccgggagcagggagcgtgagtcgccatggcgacgccggcgggtctggagcgctgggttcaggacgagctgcactcggtgttggggctgagcgagcggcacgtcgcccagtttctgatcggtaccgcacagcgctgcacctctgccgaggagttcgtgcagcgcctacgagacactgataccttggatctcagtgggccggcccgggacttcgccctgagactctggaacaaggtaccacgaaaggcagtggtagaaaagccagctcgggcagcagagcgagaggcccgggccctgctggagaagaaccgatcttataggttactggaagacagtgaagagagcagtgaggagactgtgagtagggctggaagcagcctccagaagaaacgtaaaaagcggaaacacctcaggaagaagcgtgaggaagaagaggaggaagaggcttctgagaaagggaagaagaaa

SEQ ID NO: 7923 - DNA, 4502 bp, Homo sapiens
aattgcgaggcagcggtcgccccggcccgagaagcccggatcgaagcgcagggtggcagccccggagccggggaatgtgaagagctctcggctgtgcagtggtaccgtcggggcctgggccgcgaaggatcttctgccacagctgcaacatgggcggcaagaacaagaaacacaaggctccagcggccgcggtggtccgggccgccgtgtctgcttccagagccaaatctgccgaggctggaattgccggggaggcccaaagcaagaagccagtgtccaggccggccaccgctgccgctgccgctgccggctccagggagccccgtgtcaagcaaggtccaaaaatttatagttttaattctacaaatgattctagtggtcctgcaaatctggataaatctattttgaaagtggtaattaataacaaactagagcaaagaattattggagtgatcaatgagcataaaaagcaaaataatgacaaaggaatgatttctggaagacttactgccaaaaaattgcaggatttatacatggctttacaagcattttcatttaagacaaaggacattgaagatgccatgaccaatacactcttatatggaggtgaccttcattctgccttggattggctctgtttaaacctttcagatgatgcacttcctgaaggattcagtcaggaatttgaagagcagcaacctaaaagtaggcctaaatttcagtctcctcaaatacaagccactatttcacctccattgcaacctaaaacaaaaacatatgaagaggaccctaagagtaagccaaaaaaggaagaaaaaaatatggaagtaaatatgaaagagtggattttacgatatgctgaacaacaaaatgaagaagaaaagaatgagaattctaaaagtttagaagaggaggaaaaatttgaccctaatgaaaggtacttacatcttgcagcaaaactgctggatgcaaaagaacaagcagctacctttaaactagaaaaaaacaagcaaggccaaaaagaggctcaggaaaaaataaggaaatttcaaagagaaatggaaactttagaagaccatccagtatttaacccagccatgaagatttcacatcaacaaaatgaaaggaaaaagcctcctgtagccacagaaggagaaagtgcattgaattttaatttatttgaaaaatctgcagctgctactgaagaagagaaagataaaaagaaagaacctcatgatgtaagaaattttgactatactgctcgaagttggactggaaaatctcccaaacaatttctgattgattgggtcaggaagaatcttcccaagagtccaaatccttcctttgaaaaagttccagtaggtagatactggaaatgtagggttagggtaatcaagtctgaagatgatgtcctggtagtatgccctacaatcttaacagaagatggcatgcaagctcagcacctgggagctactttagccctttaccgtttagttaaagggcagtcagttcatcagttacttcctcccacttaccgagatgtttggctggagtggagtgatgcagaaaagaaaagggaagaattaaataaaatggaaaccaataaaccacgtgatctttttattgccaaacttctgaataaactgaaacagcagcaacagcagcaacaacagcattctgaaaataagagagaaaactctgaagatcccgaggaatcttgggaaaatttagtttcggatgaggatttttctgcactgtccttggaatcagcaaatgtggaagatttggaacctgttagaaacctctttagaaagttgcaaagcacacctaagtatcagaaacttctaaaggaaagacaacagctacctgtatttaaacatcgggactcaattgttgaaactcttaaaaggcatcgggtagtggttgtggcaggtgaaacagggagtggtaaaagtactcaggtaccacattttctattggaagatttgcttctaaatgagtgggaagcaagtaaatgtaacattgtctgtacccaaccccgaagaatctcagcagttagtttagccaacagagtatgtgatgaattgggctgtgaaaatggacctggaggaaggaattccttgtgtggatatcagatccggatggaatctcgagcttgtgaatctaccaggttactctattgtacaacaggggttttgctaaggaaacttcaagaagatggtcttctaagtaatgtgtctcatgttattgtagatgaggttcatgaaagaagtgtccagtcagacttcctactaattatcttgaaggaaattttacagaaacgttctgatctacacttgattctaatgagtgccactgtggacagcgaaaaattttctacatatttcacacactgccccattctcagaatttcaggaagaagttatcctgttgaggtttttcatcttgaagatataatagaagaaacaggctttgtactggaaaaagactcagaatattgtcagaaatttctggaagaggaagaagaagtaaccattaatgttacaagcaaagcagggggaataaaaaaatatcaggaatacatcccagttcagactggagcacatgctgatttaaatccattttaccaaaagtacagcagccgcactcagcatgctattctatacatgaatcctcataaaatcaacctggatctcattttggaacttcttgcatacttagataaaagtccccaattcagaaatattgaaggagcagtattgatctttttaccaggacttgctcatattcagcagttgtatgatcttctatcaaatgatagaagattttattctgaacgatataaagtgatagctctgcattctattctttcaacccaagatcaagctgcagcattcacacttccccctccaggagtcaggaagattgttttagcaaccaatattgcagagacgggtatcactattcctgatgttgtatttgtaattgatactggaagaacaaaagaaaataagtaccatgaaagcagtcagatgagttctttggtggagacgtttgtcagtaaagccagtgctttgcagcgccagggaagagctgggcgggtcagagatggcttctgtttccgaatgtacacaagagaaagatttgaaggctttatggattattctgttcctgaaatcttacgtgtacctttggaggaattatgccttcatattatgaaatgtaatcttggttctcctgaagatttcctctccaaagccttagatcctcctcagctccaagtgatcagcaatgcaatgaatttgctccgaaaaattggagcttgtgaattaaatgagcctaaactgactccgttgggccaacaccttgcagctttacctgtgaatgtcaagattggcaagatgcttatttttggtgccatatttggctgccttgacccagtggcaacactagctgcagttatgacagagaagtctccttttaccacaccaattggtcgaaaagatgaagcagatcttgcaaaatcagctttggccatggcggattcagaccacctgacgatctacaatgcatatctaggatggaagaaagcacgacaagaaggaggttatcgttctgaaatcacatactgccggaggaactttcttaatagaacatcactgttaaccctagaggatgtaaagcaggagttaataaagttggttaaggcagcaggattttcatcttccacaacttctaccagctgggaaggaaacagagcctcacagaccctctcattccaagaaattgcccttcttaaagctgtactggtggctggactgtatgacaatgtggggaagataatctatacaaagtcagtggatgttacagaaaaattggcttgcattgtggagacggcccaaggcaaagcacaagtacacccatcctcagtaaatcgagatttgcaaactcatggatggctcttataccaggagaagataaggtatgccagagtgtatttgagagaaactaccctaataaccccttttccagttttactttttggtggtgatatagaagttcagcaccgagaacgtcttctttctattgatggctggatctattttcaggcccctgtaaagatagctgtcattttcaagcagctgagagttctcattgattcagttttaagaaaaaagcttgaaaatccaaagatgtcccttgaaaatgacaagattctgcagatcattacggaattgataaaaacagagaataactgaaactgaaattcatggtcaactgctttaaaaattaagatgaagatacagtcatgaaattatctgaaaatgggtcatcacattaagtatttcattacttaaaatgttggtactagccattaacttaaaggtggtgggaaaaaagcacatactttaaacatgtataattttctagttcctttttaatgatgattattctgaatgtatttgccactacatttacaataaattctttggtattatgca

SEQ ID NO: 7924 - DNA, 2827 bp, Homo sapiens
aggcagagagcacgaggcccagtgcagaatcattttctgaaccagccaggaaataccggaacccaccaaactttaaacaccagcctaaattattcctgttcttttaagcaggcagcagaaatgacagaaacccgttaacagaaaaaaaaaaaataatgcttttcatttgaactcctgtgcattttctttttaacttatatgtgttcctaattttccttactctttttgtttgtttgtttcttagtgtggtttattgacaatcatttacaatgccgaagagtgctgtagtgagccagcacagtgggtaacacagcaacggagaacagatgcaggtttgaggaatttaacttgctaaaaccttgaactgaagtcttagagattggaacatacgggtttgtataaataggcttttaagccctgtttgcaatgggttactgataggagaaacttgcttgtggaatgtcagctgcgtgagctcactgtcagacaagatggaagaagaagggctggagtgtccaaactcttcctctgaaaaacgctattttcctgaatccctggattccagcgatggggatgaggaagaggttttggcctgtgaggatttggaacttaacccctttgatggattgccatattcatcacgttattataaacttctgaaagaaagagaagatcttcctatatggaaagaaaaatactcctttatggagaacctgcttcaaaatcaaatcgtgattgtttcaggagatgctaaatgtggtaagagcgctcaggttcctcagtggtgtgctgaatattgtctttccatccactaccagcacgggggcgtgatatgcacacaggtccacaagcagactgtggtccagctcgccctgcgggtggcggatgaaatggatgttaacattggtcatgaggttggctacgtgatccctttcgagaactgctgtaccaacgaaacaatcctgaggtattgtactgatgatatgctgcaaagagaaatgatgtccaatccttttttgggtagctatggggtcatcatcttagatgatattcatgaaagaagcattgcaactgatgtgttacttggacttcttaaagatgttttactagcaagaccagaactgaagctcataattaactcctcacctcacctgatcagcaaactcaattcttattatggaaacgtgcctgtcatagaagtgaaaaataaacaccctgtggaggttgtgtaccttagtgaggctcaaaaggattcttttgagtctattttacgccttatctttgaaattcaccactcgggtgagaaaggtgacattgtagtctttctggcctgtgaacaagtgtacaacccgagaataagagcaaactcgctcgtcatgcagcccatcagccagagccaggcagagatacgcaagcagattcttggctcatcttcttcaggaaaatttttctgcctgtacactgaagaatttgcctccaaagacatgacgccactgaagccagcagaaatgcaggaagccaacctaacaagcatggtgctttttatgaagaggatagacattgcgggcctaggccactgtgacttcatgaacagaccagcaccagaaagtttgatgcaggcattggaagacttagattatctggcagcactggataatgatggaaatctttctgaatttggaatcatcatgtcagagtttcctcttgatccacaactctcgaagtctatcttagcgtcctgtgaatttgactgtgtagatgaagtgctaacaatcgcagccatggtaacagctccaaattgcttttcacatgtgccacatggagctgaagaggctgccttgacttgttggaagacatttttacatcccgaaggagatcactttaccctcatcagcatttacaaggcttaccaagacacaactctgaattctagcagtgagtactgtgtggaaaagtggtgtcgtgattacttcctcaactgttcagcactcagaatggcagatgttattcgagctgaactcttagaaattatcaagcgaatcgagcttccctatgcagaacctgcttttggctccaaggaaaacactctaaacataaagaaagctcttctgtccggttactttatgcagattgctcgggatgttgatggatcaggtaactacttaatgctgacacataagcaggttgctcagctgcatcccctgtctggttactcaatcaccaagaagatgccagagtgggtcctcttccataaattcagcatttctgagaacaactacatcaggattacctcagaaatctctcctgaactatttatgcagctggtaccacaatactatttcagtaatctgcctcctagtgaaagtaaggacattctacagcaagtagtggatcacctatcccctgtgtcaacaatgaataaggaacagcaaatgtgtgagacgtgccctgaaactgaacagagatgcactctccagtgactccccagcaaacacaaggtgcagcagggtcccaaaggtagctggatggctgaactgctggatatgggagatacatgacgcgaagacggatttcacatccacaggacggtcttgaagaaaataacactgtgtatattattttaaaataaaaaatagaagtttttattgagttctttaaattactactccatgcttttcttcttcttggaaaagtttttaaatcaaccactcataatttgaccaaaattttaaaaaactggtattttgtaaatgtgtcagagacacatgggacagaaccctactttttgtagaggaacttaatctgaataaagtctgagtttttcagt

SEQ ID NO: 7925 - DNA, 3070 bp, Homo sapiens
aggcagagagcacgaggcccagtgcagaatcattttctgaaccagccaggaaataccggaacccaccaaactttaaacaccagcctaaattattcctgttcttttaagcaggcagcagaaatgacagaaacccgttaacagaaaaaaaaaaaataatgcttttcatttgaactcctgtgcattttctttttaacttatatgtgttcctaattttccttactctttttgtttgtttgtttcttagtgtggtttattgacaatcatttacaatgccgaagagtgctgtagtgagccagcacagtgggtaacacagcaacggagaacagatgcaggtttgaggaatttaacttgctaaaaccttgaactgaagtcttagagattggaacatacgggtttgtataaataggcttttaagccctgtttgcaatgggttactgataggagaaacttgcttgtggaatgtcagctgcgtgagctcactgtcagacaagatggaagaagaagggctggagtgtccaaactcttcctctgaaaaacgctattttcctgaatccctggattccagcgatggggatgaggaagaggttttggcctgtgaggatttggaacttaacccctttgatggattgccatattcatcacgttattataaacttctgaaagaaagagaagatcttcctatatggaaagaaaaatactcctttatggagaacctgcttcaaaatcaaatcgtgattgtttcaggagatgctaaatgtggtaagagcgctcaggttcctcagtggtgtgctgaatattgtctttccatccactaccagcacgggggcgtgatatgcacacaggtccacaagcagactgtggtccagctcgccctgcgggtggcggatgaaatggatgttaacattggtcatgaggttggctacgtgatccctttcgagaactgctgtaccaacgaaacaatcctgaggtattgtactgatgatatgctgcaaagagaaatgatgtccaatccttttttgggtagctatggggtcatcatcttagatgatattcatgaaagaagcattgcaactgatgtgttacttggacttcttaaagatgttttactagcaagaccagaactgaagctcataattaactcctcacctcacctgatcagcaaactcaattcttattatggaaacgtgcctgtcatagaagtgaaaaataaacaccctgtggaggttgtgtaccttagtgaggctcaaaaggattcttttgagtctattttacgccttatctttgaaattcaccactcgggtgagaaaggtgacattgtagtctttctggcctgtgaacaagatattgagaaagtctgtgaaactgtctatcaaggatctaacctaaacccagatcttggagaactggtggttgttcctttgtatccaaaagagaaatgttcattgttcaagccactcgatgaaacagaaaaaagatgccaagtttatcaaagaagagtggtgttaactactagctctggagagtttttgatctggagcaactcagtcagatttgttatcgatgtgggtgtggaaagaagaaaggtgtacaacccgagaataagagcaaactcgctcgtcatgcagcccatcagccagagccaggcagagatacgcaagcagattcttggctcatcttcttcaggaaaatttttctgcctgtacactgaagaatttgcctccaaagacatgacgccactgaagccagcagaaatgcaggaagccaacctaacaagcatggtgctttttatgaagaggatagacattgcgggcctaggccactgtgacttcatgaacagaccagcaccagaaagtttgatgcaggcattggaagacttagattatctggcagcactggataatgatggaaatctttctgaatttggaatcatcatgtcagagtttcctcttgatccacaactctcgaagtctatcttagcgtcctgtgaatttgactgtgtagatgaagtgctaacaatcgcagccatggtaacagctccaaattgcttttcacatgtgccacatggagctgaagaggctgccttgacttgttggaagacatttttacatcccgaaggagatcactttaccctcatcagcatttacaaggcttaccaagacacaactctgaattctagcagtgagtactgtgtggaaaagtggtgtcgtgattacttcctcaactgttcagcactcagaatggcagatgttattcgagctgaactcttagaaattatcaagcgaatcgagcttccctatgcagaacctgcttttggctccaaggaaaacactctaaacataaagaaagctcttctgtccggttactttatgcagattgctcgggatgttgatggatcaggtaactacttaatgctgacacataagcaggttgctcagctgcatcccctgtctggttactcaatcaccaagaagatgccagagtgggtcctcttccataaattcagcatttctgagaacaactacatcaggattacctcagaaatctctcctgaactatttatgcagctggtaccacaatactatttcagtaatctgcctcctagtgaaagtaaggacattctacagcaagtagtggatcacctatcccctgtgtcaacaatgaataaggaacagcaaatgtgtgagacgtgccctgaaactgaacagagatgcactctccagtgactccccagcaaacacaaggtgcagcagggtcccaaaggtagctggatggctgaactgctggatatgggagatacatgacgcgaagacggatttcacatccacaggacggtcttgaagaaaataacactgtgtatattattttaaaataaaaaatagaagtttttattgagttctttaaattactactccatgcttttcttcttcttggaaaagtttttaaatcaaccactcataatttgaccaaaattttaaaaaactggtattttgtaaatgtgtcagagacacatgggacagaaccctactttttgtagaggaacttaatctgaataaagtctgagtttttcagt

SEQ ID NO: 7926 - DNA, 2389 bp, Homo sapiens
gttctcattattccaattggcaagttttcactcattaggatcaacagccatgctgtttgcttggtaaaaaatctgccccaagtaattcaattatatgtggaaaaaggaagtgcaagcaagggaccgtacctgtgtaccagctgatgtgggaccccctggagcggcctctgcccagcttcctgggagccacttagcagaccaggaaacgagcacagctcacctagttctcagtgacctgtgataccttgctatttttctagatggatctgtcttcctacaaaacccttgagttaattcaatcccattctacaaatggtatggaaaggaaagagacataagctagagacctagagaatggaattgagctgtaaaaactatggcagttgtgggaagtcatcttttttacttagatttttagtgaaatctaacaaaattaaatgggaaaacaatataaattatatttaacttccccaaagacgttttctcatttaggtgcatctttacttatttaaagatacatgtaggcagcaacacagggatttctttccctgtatctgttacgtagtattgcctaaaattttttgtaattcagacatttttttaatagtgatgttgtttgcattgtattttattttcatgggtttttttttctttaggatattgagaaagtctgtgaaactgtctatcaaggatctaacctaaacccagatcttggagaactggtggttgttcctttgtatccaaaagagaaatgttcattgttcaagccactcgatgaaacagaaaaaagatgccaagtttatcaaagaagagtggtgttaactactagctctggagagtttttgatctggagcaactcagtcagatttgttatcgatgtgggtgtggaaagaagaaaggtgtacaacccgagaataagagcaaactcgctcgtcatgcagcccatcagccagagccaggcagagatacgcaagcagattcttggctcatcttcttcaggaaaatttttctgcctgtacactgaagaatttgcctccaaagacatgacgccactgaagccagcagaaatgcaggaagccaacctaacaagcatggtgctttttatgaagaggatagacattgcgggcctaggccactgtgacttcatgaacagaccagcaccagaaagtttgatgcaggcattggaagacttagattatctggcagcactggataatgatggaaatctttctgaatttggaatcatcatgtcagagtttcctcttgatccacaactctcgaagtctatcttagcgtcctgtgaatttgactgtgtagatgaagtgctaacaatcgcagccatggtaacagctccaaattgcttttcacatgtgccacatggagctgaagaggctgccttgacttgttggaagacatttttacatcccgaaggagatcactttaccctcatcagcatttacaaggcttaccaagacacaactctgaattctagcagtgagtactgtgtggaaaagtggtgtcgtgattacttcctcaactgttcagcactcagaatggcagatgttattcgagctgaactcttagaaattatcaagcgaatcgagcttccctatgcagaacctgcttttggctccaaggaaaacactctaaacataaagaaagctcttctgtccggttactttatgcagattgctcgggatgttgatggatcaggtaactacttaatgctgacacataagcaggttgctcagctgcatcccctgtctggttactcaatcaccaagaagatgccagagtgggtcctcttccataaattcagcatttctgagaacaactacatcaggattacctcagaaatctctcctgaactatttatgcagctggtaccacaatactatttcagtaatctgcctcctagtgaaagtaaggacattctacagcaagtagtggatcacctatcccctgtgtcaacaatgaataaggaacagcaaatgtgtgagacgtgccctgaaactgaacagagatgcactctccagtgactccccagcaaacacaaggtgcagcagggtcccaaaggtagctggatggctgaactgctggatatgggagatacatgacgcgaagacggatttcacatccacaggacggtcttgaagaaaataacactgtgtatattattttaaaataaaaaatagaagtttttattgagttctttaaattactactccatgcttttcttcttcttggaaaagtttttaaatcaaccactcataatttgaccaaaattttaaaaaactggtattttgtaaatgtgtcagagacacatgggacagaaccctactttttgtagaggaacttaatctgaataaagtctgagtttttcagtaaa

SEQ ID NO: 7927 - DNA, 803 bp, Homo sapiens
ggccaggtcaccggctgaggacactgctcctgaagcccggtcaggcggtcgcgccctccctggcggcccccgcggccccgcaggacctgtgccccgacgtcgccgacccgcggtccccgctgtcgccgacccgcggcgtccgtcgggcgagtgggcctgcccgcgggtaaggcgccggccctgggccgccctcccgggaatcgggagccgccgctgcagtgtggtttattgacaatcatttacaatgccgaagagtgctgtagtgagccagcacagtgggtaacacagcaacggagaacagatgcaggtttgaggaatttaacttgctaaaaccttgaactgaagtcttagagattggaacatacgggtttgtataaataggcttttaagccctgtttgcaatgggttactgataggagaaacttgcttgtggaatgtcagctgcgtgagctcactgtcagacaagatggaagaagaagggctggagtgtccaaactcttcctctgaaaaacgctattttcctgaatccctggattccagcgatggggatgaggaagaggttttggcctgtgaggatttggaacttaacccctttgatggattgccatattcatcacgttattataaacttctgaaagaaagagaagatcttcctatatggaaagaaaaatactcctttatggagaacctgcttcaaaatcaaatcgtgattgtttcaggagatgctaaatgtggtaagagcgctcaggttcctcagtggtgtgctgaatattgtctttccatccactaccagcacgggggcg

SEQ ID NO: 7928 - DNA, 5419 bp, Homo sapiens
acatgccggaggaggcgggcttcccgccggccaagagattccggccaggctctggacctccgagccgcgctgggtccttccctcccgggaggcaagtggtgatgctgctgactgcgggcagcggcggcagaggaggaggaggaggccggaggcagcagccgcccctggcccagccctcggccagtccctaccctgaagctgtggagctgcagcgccggagtctgcccatcttccaagcgcgggggcaactgttggcccagctccgaaacctggacaacgcggtcctcatcggggaaactggctctgggaagacaactcagatccctcagtacctgtatgaaggagggatcagccgccagggcatcattgctgtgacccagcctcgtcgagtagctgccatctctcttgctactagagtctcagatgagaagagaactgaacttgggaagctggttggctatacagtgcgctttgatgatgtcacctcagaagacaccaggatcaagtttctgacagatggcatgcttctgcgtgaagcaatttcagactctttgcttcggaaatacagctgtgtcattttggatgaagctcacgaacggactatccacacagatgtgctctttggagtggtgaaagctgcacagaagaggagaaaggaactcgggaaacttcctctgaaagtgattgtgatgtcagctacgatggatgtggacctgttctctcagtatttcaatggcgcccccgtcctctacctagagggtcggcagcatccgatccaggtgttttacaccaaacagcctcagaatgattacctgcacgccgcgcttgtctccgtcttccagatccaccaggaagccccttcttcacaggacatcctggtgttcctcactgggcaggaggagatcgaagccatgagcaagacgtgccgagacattgcaaagcacctcccagacggctgccctgcgatgctggtccttcctctgtacgcctccctgccctatgcacagcagctccgagtcttccaaggggccccaaagggctatcgcaaagtgatcatttcaaccaacatcgctgaaacctccataaccattacaggaataaaatatgtagttgacacgggcatggttaaagcaaagaagtataaccctgacagtggtcttgaggtgttagcagtgcagcgggtatcgaagacgcaggcttggcagcgcacagggagggctggcagagaggacagtggcatctgctaccggctctacacggaggacgagtttgagaagtttgataagatgaccgtgccagagatccagaggtgtaacctggccagtgtgatgcttcagcttctagcaatgaaagtcccaaatgtgctcacctttgacttcatgtcgaagccatctccagatcacattcaggcggccattgcccaactggacctgttaggtgctcttgaacataaggatgaccagcttaccctgactccaatgggaagaaagatggcagcatttcctttagaacccaaatttgccaaaaccatcctcatgtcccccaaattccactgtacagaggagatcctgaccattgtctccctgctgtctgtggacagcgtcctccacaaccctccttcccggcgagaggaagtgcaaggggtccgcaagaagttcatatccagcgagggggatcacatgaccctgctcaatatctatcggaccttcaaaaacctaggcggaaataaggattggtgcaaagagaattttgtcaacagcaagaatatgacgctggtagcagaagtcagagcacagctgagggacatctgcttaaagatgtcaatgccaatcgcatcatcccgaggagacgtggagagtgtccgccgctgcctggctcacagcctcttcatgagcaccgccgagcttcagccagatggcacctatgccaccacggacacccaccagccagtggccatccacccgtcgtctgtcctcttccactgcaagccggcctgcgtcgtgtacactgagctgctctacaccaacaagtgctacatgcgggacctctgcgtcatagatgcacagtggctgtacgaggctgcccctgagtactttaggaggaagctgagaaccgccagaaactgagccgccccaggatgccgccagaatcactggtccctgggagcttggactacagttgtccttacagcaggcttccaggttggcgcttagagaagccttggaatcagctgaaggtgcctgacttccaggagcgtgaaagcatctttgctcaactcctgggactgaaccatatagacatggacatatcatttgtacctggaaacctcaaaattatgcttttggttcttactgggtgactttgacttaatttaacacctgagcctcagttttctcatctgccaaatgggagtaataataataatccttataaaattgggttcataaagtttagagaaaaggaatggaaagtacccagaactatgcctggagcacgcacgacacacgtacagtgagttgggagccgttaggctgaatgttactgcttgccatatgatgtgaagtacagcaatatcccaagttcttgtgactgagggagattttctggaagggccacaggaggttgcggagcttggatgttgcccttagttcttgtttaatgtctctctgaatgcagttttaaaatagaaaacaaaactgacttctgtagaagtttccagagggaggtgctgttatctcgtacctcctgggatggcgatccctactgaacgcttgtgtctcagggtggaccactctgtgtctgtctccaagcagagaccagtaaaggagcctcctggtcctcagtgcgtgaccctgtcagtgctttcaggagacatgtaagcttcctgggtgaaggttgatttgtaccttctgaatcctgtcacgtgtagacatgggaaactgacctatcagtgttttgtgtgtgtaggtgactcccacatacacagttgccatttttctctctaactgggcaccagtgaacatgcgggcatgaggagtgactgtgtaccatttcagctgtttcttttcgggcagtcccctggtcagagggggtgggggtgggggaggggagaggggtacctagaacccagagaacattggcttatgccagataccacaccacatctgggcttacattcttgtatcttttttggtgtgtgggcggggggggtggggggcagttcagtgaagtctagaagacctgctggacaaattctaaaagagctagagctgtaacacttattcttgcatcttattaattttctatgatattttttccttcttcgtagggacttgggacaatctggctttgctgctttctaactgctaggcacctctctctaaccctcattgtcagagggaattggaggatatccacagtctgttcctgttctgatattctgagcagagaaaaggcactaacggttcctcttagctatttaattatcagaagcaagtaatctttccccagataatattttgccctagaagaagccgtgatttagctcttttattgtgcttacttggtccaaatacatctgtggggtgttttgtcatttcttaatgaatgaatcatagttataaccaggggccaagctgcccaagaggctcttcagagatcatggatgctctctttctggaagctgtggcctgatggagcagccccattccagggtcccatctgtccggagttgtgtatgtcaagtccggctcagtctttatttccaacactagccgtggtcctgtgcagtcaagctctcagctagtgtttagggctgtctgtcagaaatggttatacgtgggcaaaagaagatctgacagctcctatataccttatcttactgaattcttaaactttgaaccagttcttccacttactgacttgttaccactgctgactttctgaaaagttttccagtttttgttttttgttttttgttttccagtaggggattagaatgtttagtcctacttagtaagaaaaatattgtatttttaatcattcatagtgctggtaaaaaaaaaaaaaaaaaaaaaaaaattggggggtggccgggcgcagtggctcacacctgtaatcccagcactttgggaggccaaggcgggcggatcacctcatgcctgtaatcccagcattgggatgggaggctgaggtgggtggattgcttgagaagttcaagaccagcctggccaacatggcaaaaccccgtctctactaaaaatagaaaacttagctgggcatggtggcacacgcctgtaatcccagctaccggggaggctgaggcacaagaattgcttgaacttgggaggcagagtttgtagtgagccaagatcacgccactgcattccagcctggccgacagtgtgagacggtctcagaaaaaaaaagaaagaaagaaagaaaaagaaaaaacttggggtaatttatgtccagcttaagtacctgaacagtttccggaaatgtatattttttttctgagaggcaaaggatgtaaacagcttctaagtagctttaatgtttctgtacagaaataagtttatccctgtaacattgtggtagagttttaatacagtatttagttttttattgggcttttttaaaaagttaacttttaacatagctgctcagggattaaatcagattggaaaacccattctgactccacatactgctacaaagaaatacatcgttgtttatattgagctgcaggagatagtacactttaaacttaagaaagttaaatgtttcacaataacattgcaatataatcttcagctactctctttccattggtaaaatctctgatggtgtgataactctttgccaacctacgaaacccatatctggaagaatcaccagctcccgtgagcagcttcatgtaaatagatgcactccaagcagattgcatgcctcaggtgtttgtcttctagtaatcatggagtgtgcaacacccagagtaacactacaaggggcaggactgcaaacagcaggtcctggctaaaaacccttaatgctgcattgctgccagttgtaaagagatgcctgaatggaggcaagttctgccctgtgggtgaaactgatgatgtactgtactgtcatatataaatccactaaatccagctaccaggaactgcctggaactgtggccatgcatttttttttttctttaaagaccagtgtgatagtaggccatgcatctgagatacgatattccttggtaactagagggagaaaaaaaaatcaagtaggttcaggcttatgttgtattttgagagtctggttttatttgaacagaaataactctacagaaagctcttgtaaataatgctcaaatttgcacccgacgatcaaatccattaaaaatgaatcttgtatatga

SEQ ID NO: 7929 - DNA, 2224 bp, Homo sapiens
ctgagagggggcaggagctctcggcgcttgcgcctcccgccgcggtgccctcccgacatgccggaggaggcgggcttcccgccggccaagagattccggccaggctctggacctccgagccgcgctgggtccttccctcccgggaggcaagtggtgatgctgctgactgcgggcagcggcggcagaggaggaggaggaggccggaggcagcagccgcccctggcccagccctcggccagtccctaccctgaagctgtggagctgcagcgccggagtctgcccatcttccaagcgcgggggcaactgttggcccagctccgaaacctggacaacgcggtcctcatcggaagccccttcttcacaggacatcctggtgttcctcactgggcaggaggagatcgaagccatgagcaagacgtgccgagacattgcaaagcacctcccagacggctgccctgcgatgctggtccttcctctgtacgcctccctgccctatgcacagcagctccgagtcttccaaggggccccaaagacagtggtcttgaggtgttagcagtgcagcgggtatcgaagacgcaggcttggcagcgcacagggagggctggcagagaggacagtggcatctgctaccggctctacacggaggacgagtttgagaagtttgataagatgaccgtgccagagatccagaggtgtaacctggccagtgtgatgcttcagcttctagcaatgaaagtcccaaatgtgctcacctttgacttcatgtcgaagccatctccagatcacattcaggcggccattgcccaactggacctgttaggtgctcttgaacataaggatgaccagcttaccctgactccaatgggaagaaagatggcagcatttcctttagaacccaaatttgccaaaaccatcctcatgtcccccaaattccactgtacagaggagatcctgaccattgtctccctgctgtctgtggacagcgtcctccacaaccctccttcccggcgagaggaagtgcaaggggtccgcaagaagttcatatccagcgagggggatcacatgaccctgctcaatatctatcggaccttcaaaaacctaggcggaaataaggattggtgcaaagagaattttgtcaacagcaagaatatgacgctggtagcagaagtcagagcacagctgagggacatctgcttaaagatgtcaatgccaatcgcatcatcccgaggagacgtggagagtgtccgccgctgcctggctcacagcctcttcatgagcaccgccgagcttcagccagatggcacctatgccaccacggacacccaccagccagtggccatccacccgtcgtctgtcctcttccactgcaagccggcctgcgtcgtgtacactgagctgctctacaccaacaagtgctacatgcgggacctctgcgtcatagatgcacagtggctgtacgaggctgcccctgagtactttaggaggaagctgagaaccgccagaaactgagccgccccaggatgccgccagaatcactggtccctgggagcttggactacagttgtccttacagcaggcttccaggttggcgcttagagaagccttggaatcagctgaaggtgcctgacttccaggagcgtgaaagcatctttgctcaactcctgggactgaaccatatagacatggacatatcatttgtacctggaaacctcaaaattatgcttttggttcttactgggtgactttgacttaatttaacacctgagcctcagttttctcatctgccaaatgggagtaataataataatccttataaaattgggttcataaagtttagagaaaaggaatggaaagtacccagaactatgcctggagcacgcacgacacacgtacagtgagttgggagccgttaggctgaatgttactgcttgccatatgatgtgaagtacagcaatatcccaagttcttgtgactgagggagattttctggaagggccacaggaggttgcggagcttggatgttgcccttagttcttgtttaatgtctctctgaatgcagttttaaaatagaaaacaaaactgacttctgtagaagtttccagagggaggtgctgttatctcgtacctcctgggatggcgatccctactgaacgcttgtgtctcagggtggaccactctgtgtctgtctccaagcagagaccagtaaaggagcctcctggtcctc

SEQ ID NO: 7930 - DNA, 3487 bp, Homo sapiens
ttccagcggttgctggttctgacgggttgtagtctgccaggacaatgagttatgactaccatcagaactggggccgtgatgggggtccccgcagctccggtgggggctatggaggggggccagcagggggtcatggaggtaaccgaggctccggaggaggcggcggcggcggagggggtggtcgaggcggcaggggccggcatcccgggcacctgaaaggccgcgaaatcggcatgtggtacgcgaaaaaacaggggcagaagaacaaggaagcggagaggcaagagagagctgtagtacacatggatgaacgacgagaagaacaaattgtacagttactgaattctgttcaagcgaagaatgataaagagtcagaagcacagatatcctggtttgctcctgaggatcatggatacggtactgaagtttctactaagaacacaccatgctcagagaacaaacttgacatccaggaaaagaagttgataaatcaagaaaaaaaaatgtttagaatcaggaacagatcatatattgaccgagattctgagtatctcttgcaagaaaatgaaccagatggaactttagaccaaaaattattggaagatttacaaaagaaaaaaaatgaccttcggtatattgaaatgcagcatttcagagaaaagctgccttcgtatggaatgcaaaaggaattggtaaatttaattgataaccatcaggtaacagtaataagtggtgaaactggttgtggcaaaaccactcaagttactcagttcattttggataactacattgaaagaggaaaaggatctgcttgcagaatagtttgtactcagccaagaagaattagtgccatttcagttgcggaaagagtagctgcagaaagggcagaatcttgtggcagtggtaatagtactggatatcaaattcgtctccagagtcggttgccaaggaaacagggttctatcttatactgtacaacaggaatcatccttcagtggctccagtcagacccgtatttgtccagtgttagtcatatcgtacttgatgaaatccatgaaagaaatctgcagtcagatgttttaatgactgttgttaaagaccttctcaattttcgatctgacttgaaagtaatattgatgagtgcaacattgaatgcagaaaagttttcagaatattttggtaactgtccaatgatacatatacctggttttacctttccggttgtggaatatcttttggaagatgtaattgaaaaaataaggtatgttccagaacaaaaagaacacagatcccagtttaagaggggtttcatgcaagggcatgtaaatagacaagaaaaagaagaaaaagaagcaatatataaagaacgttggccagattatgtaagggaactgcgaagaaggtattctgcaagtactgtagatgttatagaaatgatggaggatgataaagttgatctgaatttgattgttgccctcatccgatacattgttttggaagaagaggatggtgcgatactggtctttctgccaggctgggacaatatcagcactttacatgatctcttgatgtcacaagtaatgtttaaatcagataaatttttaattatacctttacattcactgatgcctacagttaaccagacacaggtgtttaaaagaacccctcctggtgttcggaaaatagtaattgctaccaacattgcggagactagcattaccatagatgatgtcgtttatgtgatagatggaggaaaaataaaagagacgcattttgatactcagaacaatatcagtacaatgtccgctgagtgggttagtaaagctaatgccaaacagagaaaaggtcgagctggaagagttcaacctggtcattgctatcatctgtataatggtcttagagcaagtcttctagatgactatcaactgccagaaattttgagaactcctttggaagaactttgtttacaaataaagattttaaggctaggtggaattgcttattttctgagtagattaatggacccaccatcaaatgaggcagtgttactctccataagacacctgatggagctgaacgctttggataaacaagaagaattgacacctcttggagtccacttggcacgattacccgttgagccacatattggaaaaatgattctttttggagcactgttctgctgcttagacccagtactcactattgctgctagtctcagtttcaaagatccatttgtcattccactgggctgggaagaggctaggcgacgtggtttcagatacgaaaaggactattgctgggaatattttctgtcttcaaacacactgcagatgctgcataacatgaaaggacagtttgctgagcatcttcttggagctggatttgtaagcagtagaaatcctaaagatccagaatctaatataaattcagataatgagaagataattaaagctgtcatctgtgctggtttatatcccaaagttgctaaaattcgactaaatttgggtaaaaaaagaaaaatggtaaaagtttacacaaaaaccgatggcctggttgctgttcatcctaaatctgttaatgtggagcaaacagactttcactacaactggcttatctatcacctaaagatgagaacaagcagtatatacttgtatgactgcacagaggtttccccatactgtctcttgttttttggaggtgacatttccatccagaaggataacgatcaggaaactattgctgtagatgagtggattgtatttcagtctccagcaagaattgcccatcttgttaaggaattaagaaaggaactagatattcttctgcaagagaagattgaaagtcctcatcctgtagactggaatgacactaaatccagagactgtgcagtactgtcagctattatagacttgatcaaaacacaggaaaaggcaactcccaggaactttccgccacgattccaggatggatattacagctgacagcttttcaggggtggtctgaaaagccagtttgacagccattcttcatcattgtttaaattttggctggatgccaaaccctgggacatgaacaattttcatgtgtaaggtagaagccttcagtaggtagtaaagacttaatgtgcatgacttgatgttatatgtagagatatatatatatatatatatataccataaaagcaatatgttctctgatcatatactctgctgtggtcatgcccactctttgggagtatattccctttatatatattgagtattgtaccacttgagaaattcctttgttctgttatacaaaattaatctttctgctcataatgattgatgataccaccagtaaaaataggatgtttaccccaaaacaagtgtcaattaagaatttgaacacaaccacattttttaaaatgaaacttctatcggaagtaaattaatttgttgtaataaagtccagtatttaataaaatgtacaatgttaaatctca

SEQ ID NO: 7931 - DNA, 2985 bp, Homo sapiens
atgagttatgactaccatcagaactggggccgtgatgggggtccccgcagctccggtgggggctatggaggggggccagcagggggtcatggaggtaaccgaggctccggaggaggcggcggcggcggagggggtggtcgaggcggcaggggccggcatcccgggcacctgaaaggccgcgaaatcggcatgtggtacgcgaaaaaacaggggcagaagaacaaggaagcggagaggcaagagagagctgtagtacacatggatgaacgacgagaagaacaaattgtacagttactgaattctgttcaagcgaagaatgataaagagtcagaagcacagatatcctggtttgctcctgaggatcatggatacggtactgaagtttctactaagaacacaccatgctcagagaacaaacttgacatccaggaaaagaagttgataaatcaagaaaaaaaaatgtttagaatcaggaacagatcatatattgaccgagattctgagtatctcttgcaagaaaatgaaccagatggaactttagaccaaaaattattggaagatttacaaaagaaaaaaaatgaccttcggtatattgaaatgcagcatttcagagaaaagctgccttcgtatggaatgcaaaaggaattggtaaatttaattgataaccatcaggtaacagtaataagtggtgaaactggttgtggcaaaaccactcaagttactcagttcattttggataactacattgaaagaggaaaaggatctgcttgcagaatagtttgtactcagccaagaagaattagtgccatttcagttgcggaaagagtagctgcagaaagggcagaatcttgtggcagtggtaatagtactggatatcaaattcgtctccagagtcggttgccaaggaaacagggttctatcttatactgtacaacaggaatcatccttcagtggctccagtcagacccgtatttgtccagtgttagtcatatcgtacttgatgaaatccatgaaagaaatctgcagtcagatgttttaatgactgttgttaaagaccttctcaattttcgatctgacttgaaagtaatattgatgagtgcaacattgaatgcagaaaagttttcagaatattttggtaactgtccaatgatacatatacctggttttacctttccggttgtggaatatcttttggaagatgtaattgaaaaaataaggtatgttccagaacaaaaagaacacagatcccagtttaagaggggtttcatgcaagggcatgtaaatagacaagaaaaagaagaaaaagaagcaatatataaagaacgttggccagattatgtaagggaactgcgaagaaggtattctgcaagtactgtagatgttatagaaatgatggaggatgataaagttgatctgaatttgattgttgccctcatccgatacattgttttggaagaagaggatggtgcgatactggtctttctgccaggctgggacaatatcagcactttacatgatctcttgatgtcacaagtaatgtttaaatcagttaaccagacacaggtgtttaaaagaacccctcctggtgttcggaaaatagtaattgctaccaacattgcggagactagcattaccatagatgatgtcgtttatgtgatagatggaggaaaaataaaagagacgcattttgatactcagaacaatatcagtacaatgtccgctgagtgggttagtaaagctaatgccaaacagagaaaaggtcgagctggaagagttcaacctggtcattgctatcatctgtataatggtcttagagcaagtcttctagatgactatcaactgccagaaattttgagaactcctttggaagaactttgtttacaaataaagattttaaggctaggtggaattgcttattttctgagtagattaatggacccaccatcaaatgaggcagtgttactctccataagacacctgatggagctgaacgctttggataaacaagaagaattgacacctcttggagtccacttggcacgattacccgttgagccacatattggaaaaatgattctttttggagcactgttctgctgcttagacccagtactcactattgctgctagtctcagtttcaaagatccatttgtcattccactgggaaaagaaaagattgcagatgcaagaagaaaggaattggcaaaggatactagaagtgatcacttaacagttgtgaatgcgtttgagggctgggaagaggctaggcgacgtggtttcagatacgaaaaggactattgctgggaatattttctgtcttcaaacacactgcagatgctgcataacatgaaaggacagtttgctgagcatcttcttggagctggatttgtaagcagtagaaatcctaaagatccagaatctaatataaattcagataatgagaagataattaaagctgtcatctgtgctggtttatatcccaaagttgctaaaattcgactaaatttgggtaaaaaaagaaaaatggtaaaagtttacacaaaaaccgatggcctggttgctgttcatcctaaatctgttaatgtggagcaaacagactttcactacaactggcttatctatcacctaaagatgagaacaagcagtatatacttgtatgactgcacagaggtttccccatactgtctcttgttttttggaggtgacatttccatccagaaggataacgatcaggaaactattgctgtagatgagtggattgtatttcagtctccagcaagaattgcccatcttgttaaggaattaagaaaggaactagatattcttctgcaagagaagattgaaagtcctcatcctgtagactggaatgacactaaatccagagactgtgcagtactgtcagctattatagacttgatcaaaacacaggaaaaggcaactcccaggaactttccgccacgattccaggatggatattacagctga

SEQ ID NO: 7932 - DNA, 6733 bp, Homo sapiens
aagtgggcgcacagtggcttccgggcccggacgccatttccagcggttgctggttctgacgggttgtagtctgccaggacaatgagttatgactaccatcagaactggggccgtgatgggggtccccgcagctccggtgggggctatggaggggggccagcagggggtcatggaggtaaccgaggctccggaggaggcggcggcggcggagggggtggtcgaggcggcaggggccggcatcccgggcacctgaaaggccgcgaaatcggcatgtggtacgcgaaaaaacaggggcagaagaacaaggaagcggagaggcaagagagagctgtagtacacatggatgaacgacgagaagaacaaattgtacagttactgaattctgttcaagcgaagaatgataaagagtcagaagcacagatatcctggtttgctcctgaggatcatggatacggtactgaagtttctactaagaacacaccatgctcagagaacaaacttgacatccaggaaaagaagttgataaatcaagaaaaaaaaatgtttagaatcaggaacagatcatatattgaccgagattctgagtatctcttgcaagaaaatgaaccagatggaactttagaccaaaaattattggaagatttacaaaagaaaaaaaatgaccttcggtatattgaaatgcagcatttcagagaaaagctgccttcgtatggaatgcaaaaggaattggtaaatttaattgataaccatcaggtaacagtaataagtggtgaaactggttgtggcaaaaccactcaagttactcagttcattttggataactacattgaaagaggaaaaggatctgcttgcagaatagtttgtactcagccaagaagaattagtgccatttcagttgcggaaagagtagctgcagaaagggcagaatcttgtggcagtggtaatagtactggatatcaaattcgtctccagagtcggttgccaaggaaacagggttctatcttatactgtacaacaggaatcatccttcagtggctccagtcagacccgtatttgtccagtgttagtcatatcgtacttgatgaaatccatgaaagaaatctgcagtcagatgttttaatgactgttgttaaagaccttctcaattttcgatctgacttgaaagtaatattgatgagtgcaacattgaatgcagaaaagttttcagaatattttggtaactgtccaatgatacatatacctggttttacctttccggttgtggaatatcttttggaagatgtaattgaaaaaataaggtatgttccagaacaaaaagaacacagatcccagtttaagaggggtttcatgcaagggcatgtaaatagacaagaaaaagaagaaaaagaagcaatatataaagaacgttggccagattatgtaagggaactgcgaagaaggtattctgcaagtactgtagatgttatagaaatgatggaggatgataaagttgatctgaatttgattgttgccctcatccgatacattgttttggaagaagaggatggtgcgatactggtctttctgccaggctgggacaatatcagcactttacatgatctcttgatgtcacaagtaatgtttaaatcagataaatttttaattatacctttacattcactgatgcctacagttaaccagacacaggtgtttaaaagaacccctcctggtgttcggaaaatagtaattgctaccaacattgcggagactagcattaccatagatgatgtcgtttatgtgatagatggaggaaaaataaaagagacgcattttgatactcagaacaatatcagtacaatgtccgctgagtgggttagtaaagctaatgccaaacagagaaaaggtcgagctggaagagttcaacctggtcattgctatcatctgtataatggtcttagagcaagtcttctagatgactatcaactgccagaaattttgagaactcctttggaagaactttgtttacaaataaagattttaaggctaggtggaattgcttattttctgagtagattaatggacccaccatcaaatgaggcagtgttactctccataagacacctgatggagctgaacgctttggataaacaagaagaattgacacctcttggagtccacttggcacgattacccgttgagccacatattggaaaaatgattctttttggagcactgttctgctgcttagacccagtactcactattgctgctagtctcagtttcaaagatccatttgtcattccactgggaaaagaaaagattgcagatgcaagaagaaaggaattggcaaaggatactagaagtgatcacttaacagttgtgaatgcgtttgagggctgggaagaggctaggcgacgtggtttcagatacgaaaaggactattgctgggaatattttctgtcttcaaacacactgcagatgctgcataacatgaaaggacagtttgctgagcatcttcttggagctggatttgtaagcagtagaaatcctaaagatccagaatctaatataaattcagataatgagaagataattaaagctgtcatctgtgctggtttatatcccaaagttgctaaaattcgactaaatttgggtaaaaaaagaaaaatggtaaaagtttacacaaaaaccgatggcctggttgctgttcatcctaaatctgttaatgtggagcaaacagactttcactacaactggcttatctatcacctaaagatgagaacaagcagtatatacttgtatgactgcacagaggtttccccatactgtctcttgttttttggaggtgacatttccatccagaaggataacgatcaggaaactattgctgtagatgagtggattgtatttcagtctccagcaagaattgcccatcttgttaaggaattaagaaaggaactagatattcttctgcaagagaagattgaaagtcctcatcctgtagactggaatgacactaaatccagagactgtgcagtactgtcagctattatagacttgatcaaaacacaggaaaaggcaactcccaggaactttccgccacgattccaggatggatattacagctgacagcttttcaggggtggtctgaaaagccagtttgacagccattcttcatcattgtttaaattttggctggatgccaaaccctgggacatgaacaattttcatgtgtaaggtagaagccttcagtaggtagtaaagacttaatgtgcatgacttgatgttatatgtagagatatatatatatatatatatataccataaaagcaatatgttctctgatcatatactctgctgtggtcatgcccactctttgggagtatattccctttatatatattgagtattgtaccacttgagaaattcctttgttctgttatacaaaattaatctttctgctcataatgattgatgataccaccagtaaaaataggatgtttaccccaaaacaagtgtcaattaagaatttgaacacaaccacattttttaaaatgaaacttctatcggaagtaaattaatttgttgtaataaagtccagtatttaataaaatgtacaatgttaaatctcagccaacctcttggattggtttctacattttcacctatggcttggttcatttgatatttttactatttttaaaacacgtgccctttttatatcaccctgtgcctcataatacagcaattgagagcacggtctggagcctgattacctcagttccagtctcagctctgtcagttagtcagtgtcttggcttctctcctttttccttatcttgtaagatacagttggcccttcatatccatgcattccacatctgtggattcaaacaactgtggatagaagatatttggggaaaaaaaggatggttgtgtctatactgaacatgtgcagacttttttccttgtcattccctaaacaatacagtttaacagctatttatatagtatttacattgtattaggtattataaataatctagagatgacttaaagaatatgggaggttgtgcctaggtaacatgcaaatactacgccattttattataaaagacttgagcatccatggatttaggtatttgaggggttggggttggaaaccagtcccccacagatactgagggacaactgtacatgtaacagttgtgaggatgaagtacattaatacatgtaaagcacataggctagtgcctgtactctctgaatcttagttgttatttgtccctgaaatattttcgtaaatgtctaacaatctattatattacactttttattttattgctacttatcttcttcgccaaggaatagtgtaacaacacatgctgtacattttcagccctatcagattgtgataaatactgttggttgccggccagcaactattttgtccctcccttcttgcttgcttattctggtgttcccttctgtgcagctctgtgtccaggtatgttggaccctttccctaagggtgaatcctgctgttctaaatgaatcacatgtggtcttatcccccttataagtaattgataaggcatgagtacataaacatgtcctagtgaatggcagctgagaagtgatcttcaagggggtgtctgaaaaatgttttactcactaataggcttagaggaggaaatcctgctctctctggacattgtcttttctgactctgatagttggaactgctgcagccaactaatgatcacaaggagacacggactcagactgaggttagctcagtggaaagatagaactcaccagagcctttgataatgccggtaagcttcagaattaacccattctagagctgctttacatgtggacttatgttgatataataaaaacccttcaattgtttaagccacttttaataggatattgttagttttttgttggttttttgttttgttttgttttgttttttgttttttggagacagtgtcttgccctgtcacccaggctggagtgcagtggtgtgatcttggttcactgcagcctcgacttcctgggttcaagtgatccttctgcctcagcctcccaaatagctgggactataggcatgcatcaccacacccagctaatttctgtattttttgtagagacaccgtttcaccatgttgcccaggctggtctcaaaactcctgtgctcaagcagtctgcccgccttggcttcccaaagtgctgacattacaggtatgagccactgcacccggtccctagtagggtatttttaacttggcaaaaagggtattaatcagaaacatacactatccatcactgagtattatactcttgattttgcaatgtaagagttttaacctatttgtctgacagaaggtgtaaaagtgctggacatgctgcagaaagaaacaggaaaagcatcttgctgcactccaaagaatgcaaattttaatgtgccttccaataaatgcaaggaaaccgaaagagttaatagtatcatacaatgactgggatgtattgataatgctacagtgatccattaacagcacttgttcaggtactgctcccaatcctgggaatgtgtgttacctgttatgtctcaaatcctttatcttggctgttcttctaaaagtgatctgtctgtcattgaatgctggcattagagtcatgtcacaatattagagcatactggttttgcctctaacgtcgaggtgaccatctggtctttcttgctctgtaagagtttctgtttgtgcttttttttcccttacttttattatccagtttaaatccagtcagttggccaaaatggtcttggaagaaaggatttagagattctgtaaaaaagattattagttggttctgtgtttgcaaaccagtatgtaattcccatatgaatggggaaaatgttcctgaggaattatttaattgatgaggcattcacagagattaaagcagttattgttacctccaatttatgtcttctgcacagctgattaggttggacattttaatccaaggtgctacttacattctgtttcttttgtttacaaaatagggcattactgagtagaaaatacattccaggtctaagaactgtttgttctttagtggattttaaagaataagacattaaattaagaaggaaaatctgtttgattcatcattttgagtaatgcagagaataactcttaaaaaaaaaacctgaaacagaaactttcaggaaaaaaacaaaagaaattaaactactgaataatctttcaaaagcatcgttgaacagtgagcacatgtgatgccttcccaattaattaatttgggcaaaagctctagataaacttacaccaattgttgcaaggcattctctattactgcatttttaaaacaaagtcctcccctaaaagttatgaattatacaaaagctttaggaggaattttagtactcctttacccaaaataaatagtggtaaatttccttctgttcttagctctgagtttgtatttatttataagtcattgtgatcatgtatacttatatatttttaatatgctaattgcttttaaatgggatttttgttctgattttaaaataatacatcctccctggacaatatttggaaatgtagcaaagtaaatcatgttaccattgttccattttgatatatataaactttaggtattattttatatataataaattttaagatattatatacaataaaattaaccaatttaa

SEQ ID NO: 7933 - DNA, 3568 bp, Homo sapiens
aagtgggcgcacagtggcttccgggcccggacgccatttccagcggttgctggttctgacgggttgtagtctgccaggacaatgagttatgactaccatcagaactggggccgtgatgggggtccccgcagctccggtgggggctatggaggggggccagcagggggtcatggaggtaaccgaggctccggaggaggcggcggcggcggagggggtggtcgaggcggcaggggccggcatcccgggcacctgaaaggccgcgaaatcggcatgtggtacgcgaaaaaacaggggcagaagaacaaggaagcggagaggcaagagagagctgtagtacacatggatgaacgacgagaagaacaaattgtacagttactgaattctgttcaagcgaagaatgataaagagtcagaagcacagatatcctggtttgctcctgaggatcatggatacggtactgaagtttctactaagaacacaccatgctcagagaacaaacttgacatccaggaaaagaagttgataaatcaagaaaaaaaaatgtttagaatcaggaacagatcatatattgaccgagattctgagtatctcttgcaagaaaatgaaccagatggaactttagaccaaaaattattggaagatttacaaaagaaaaaaaatgaccttcggtatattgaaatgcagcatttcagagaaaagctgccttcgtatggaatgcaaaaggaattggtaaatttaattgataaccatcaggtaacagtaataagtggtgaaactggttgtggcaaaaccactcaagttactcagttcattttggataactacattgaaagaggaaaaggatctgcttgcagaatagtttgtactcagccaagaagaattagtgccatttcagttgcggaaagagtagctgcagaaagggcagaatcttgtggcagtggtaatagtactggatatcaaattcgtctccagagtcggttgccaaggaaacagggttctatcttatactgtacaacaggaatcatccttcagtggctccagtcagacccgtatttgtccagtgttagtcatatcgtacttgatgaaatccatgaaagaaatctgcagtcagatgttttaatgactgttgttaaagaccttctcaattttcgatctgacttgaaagtaatattgatgagtgcaacattgaatgcagaaaagttttcagaatattttggtaactgtccaatgatacatatacctggttttacctttccggttgtggaatatcttttggaagatgtaattgaaaaaataaggtatgttccagaacaaaaagaacacagatcccagtttaagaggggtttcatgcaagggcatgtaaatagacaagaaaaagaagaaaaagaagcaatatataaagaacgttggccagattatgtaagggaactgcgaagaaggtattctgcaagtactgtagatgttatagaaatgatggaggatgataaagttgatctgaatttgattgttgccctcatccgatacattgttttggaagaagaggatggtgcgatactggtctttctgccaggctgggacaatatcagcactttacatgatctcttgatgtcacaagtaatgtttaaatcaggtactatgtcacaggtgtttaaaagaacccctcctggtgttcggaaaatagtaattgctaccaacattgcggagactagcattaccatagatgatgtcgtttatgtgatagatggaggaaaaataaaagagacgcattttgatactcagaacaatatcagtacaatgtccgctgagtgggttagtaaagctaatgccaaacagagaaaaggtcgagctggaagagttcaacctggtcattgctatcatctgtataatggtcttagagcaagtcttctagatgactatcaactgccagaaattttgagaactcctttggaagaactttgtttacaaataaagattttaaggctaggtggaattgcttattttctgagtagattaatggacccaccatcaaatgaggcagtgttactctccataagacacctgatggagctgaacgctttggataaacaagaagaattgacacctcttggagtccacttggcacgattacccgttgagccacatattggaaaaatgattctttttggagcactgttctgctgcttagacccagtactcactattgctgctagtctcagtttcaaagatccatttgtcattccactgggaaaagaaaagattgcagatgcaagaagaaaggaattggcaaaggatactagaagtgatcacttaacagttgtgaatgcgtttgagggctgggaagaggctaggcgacgtggtttcagatacgaaaaggactattgctgggaatattttctgtcttcaaacacactgcagatgctgcataacatgaaaggacagtttgctgagcatcttcttggagctggatttgtaagcagtagaaatcctaaagatccagaatctaatataaattcagataatgagaagataattaaagctgtcatctgtgctggtttatatcccaaagttgctaaaattcgactaaatttgggtaaaaaaagaaaaatggtaaaagtttacacaaaaaccgatggcctggttgctgttcatcctaaatctgttaatgtggagcaaacagactttcactacaactggcttatctatcacctaaagatgagaacaagcagtatatacttgtatgactgcacagaggtttccccatactgtctcttgttttttggaggtgacatttccatccagaaggataacgatcaggaaactattgctgtagatgagtggattgtatttcagtctccagcaagaattgcccatcttgttaaggaattaagaaaggaactagatattcttctgcaagagaagattgaaagtcctcatcctgtagactggaatgacactaaatccagagactgtgcagtactgtcagctattatagacttgatcaaaacacaggaaaaggcaactcccaggaactttccgccacgattccaggatggatattacagctgacagcttttcaggggtggtctgaaaagccagtttgacagccattcttcatcattgtttaaattttggctggatgccaaaccctgggacatgaacaattttcatgtgtaaggtagaagccttcagtaggtagtaaagacttaatgtgcatgacttgatgttatatgtagagatatatatatatatatatatataccataaaagcaatatgttctctgatcatatactctgctgtggtcatgcccactctttgggagtatattccctttatatatattgagtattgtaccacttgagaaattcctttgttctgttatacaaaattaatctttctgctcataatgattgatgataccaccagtaaaaataggatgtttaccccaaaacaagtgtcaattaagaatttgaacacaaccacattttttaaaatgaaacttctatcggaagtaaattaatttgttgtaataaagtccagtatttaataaaatgtacaatgttaaatctc

SEQ ID NO: 7934 - DNA, 4454 bp, Homo sapiens
cttttcctgcccccagactagaggcgggatgtagtctcttaggctaagagtgattggtcacaaggagactcggaagtgtctgatcagagccccagaggaggccttgagagcctgttggcgtaccgttccacacttggatccaggaatcgggcgtgttccaggctgctctctatggtagctttgggcggatagagggggcgcgcaaagtattaagggacaataatggccgctttcaaggtgtggattttggctccttgagcctgtctgagcgaggggtggcagcgccggcgccccagaatccgggacagaagggtcccaagagtcgcgcttggtgagagaaatcccagatcctgtgatgggggacaccagtgaggatgcctcgatccatcgattggaaggcactgatctggactgtcaggttggtggtcttatttgcaagtccaaaagtgcggccagcgagcagcatgtcttcaaggctcctgctccccgcccttcattactcggactggacttgctggcttccctgaaacggagagagcgagaggagaaggacgatggggaggacaagaagaagtccaaagtctcctcctacaaggactgggaagagagcaaggatgaccagaaggatgctgaggaagagggcggtgaccaggctggccaaaatatccggaaagacagacattatcggtctgctcgggtagagactccatcccatccgggtggtgtgagcgaagagttttgggaacgcagtcggcagagagagcgggagcggcgggaacatggtgtctatgcctcgtccaaagaagaaaaggattggaagaaggagaaatcgcgggatcgagactatgaccgcaagagggacagagatgagcgggatagaagtaggcacagcagcagatcagagcgagatggagggtcagagcgtagcagcagaagaaatgaacccgagagcccacgacatcgacctaaagatgcagccaccccttcaaggtctacctgggaggaagaggacagtggctatggctcctcaaggcgctcacagtgggaatcgccctccccgacgccttcctatcgggattctgagcggagccatcggctgtccactcgagatcgagacaggtctgtgaggggcaagtactcggatgacacgcctctgccaactccctcctacaaatataacgagtgggccgatgacagaagacacttggggtccaccccgcgtctgtccaggggccgaggaagacgtgaggagggcgaagaaggaatttcatttgacacggaggaggagcggcagcagtgggaagatgaccagaggcaagccgatcgggattggtacatgatggacgagggctatgacgagttccacaacccgctggcctactcctccgaggactacgtgaggaggcgggagcagcacctgcataaacagaagcagaagcgcatttcagctcagcggagacagatcaatgaggataacgagcgctgggagacaaaccgcatgctcaccagtggggtggtccatcggctggaggtggatgaggactttgaagaggacaacgcggccaaggtgcatctgatggtgcacaatctggtgcctccctttctggatgggcgcattgtcttcaccaagcagccggagccggtgattccagtgaaggatgctacttctgacctggccatcattgctcggaaaggcagccagacagtgcggaagcacagggagcagaaggagcgcaagaaggctcagcacaaacactgggaactggcggggaccaaactgggagatataatgggcgtcaagaaggaggaagagccagataaagctgtgacggaggatgggaaggtggactacaggacagagcagaagtttgcagatcacatgaagagaaagagcgaagccagcagtgaatttgcaaagaagaagtccatcctggagcagaggcagtacctgcccatctttgcagtgcagcaggagctgctcactattatcagagacaacagcatcgtgatcgtggttggggagacggggagtggtaagaccactcagctgacgcagtacctgcatgaagatggttacacggactatgggatgattgggtgtacccagccccggcgtgtagctgccatgtcagtggccaagagagtcagtgaagagatggggggaaaccttggcgaggaggtgggctatgccatccgctttgaagactgcacttcagagaacaccttgatcaaatacatgactgacgggatcctgctccgagagtccctccgggaagccgacctggatcactacagtgccatcatcatggacgaggcccacgagcgctccctcaacactgacgtgctctttgggctgctccgggaggtagtggctcggcgctcagacctgaagctcatcgtcacatcagccacgatggatgcggagaagtttgctgccttttttgggaatgtccccatcttccacatccctggccgtaccttccctgttgacatcctcttcagcaagaccccacaggaggattacgtggaggctgcagtgaagcagtccttgcaggtgcacctgtcgggggcccctggagacatccttatcttcatgcctggccaagaggacattgaggtgacctcagaccagattgtggagcatctggaggaactggagaacgcgcctgccctggctgtgctgcccatctactctcagctgccttctgacctccaggccaaaatcttccagaaggctccagatggcgttcggaagtgcatcgttgccaccaatattgccgagacgtctctcactgttgacggcatcatgtttgttatcgattctggttattgcaaattaaaggtcttcaaccccaggattggcatggatgctctgcagatctatcccattagccaggccaatgccaaccagcggtcagggcgagccggcaggacgggcccaggtcagtgtttcaggctctacacccagagcgcctacaagaatgagctcctgaccaccacagtgcccgagatccagaggactaacctggccaacgtggtgctgctgctcaagtccctcggggtgcaggacctgctgcagttccacttcatggacccgcccccggaggacaacatgctcaactctatgtatcagctctggatcctcggggccctggacaacacaggtggtctgacctctaccgggcggctgatggtggagttcccgctggaccctgccctgtccaagatgctcatcgtgtcctgtgacatgggctgcagctccgagatcctgctcatcgtttccatgctctcggtcccagccatcttctacaggcccaagggtcgagaggaggagagtgatcaaatccgggagaagttcgctgttcctgagagcgatcatttgacctacctgaatgtttacctgcagtggaagaacaataattactccaccatctggtgtaacgatcatttcatccatgctaaggccatgcggaaggtccgggaggtgcgagctcaactcaaggacatcatggtgcagcagcggatgagcctggcctcgtgtggcactgactgggacatcgtcaggaagtgcatctgtgctgcctatttccaccaagcagccaagctcaagggaatcggggagtacgtgaacatccgcacagggatgccctgccacttgcaccccaccagctccctttttggaatgggctacaccccagattacatagtgtatcacgagttggtcatgaccaccaaggagtatatgcagtgtgtgaccgctgtggacggggagtggctggcggagctgggccccatgttctatagcgtgaaacaggcgggcaagtcacggcaggagaaccgtcgtcgggccaaagaggaagcctctgccatggaggaggagatggcgctggccgaggagcagctgcgagcccggcggcaggagcaggagaagcgcagccccctgggcagtgtcaggtctacgaagatctacactccaggccggaaagagcaaggggagcccatgacccctcgccgcacgccagcccgctttggtctgtgagctgaggctgtccccagagaggatggcagcaggtattgggtcctcagccttctggcgggagccctgaggctgcggacaaagccctttcatctgaggactttcatctgtgcatatcacggccccccagggcagttcctgctggaccagactctctggcagaggaggtggagttcttccatgcaggagcacggcatggcgggagcggggctgcagagtatccgaggtgctgccggggcagcgggaggtggctggacccatcgcatctaaaactggcccaggacacttggtgtatgcgtgacttggctgtggctgtcttttttaatccttgtgtaaagcagcaaaaaagacctaaagggaattgtaatttggttataattcaggatttggaaataaatttattatttgtaaaacatga

SEQ ID NO: 7935 - DNA, 2250 bp, Homo sapiens
acttggatccaggaatcgggcgtgttccaggctgctctctatggtagctttgggcggatagagggggcgcgcaaagtattaagggacaataatggccgctttcaaggtgtggattttggctccttgagcctgtctgagcgaggggtggcagcgccggcgccccagaatccgggacagaagggtcccaagagtcgcgcttggtgagagaaatcccagatcctgtgatgggggacaccagtgaggatgcctcgatccatcgattggaaggcactgatctggactgtcaggttggtggtcttatttgcaagtccaaaagtgcggccagcgagcagcatgtcttcaaggctcctgctccccgcccttcattactcggactggacttgctggcttccctgaaacggagagagcgagaggagaaggacgatggggaggacaagaagaagtccaaagtctcctcctacaaggactgggaagagagcaaggatgaccagaaggatgctgaggaagagggcggtgaccaggccaaaatcttccagaaggctccagatggcgttcggaagtgcatcgttgccaccaatattgccgagacgtctctcactgttgacggcatcatgtttgttatcgattctggttattgcaaattaaaggtcttcaaccccaggattggcatggatgctctgcagatctatcccattagccaggccaatgccaaccagcggtcagggcgagccggcaggacgggcccaggtcagtgtttcaggctctacacccagagcgcctacaagaatgagctcctgaccaccacagtgcccgagatccagaggactaacctggccaacgtggtgctgctgctcaagtccctcggggtgcaggacctgctgcagttccacttcatggacccgcccccggaggacaacatgctcaactctatgtatcagctctggatcctcggggccctggacaacacaggtggtctgacctctaccgggcggctgatggtggagttcccgctggaccctgccctgtccaagatgctcatcgtgtcctgtgacatgggctgcagctccgagatcctgctcatcgtttccatgctctcggtcccagccatcttctacaggcccaagggtcgagaggaggagagtgatcaaatccgggagaagttcgctgttcctgagagcgatcatttgacctacctgaatgtttacctgcagtggaagaacaataattactccaccatctggtgtaacgatcatttcatccatgctaaggccatgcggaaggtccgggaggtgcgagctcaactcaaggacatcatggtgcagcagcggatgagcctggcctcgtgtggcactgactgggacatcgtcaggaagtgcatctgtgctgcctatttccaccaagcagccaagctcaagggaatcggggagtacgtgaacatccgcacagggatgccctgccacttgcaccccaccagctccctttttggaatgggctacaccccagattacatagtgtatcacgagttggtcatgaccaccaaggagtatatgcagtgtgtgaccgctgtggacggggagtggctggcggagctgggccccatgttctatagcgtgaaacaggcgggcaagtcacggcaggagaaccgtcgtcgggccaaagaggaagcctctgccatggaggaggagatggcgctggccgaggagcagctgcgagcccggcggcaggagcaggagaagcgcagccccctgggcagtgtcaggtctacgaagatctacactccaggccggaaagagcaaggggagcccatgacccctcgccgcacgccagcccgctttggtctgtgagctgaggctgtccccagagaggatggcagcaggtattgggtcctcagccttctggcgggagccctgaggctgcggacaaagccctttcatctgaggactttcatctgtgcatatcacggccccccagggcagttcctgctggaccagactctctggcagaggaggtggagttcttccatgcaggagcacggcatggcgggagcggggctgcagagtatccgaggtgctgccggggcagcgggaggtggctggacccatcgcatctaaaactggcccaggacacttggtgtatgcgtgacttggctgtggctgtcttttttaatccttgtgtaaagcagcaaaaaagacctaaagggaattgtaatttggttataattcaggatttggaaataaatttattatttgt

SEQ ID NO: 7936 - DNA, 3666 bp, Homo sapiens
ccacgtcatcgagcagctccccctccccttgctacaagtcgcacgcgcggaagtaaacacctctacgtcatcagggcgcgtcctcgtctttcccctcccatctcctcagatcggtggacgtgctcgcctccactcggggccaggtctatgtcccggtttcccgcagtcgcgggcagggcgccaaggcggcaggaggagggtgagcggtcaagagacctccaggaagagcggctctcggctgtttgcatcgccgatagagaagagaaaggatgcacgtcccaggagggaggaactactccaacttttcctattcagaaacaaagaaaaaagattattcaagctgtgagggacaattcattccttattgttactggaaatacaggaagtggtaaaacaactcaactcccaaaatatctatatgaagcagggttttcacaacatggtatgattggtgtaactcaaccacgaaaagtagctgctatatcagttgctcagagagtagctgaagaaatgaaatgcactttgggatccaaagtaggataccaagttcgttttgatgattgcagttctaaggagacagcaatcaaatatatgactgatggatgtttactgaaacatattctgggagacccaaatcttaccaaattcagtgtcattattttggatgaagcccatgaaagaactctaactacagatatcttatttggtttattgaagaagctatttcaggagaagtctcctaataggaaggagcatttaaaagtggtggtaatgtcagcaactatggaattagccaagctctctgcattctttggaaattgtccaatatttgatatacctggaaggctttatccagtcagagagaaattctgcaatttgattggtccacgagacagagaaaatactgcgtatattcaagcgattgtgaaagtcaccatggatatccatttgaatgaaatggctggagacatcttggtttttctgactggccagtttgaaatagaaaaaagttgtgagttactttttcagatggcagagtctgttgattatgattatgatgttcaagataccaccctcgatggcttgttaatattgccgtgttatggatcaatgacaacagatcaacagaggaggatatttttgccaccaccacctggaattagaaaatgtgtcatatccaccaatatttctgcaacgtctttgacaatagatggaatcagatatgtggtagatggtggcttcgtgaagcagttaaatcacaaccccagattagggttggacatcctggaggtggttccaatttcaaagagcgaggcattacagcgaagtggccgagctggcaggacttcttcaggaaaatgctttcggatctatagtaaagatttttggaaccagtgtatgcctgaccatgtgatccctgaaattaagagaactagtttgacatctgtagttctgaccttaaagtgccttgccatacacgatgtcataaggtttccctatttggatccacctaatgagagacttattttagaagctcttaaacaactttaccagtgtgatgctattgacaggagtggccatgtcaccagattgggtttgtctatggtggagtttcctttgcctccacatctgacatgtgcagtaataaaagctgcttccctggattgtgaagatctactacttccaatagcagcaatgttgtctgtggaaaacgtcttcattagacctgttgatccagagtaccagaaggaagcagaacagagacatcgagaattggcagctaaagctggaggatttaatgactttgcaactttagctgtcatctttgaacaatgcaaatcaagtggagctccagcttcatggtgccaaaaacactggattcattggaggtgcttattttctgcatttcgtgtggaagctcaacttcgagaactaatcaggaagcttaaacagcaaagtgatttcccaaaagagacctttgaaggccctaaacatgaagtactacgaagatgtctttgtgcgggctatttcaaaaatgtagctcgaagatctgttgggagaacgttttgcacaatggatggtcgtggaagcccagttcacattcatccttcctcagcacttcatgaacaggaaaccaaacttgaatggatcatttttcatgaggtattggttaccaccaaagtctacgcaagaattgtatgcccaatccgttatgaatgggtaagagacttgttacccaagttgcatgaatttaatgcacatgatttgagcagtgtggcccgacgtgaagtgagagaagatgcaagaaggagatggacaaataaggaaaatgtaaagcagctaaaggatggaatatcgaaagacgtcttaaagaaaatgcaaagaagaaatgatgacaaatccatatctgatgcacgggctcgtttccttgagagaaagcagcagaggacccaggaccacagtgacacacgaaaggaaacaggctaaggtggtgaaccctccaattcaggaagtgggaaaaggagccaggaaatgtgcttctactttgccagttatttcagacagcactaccaagaggaggtggtcagcacttgttattggcctatgaactaaaagcaaatcaaagctcataaatcaaagctcatcagttcccataaatgcagttgtcaaagaaaagatttggttgccatagtcataagcaatgatacatgaaaccaatgaaagacagtacatgtaataatattttcctcagtacaattttgctggccttaactggtatcaaacgctgtcattgagatgttttcaaagaacattgagttgtatttaatcagcgtgtactccatttgcattgaagcattaaaaattatttttcttaaaatctctttaaggccttcttgttgctgttagaatagtgctatatatcaggtatgtgaccatttatttcagaaggctgaacataagaggtttctactcagcaatacttagatgtctaactgtttaattgctacagagctttatagatatttagagaaaagacttaatcaattagtaaataaaattgcctatggcaggattctttcttgaattaatattaatccttaaattgatttttctgggattatacaaattcctttttatataaaagtatattgtttaaaacagtagctatagccattaaccaaaggacagatgatatatatatatatgatatatatatatatataagttcttttttagctgtacctacgtacttatatcagcaccatgtatgtaggtgtgatagtactttcaaacagcgcctccacctggcctactctgttatttccacctgtttgggtagggccatttaacttccattatgccaaacttgggatgggattttcgaagcagacaacactatttcatcgtgtttcaaattggaaccttgaggctagttagtatcacactcaggccacactcagcacttgcccactcttgtttactgccttgtattctagttatttgtgtatttgtctccctcactagattatacgctccttgtgggcagggactgtgtcttttttcatctttgtatctttcatgcacctagcatagtgctttgcacatagtagtcactcagtgtttgttaaataaagctattagtgtcattaaaattcaaaagacagt

SEQ ID NO: 7937 - DNA, 2228 bp, Homo sapiens
gtctttcccctcccatctcctcagatcggtggacgtgctcgcctccactcggggccaggtctatgtcccggtttcccgcagtcgcgggcagggcgccaaggcggcaggaggagggtgagcggtcaagagacctccaggaagagcggctctcggctgtttgcatcgccgatagagaagagaaaggatgcacgtcccaggagggaggaactactccaacttttcctattcagaaacaaagaaaaaagattattcaagctgtgagggacaattcattccttattgttactggaaatacaggaagtggtaaaacaactcaactcccaaaatatctatatgaagcagggttttcacaacatggtatgattggtgtaactcaaccacgaaaagtagctgctatatcagttgctcagagagtagctgaagaaatgaaatgcactttgggatccaaagtaggataccaagttcgttttgatgattgcagttctaaggagacagcaatcaaatatatgactgatggatgtttactgaaacatattctgggagacccaaatcttaccaaattcagtgtcattattttggatgaagcccatgaaagaactctaactacagatatcttatttggtttattgaagaagctatttcaggagaagtctcctaataggaaggagcatttaaaagtggtggtaatgtcagcaactatggaattagccaagctctctgcattctttggaaattgtccaatatttgatatacctggaaggctttatccagtcagagagaaattctgcaatttgattggtccacgagacagagaaaatactgcgtatattcaagcgattgtgaaagtcaccatggatatccatttgaatgaaatggctggagacatcttggtttttctgactggccagtttgaaatagaaaaaagttgtgagttactttttcagatggcagagtctgttgattatgattatgatgttcaagataccaccctcgatggcttgttaatattgccgtgttatggatcaatgacaacagatcaacagaggaggatatttttgccaccaccacctggaattagaaaatgtgtcatatccaccaatatttctgcaacgtctttgacaatagatggaatcagatatgtggtagatggtggcttcgtgaagcagttaaatcacaaccccagattagggttggacatcctggaggtggttccaatttcaaagagcgaggcattacagcgaagtggccgagctggcaggacttcttcaggaaaatgctttcggatctatagtaaagatttttggaaccagtgtatgcctgaccatgtgatccctgaaattaagagaactagtttgacatctgtagttctgaccttaaagtgccttgccatacacgatgtcataaggtttccctatttggatccacctaatgagagacttattttagaagctcttaaacaactttaccagtgtgatgctattgacaggagtggccatgtcaccagattgggtttgtctatggtggagtttcctttgcctccacatctgacatgtgcagtaataaaagctgcttccctggattgtgaagatctactacttccaatagcagcaatgttgtctgtggaaaacgtcttcattagacctgttgatccagagtaccagaaggaagcagaacagagacatcgagaattggcagctaaagctggaggatttaatgactttgcaactttagctgtcatctttgaacaatgcaaatcaagtggagctccagcttcatggtgccaaaaacactggattcattggaggtgcttattttctgcatttcgtgtggaagctcaacttcgagaactaatcaggaagcttaaacagcaaagtgatttcccaaaagagacctttgaaggccctaaacatgaagtactacgaagatgtctttgtgcgggctatttcaaaaatgtagctcgaagatctgttgggagaacgttttgcacaatggatggtcgtggaagcccagttcacattcatccttcctcagcacttcatgaacaggaaaccaaacttgaatggatcatttttcatgaggtattggttaccaccaaagtctacgcaagaattgtatgcccaatccgttatgaatgggtaagagacttgttacccaagttgcatgaatttaatgcacatgatttgagcagtgtggcccgacgtgaagtgagcaaaataaaattatttcag

SEQ ID NO: 7938 - DNA, 3724 bp, Homo sapiens
gtctttcccctcccatctcctcagatcggtggacgtgctcgcctccactcggggccaggtctatgtcccggtttcccgcagtcgcgggcagggcgccaaggcggcaggaggagggtgagcggtcaagagacctccaggaagagcggctctcggctgtttgcatcgccgatagagaagagaaaggatgcacgtcccaggagggaggaactactccaacttttcctattcagaaacaaagaaaaaagattattcaagctgtgagggacaattcattccttattgttactggaaatacaggaagtggtaaaacaactcaactcccaaaatatctatatgaagcagggttttcacaacatggtatgattggtgtaactcaaccacgaaaagtagctgctatatcagttgctcagagagtagctgaagaaatgaaatgcactttgggatccaaagtaggataccaagttcgttttgatgattgcagttctaaggagacagcaatcaaatatatgactgatggatgtttactgaaacatattctgggagacccaaatcttaccaaattcagtgtcattattttggatgaagcccatgaaagaactctaactacagatatcttatttggtttattgaagaagctatttcaggagaagtctcctaataggaaggagcatttaaaagtggtggtaatgtcagcaactatggaattagccaagctctctgcattctttggaaattgtccaatatttgatatacctggaaggctttatccagtcagagagaaattctgcaatttgattggtccacgagacagagaaaatactgcgtatattcaagcgattgtgaaagtcaccatggatatccatttgaatgaaatggctggagacatcttggtttttctgactggccagtttgaaatagaaaaaagttgtgagttactttttcagatggcagagtctgttgattatgattatgatgttcaagataccaccctcgatggcttgttaatattgccgtgttatggatcaatgacaacagtttcacaaaccagtctcacctttgtaacccacatccagatcatgaaacaaatcagtgagaaccagcattccttgacaggtctcaccattgctgggattacaggcgtgagtcaccacgcccggcctagaaacatgacttgtaatgaaaaattaaatcaacagaggaggatatttttgccaccaccacctggaattagaaaatgtgtcatatccaccaatatttctgcaacgtctttgacaatagatggaatcagatatgtggtagatggtggcttcgtgaagcagttaaatcacaaccccagattagggttggacatcctggaggtggttccaatttcaaagagcgaggcattacagcgaagtggccgagctggcaggacttcttcaggaaaatgctttcggatctatagtaaagatttttggaaccagtgtatgcctgaccatgtgatccctgaaattaagagaactagtttgacatctgtagttctgaccttaaagtgccttgccatacacgatgtcataaggtttccctatttggatccacctaatgagagacttattttagaagctcttaaacaactttaccagtgtgatgctattgacaggagtggccatgtcaccagattgggtttgtctatggtggagtttcctttgcctccacatctgacatgtgcagtaataaaagctgcttccctggattgtgaagatctactacttccaatagcagcaatgttgtctgtggaaaacgtcttcattagacctgttgatccagagtaccagaaggaagcagaacagagacatcgagaattggcagctaaagctggaggatttaatgactttgcaactttagctgtcatctttgaacaatgcaaatcaagtggagctccagcttcatggtgccaaaaacactggattcattggaggtgcttattttctgcatttcgtgtggaagctcaacttcgagaactaatcaggaagcttaaacagcaaagtgatttcccaaaagagacctttgaaggccctaaacatgaagtactacgaagatgtctttgtgcgggctatttcaaaaatgtagctcgaagatctgttgggagaacgttttgcacaatggatggtcgtggaagcccagttcacattcatccttcctcagcacttcatgaacaggaaaccaaacttgaatggatcatttttcatgaggtattggttaccaccaaagtctacgcaagaattgtatgcccaatccgttatgaatgggtaagagacttgttacccaagttgcatgaatttaatgcacatgatttgagcagtgtggcccgacgtgaagtgagagaagatgcaagaaggagatggacaaataaggaaaatgtaaagcagctaaaggatggaatatcgaaagacgtcttaaagaaaatgcaaagaagaaatgatgacaaatccatatctgatgcacgggctcgtttccttgagagaaagcagcagaggacccaggaccacagtgacacacgaaaggaaacaggctaaggtggtgaaccctccaattcaggaagtgggaaaaggagccaggaaatgtgcttctactttgccagttatttcagacagcactaccaagaggaggtggtcagcacttgttattggcctatgaactaaaagcaaatcaaagctcataaatcaaagctcatcagttcccataaatgcagttgtcaaagaaaagatttggttgccatagtcataagcaatgatacatgaaaccaatgaaagacagtacatgtaataatattttcctcagtacaattttgctggccttaactggtatcaaacgctgtcattgagatgttttcaaagaacattgagttgtatttaatcagcgtgtactccatttgcattgaagcattaaaaattatttttcttaaaatctctttaaggccttcttgttgctgttagaatagtgctatatatcaggtatgtgaccatttatttcagaaggctgaacataagaggtttctactcagcaatacttagatgtctaactgtttaattgctacagagctttatagatatttagagaaaagacttaatcaattagtaaataaaattgcctatggcaggattctttcttgaattaatattaatccttaaattgatttttctgggattatacaaattcctttttatataaaagtatattgtttaaaacagtagctatagccattaaccaaaggacagatgatatatatatatatgatatatatatatatataagttcttttttagctgtacctacgtacttatatcagcaccatgtatgtaggtgtgatagtactttcaaacagcgcctccacctggcctactctgttatttccacctgtttgggtagggccatttaacttccattatgccaaacttgggatgggattttcgaagcagacaacactatttcatcgtgtttcaaattggaaccttgaggctagttagtatcacactcaggccacactcagcacttgcccactcttgtttactgccttgtattctagttatttgtgtatttgtctccctcactagattatacgctccttgtgggcagggactgtgtcttttttcatctttgtatctttcatgcacctagcatagtgctttgcacatagtagtcactcagtgtttgttaaataaagctattagtgtcattaaaattc

SEQ ID NO: 7939 - DNA, 3435 bp, Homo sapiens
ccacgtcatcgagcagctccccctccccttgctacaagtcgcacgcgcggaagtaaacacctctacgtcatcagggcgcgtcctcgtctttcccctcccatctcctcagatcggtggacgtgctcgcctccactcggggccaggtctatgtcccggtttcccgcagtcgcgggcagggcgccaaggcggcaggaggagggtgagcggtcaagagacctccaggaagagcggctctcggctgtttgcatcgccgatagagaagagaaaggatgcacgtcccaggagggaggaactactccaacttttcctattcagaaacaaagaaaaaagattattcaagctgagacagcaatcaaatatatgactgatggatgtttactgaaacatattctgggagacccaaatcttaccaaattcagtgtcattattttggatgaagcccatgaaagaactctaactacagatatcttatttggtttattgaagaagctatttcaggagaagtctcctaataggaaggagcatttaaaagtggtggtaatgtcagcaactatggaattagccaagctctctgcattctttggaaattgtccaatatttgatatacctggaaggctttatccagtcagagagaaattctgcaatttgattggtccacgagacagagaaaatactgcgtatattcaagcgattgtgaaagtcaccatggatatccatttgaatgaaatggctggagacatcttggtttttctgactggccagtttgaaatagaaaaaagttgtgagttactttttcagatggcagagtctgttgattatgattatgatgttcaagataccaccctcgatggcttgttaatattgccgtgttatggatcaatgacaacagatcaacagaggaggatatttttgccaccaccacctggaattagaaaatgtgtcatatccaccaatatttctgcaacgtctttgacaatagatggaatcagatatgtggtagatggtggcttcgtgaagcagttaaatcacaaccccagattagggttggacatcctggaggtggttccaatttcaaagagcgaggcattacagcgaagtggccgagctggcaggacttcttcaggaaaatgctttcggatctatagtaaagatttttggaaccagtgtatgcctgaccatgtgatccctgaaattaagagaactagtttgacatctgtagttctgaccttaaagtgccttgccatacacgatgtcataaggtttccctatttggatccacctaatgagagacttattttagaagctcttaaacaactttaccagtgtgatgctattgacaggagtggccatgtcaccagattgggtttgtctatggtggagtttcctttgcctccacatctgacatgtgcagtaataaaagctgcttccctggattgtgaagatctactacttccaatagcagcaatgttgtctgtggaaaacgtcttcattagacctgttgatccagagtaccagaaggaagcagaacagagacatcgagaattggcagctaaagctggaggatttaatgactttgcaactttagctgtcatctttgaacaatgcaaatcaagtggagctccagcttcatggtgccaaaaacactggattcattggaggtgcttattttctgcatttcgtgtggaagctcaacttcgagaactaatcaggaagcttaaacagcaaagtgatttcccaaaagagacctttgaaggccctaaacatgaagtactacgaagatgtctttgtgcgggctatttcaaaaatgtagctcgaagatctgttgggagaacgttttgcacaatggatggtcgtggaagcccagttcacattcatccttcctcagcacttcatgaacaggaaaccaaacttgaatggatcatttttcatgaggtattggttaccaccaaagtctacgcaagaattgtatgcccaatccgttatgaatgggtaagagacttgttacccaagttgcatgaatttaatgcacatgatttgagcagtgtggcccgacgtgaagtgagagaagatgcaagaaggagatggacaaataaggaaaatgtaaagcagctaaaggatggaatatcgaaagacgtcttaaagaaaatgcaaagaagaaatgatgacaaatccatatctgatgcacgggctcgtttccttgagagaaagcagcagaggacccaggaccacagtgacacacgaaaggaaacaggctaaggtggtgaaccctccaattcaggaagtgggaaaaggagccaggaaatgtgcttctactttgccagttatttcagacagcactaccaagaggaggtggtcagcacttgttattggcctatgaactaaaagcaaatcaaagctcataaatcaaagctcatcagttcccataaatgcagttgtcaaagaaaagatttggttgccatagtcataagcaatgatacatgaaaccaatgaaagacagtacatgtaataatattttcctcagtacaattttgctggccttaactggtatcaaacgctgtcattgagatgttttcaaagaacattgagttgtatttaatcagcgtgtactccatttgcattgaagcattaaaaattatttttcttaaaatctctttaaggccttcttgttgctgttagaatagtgctatatatcaggtatgtgaccatttatttcagaaggctgaacataagaggtttctactcagcaatacttagatgtctaactgtttaattgctacagagctttatagatatttagagaaaagacttaatcaattagtaaataaaattgcctatggcaggattctttcttgaattaatattaatccttaaattgatttttctgggattatacaaattcctttttatataaaagtatattgtttaaaacagtagctatagccattaaccaaaggacagatgatatatatatatatgatatatatatatatataagttcttttttagctgtacctacgtacttatatcagcaccatgtatgtaggtgtgatagtactttcaaacagcgcctccacctggcctactctgttatttccacctgtttgggtagggccatttaacttccattatgccaaacttgggatgggattttcgaagcagacaacactatttcatcgtgtttcaaattggaaccttgaggctagttagtatcacactcaggccacactcagcacttgcccactcttgtttactgccttgtattctagttatttgtgtatttgtctccctcactagattatacgctccttgtgggcagggactgtgtcttttttcatctttgtatctttcatgcacctagcatagtgctttgcacatagtagtcactcagtgtttgttaaataaagctattagtgtcattaaaattcaaaagacagt

SEQ ID NO: 7940 - DNA, 4200 bp, Homo sapiens
gaaagctggaacccggccggagtagctctgagcgccggctgtgaggaaggaggttctgggcaagctatagccatggctgtggctgtagccatggcgggagccttaatcgggtcggagccaggccccgcggaagaacttgccaaactcgagtacctgtctttggtgtcaaaggtttgcactgagctggacaatcacttggggatcaacgacaaggaccttgctgaatttgtgatcagtcttgctgagaaaaataccacctttgatacttttaaggcttctctcgtcaaaaatggtgcagaatttacggattctcttattagtaacttgctgcgtctcatacaaaccatgcggcctccagcgaagccttccactagcaaagatccagttgttaaacctaaaacagaaaaagaaaagctgaaggaactcttcccagtcctttgccaaccggacaacccttctgttcggaccatgttggatgaagatgatgtgaaagttgctgtggatgtcctgaaagaactggaagctttaatgcccagcgcagcaggccaggagaagcaaagagatgctgaacaccgggacaggacaaagaagaagaagcggagtcgaagccgagatcgaaaccgagatcgagacagagatagggaacgaaaccgagatagagaccacaagcggagacaccgatcccgctctcgatcacgttccaggacccgggagaggaataaagtgaagtctagatatcggtccaggagcaggagtcagagtccccccaaagaccggaaggaccgggacaaatatggagagcggaatctggatagatggcgggataagcatgtggaccgccctcctccagaagagcccaccattggtgacatttataatggcaaagttaccagcatcatgcagtttggttgctttgtgcagctggaaggactaaggaagcggtgggaaggcctggtgcacatctctgagctccggcgggagggtcgtgtggccaatgtagctgatgtcgtgagcaaaggccagagggtcaaagtcaaagtgctgtccttcactgggaccaagaccagcctgagcatgaaggatgtggatcaagagactggagaagatctaaacccaaatagacggcgaaatcttgtcggggagaccaatgaggagacctcaatgcggaatcctgatagacccactcacttgtcccttgtcagtgctcctgaagtagaggacgactcactggaacgcaagcgcctcacccgaatctctgacccagagaagtgggagatcaaacagatgattgctgccaatgtcctttccaaagaagaatttccagactttgatgaagagactggcattctccctaaggtggatgatgaagaagatgaggaccttgagattgaattggttgaggaagagcctccattcctgagagggcacactaagcaaagcatggacatgagccccattaaaattgtcaagaacccagacggctccctctcccaagcagcaatgatgcagagtgccttggccaaagaaaggcgggaactcaaacaggcccagcgggaagctgagatggattctattcccatgggactcaacaaacactgggttgaccctctgcctgatgcggaaggcagacagattgctgccaacatgaggggtattgggatgatgcccaatgatattcctgagtggaagaagcatgcctttgggggcaacaaagcctcttacggaaaaaagacccagatgtcaatccttgagcagagggagagcctgcccatctacaaactgaaggagcaattggtccaggccgtccatgacaatcagatcctgattgtcattggtgagacaggatctggaaagacaacacagatcacccagtacctggcggaggcaggctacacttccaggggcaagattgggtgtacccagcccagaagagtggcagctatgtcggtggccaaaagagtgtcagaggagtttggttgttgcttaggccaagaggtgggctacaccattcgatttgaggactgcactagccctgaaacagtcatcaagtacatgacagatgggatgttgcttagagagtgcttgattgaccctgacctcactcagtacgcgatcatcatgttggacgaggcacatgagaggacaattcacactgatgtgctctttggattgttgaaaaagacagttcagaaacggcaggacatgaagctgattgtcacctcagccaccttggatgcagtgaagttttctcaatacttctatgaagctcccattttcaccatcccaggtcgaacatatccagtggaaatactgtacacaaaggaacctgagacagattatctggatgccagcctgattactgttatgcagattcatttaacagaaccaccaggtgatatcctggtcttcctgactggtcaggaagaaattgatactgcttgtgagatcctgtatgaaagaatgaaatccctgggacctgatgttccagagttaattatcctcccagtgtactctgctcttcccagtgagatgcagacccgaatctttgacccagctccaccaggcagcagaaaggttgtgattgccaccaatatcgcagagacatcgctgactattgatggtatctactatgtggtggacccaggattcgtgaaacagaaagtttacaattccaagacagggattgaccagctcgtggtgacgcctatttctcaggctcaggcaaagcaacgagctggcagagctgggagaacaggcccagggaagtgttacaggttgtacacagaacgtgcctaccgagatgaaatgctgaccaccaacgtgccggaaatccagagaaccaacttagcaagcacagtgctgtcactcaaggccatgggtatcaatgatctgctgtcctttgatttcatggatgccccacctatggaaactttgatcacagccatggagcagctgtacacactgggggccctggatgacgagggcctgctcactcgcttgggccgccggatggcagagttccctctggagccaatgctatgcaaaatgctcatcatgtctgtgcatctgggctgcagtgaggaaatgctgaccattgtatccatgctgtctgtgcagaacgtcttctataggcccaaggataaacaagcccttgcagatcagaagaaggccaaattccaccagactgaaggggaccacctcaccctgctagctgtgtacaactcctggaagaacaacaagttctccaacccatggtgctatgagaactttatccaggctcgttccctgcgccgggcccaggacattcgcaagcagatgttaggcataatggacagacacaagctggatgttgtttcctgtggcaagtccacagtccgagtgcagaaggccatctgcagtgggttcttccgtaatgctgccaagaaagacccgcaggagggttaccggacactgatcgaccagcaggtggtctatatccatccttccagtgccctcttcaacagacagccagaatgggtggtgtaccatgagctggtgctcaccaccaaggaatacatgcgtgaagttaccaccatcgaccctcggtggcttgtggagtttgccccagccttcttcaaggtctcagacccaactaagctaagcaaacagaagaagcaacagcgtcttgaacccttgtacaaccgctatgaggaacccaatgcctggagaatatctcgagctttccgacggcgctgaaaggcaagattgttcctttgcctctccagcagcagtagccagggcttggacttatcgatgacaggctggtcctgaggatacagctgtcccgtgactgactgtcttaactgagcattttctcaactcgactctcatttcttccctgctggtaaaatagaaacagggatttaaacctggctttggcaagagcctgcagcctccatcaccccaagtccttgggcccagttgggagctcatatctaacacagagacacattgcatcaacttcaagaaagggacaatttgtgcagctccaggatgggaaggtggagtgggtgagcatcttgtgcagggacatggtgagtgccctgatgccccagctagcaggagctactgtgctcatctaaagtgtttgccccacttcccaccccgtctccagcccctgtactttggcttgacctcgtggaaatatttattttcttaagg

SEQ ID NO: 7941 - DNA, 3809 bp, Homo sapiens
agtgaaagctggaacccggccggagtagctctgagcgccggctgtgaggaaggaggttctgggcaagctatagccatggctgtggctgtagccatggcgggagccttaatcgggtcggagccaggccccgcggaagaacttgccaaactcgagtacctgtctttggtgtcaaaggtttgcactgagctggacaatcacttggggatcaacgacaaggaccttgctgaatttgtgatcagtcttgctgagaaaaataccacctttgatacttttaaggcttctctcgtcaaaaatggtgcagaatttacggattctcttattagtaacttgctgcgtctcatacaaaccatgcggcctccagcgaagccttccactagcaaagatccagttgttaaacctaaaacagaaaaagaaaagctgaaggaactcttcccagtcctttgccaaccggacaacccttctgttcggaccatgttggatgaagatgatgtgaaagttgctgtggatgtcctgaaagaactggaagctttaatgcccagcgcagcaggccaggagaagcaaagagatgctgaacaccgggacaggacaaagaagaagaagcggagtcgaagccgagatcgaaaccgagatcgagacagagatagggaacgaaaccgagatagagaccacaagcggagacaccgatcccgctctcgatcacgttccaggacccgggagaggaataaagtgaagtctagatatcggtccaggagcaggagtcagagtccccccaaagaccggaaggaccgggacaaatatggagagcggaatctggatagatggcgggataagcatgtggaccgccctcctccagaagagcccaccattggtgacatttataatggcaaagttaccagcatcatgcagtttggttgctttgtgcagctggaaggactaaggaagcggtgggaaggcctggtgcacatctctgagctccggcgggagggtcgtgtggccaatgtagctgatgtcgtgagcaaaggccagagggtcaaagtcaaagtgctgtccttcactgggaccaagaccagcctgagcatgaaggatgtggatcaagagactggagaagatctaaacccaaatagacggcgaaatcttgtcggggagaccaatgaggagacctcaatgcggaatcctgatagacccactcacttgtcccttgtcagtgctcctgaagtagaggacgactcactggaacgcaagcgcctcacccgaatctctgacccagagaagtgggagatcaaacagatgattgctgccaatgtcctttccaaagaagaatttccagactttgatgaagagactggcattctccctaaggtggatgatgaagaagatgaggaccttgagattgaattggttgaggaagagcctccattcctgagagggcacactaagcaaagcatggacatgagccccattaaaattgtcaagaacccagacggctccctctcccaagcagcaatgatgcagagtgccttggccaaagaaaggcgggaactcaaacaggcccagcgggaagctgagatggattctattcccatgggactcaacaaacactgggttgaccctctgcctgatgcggaaggcagacagattgctgccaacatgaggggtattgggatgatgcccaatgatattcctgagtggaagaagcatgcctttgggggcaacaaagcctcttacggaaaaaagacccagatgtcaatccttgagcagagggagagcctgcccatctacaaactgaaggagcaattggtccaggccgtccatgacaatcagatcctgattgtcattggtgagacaggatctggaaagacaacacagatcacccagtacctggcggaggcaggctacacttccaggggcaagattgggtgtacccagcccagaagagtggcagctatgtcggtggccaaaagagtgtcagaggagtttggttgttgcttaggccaagaggtgggctacaccattcgatttgaggactgcactagccctgaaacagtcatcaagtacatgacagatgggatgttgcttagagagtgcttgattgaccctgacctcactcagtacgcgatcatcatgttggacgaggcacatgagaggacaattcacactgatgtgctctttggattgttgaaaaagacagttcagaaacggcaggacatgaagctgattgtcacctcagccaccttggatgcagtgaagttttctcaatacttctatgaagctcccattttcaccatcccaggtcgaacatatccagtggaaatactgtacacaaaggaacctgagacagattatctggatgccagcctgattactgttatgcagattcatttaacagaaccaccaggtgatatcctggtcttcctgactggtcaggaagaaattgatactgcttgtgagatcctgtatgaaagaatgaaatccctgggacctgatgttccagagttaattatcctcccagtgtactctgctcttcccagtgagatgcagacccgaatctttgacccagctccaccaggcagcagaaaggttgtgattgccaccaatatcgcagagacatcgctgactattgatggtatctactatgtggtggacccaggattcgtgaaacagaaagtttacaattccaagacagggattgaccagctcgtggtgacgcctatttctcaggctcaggcaaagcaacgagctggcagagctgggagaacaggcccagggaagtgttacaggttgtacacagaacgtgcctaccgagatgaaatgctgaccaccaacgtgccggaaatccagagaaccaacttagcaagcacagtgctgtcactcaaggccatgggtatcaatgatctgctgtcctttgatttcatggatgccccacctatggaaactttgatcacagccatggagcagctgtacacactgggggccctggatgacgagggcctgctcactcgcttgggccgccggatggcagagttccctctggagccaatgctatgcaaaatgctcatcatgtctgtgcatctgggctgcagtgaggaaatgctgaccattgtatccatgctgtctgtgcagaacgtcttctataggcccaaggataaacaagcccttgcagatcagaagaaggccaaattccaccagactgaaggggaccacctcaccctgctagctgtgtacaactcctggaagaacaacaagttctccaacccatggtgctatgagaactttatccaggctcgttccctgcgccgggcccaggacattcgcaagcagatgttaggcataatggacagacacaagctggatgttgtttcctgtggcaagtccacagtccgagtgcagaaggccatctgcagtgggttcttccgtaatgctgccaagaaagacccgcaggagggttaccggacactgatcgaccagcaggtggtctatatccatccttccagtgccctcttcaacagacagccagaatgcccaaagcacttcctccctgtggttgctgtagctgtctcattggagcagtgcctctccaagtttgaggatttgaacaaagaactgggactggtgacttgttaatgaacagttcagagggcagagggccatcatctcagcttgtggagacctttctttccctggatgctgcttctcagctaactccctctctcttcgtgtgtgtactcggccttcagggtttccaccgatttttacaccttcttcccaccacgatagcttggctttaatgtggaattaaattatatattttt

SEQ ID NO: 7942 - DNA, 4240 bp, Homo sapiens
gcgagttgctgtgcgtttctctgttgtctcggtagaaggccagagtcacacacggtcctaagagctgggcaccaggaagcgaaggctgatctgaagaagacacttgaatcatgggtgacgttaaaaattttctgtatgcctggtgtggcaaaaggaagatgaccccatcctatgaaattagagcagtggggaacaaaaacaggcagaaattcatgtgtgaggttcaggtggaaggttataattacactggcatgggaaattccaccaataaaaaagatgcacaaagcaatgctgccagagactttgttaactatttggttcgaataaatgaaataaagagtgaagaagttccagcttttggggtagcatctccgcccccacttactgatactcctgacactacagcaaatgctgaaggagatttaccaacaaccatgggaggacctcttcctccacatctggctctcaaagcagaaaataattctgaggtaggggcctctggctatggtgttcctgggcccacctgggaccgaggagccaacttgaaggattactactcaagaaaggaagaacaagaagtgcaagcgactctagaatcagaagaagtggatttaaatgctgggcttcatggaaactggaccttggaaaatgctaaagctcgtctaaaccaatattttcagaaagaaaagatccaaggagaatataagtacacccaagtgggtcctgatcacaacaggagctttattgcagaaatgaccatttatatcaagcagctgggcagaaggatttttgcacgagaacatggatcaaataagaaattggcagcacagtcctgtgccctgtcacttgtcagacaactgtaccatcttggagtggttgaagcttactccggacttacaaagaagaaggaaggagagacagtggagccttacaaagtaaacctctctcaagatttagagcatcagctgcaaaacatcattcaagagctaaatcttgagattttgcccccgcctgaagatccttctgtgccagttgcactcaacattggcaaattggctcagttcgaaccatctcagcgacaaaaccaagtgggtgtggttccttggtcacctccacaatccaactggaatccttggactagtagcaacattgatgaggggcctctggcttttgctactccagagcaaataagcatggacctcaagaatgaattgatgtaccagttggaacaggatcatgatttgcaagcaatcttgcaggagagagagttactgcctgtgaagaaatttgaaagtgagattctggaagcaatcagccaaaattcagttgtcattattagaggggctactggatgtgggaaaaccacacaggttccccagttcattctagatgactttatccagaatgaccgagcagcagagtgtaacatcgtagtaactcagcccagaagaatcagtgcggtttctgtggcagagcgagttgcatttgaaagaggagaagagcctggaaaaagctgtggctacagcgttcgatttgagtctatacttcctcgtcctcatgccagtataatgttttgtactgtaggtgtgctcctgagaaaattagaagcaggcattcgaggaatcagtcatgtaattgtagatgaaatacatgaaagagatattaatactgacttccttttggtagtactgcgtgatgttgttcaggcttatcctgaagttcgcattgttcttatgtctgctactattgataccagcatgttttgtgaatatttcttcaattgccccatcattgaagtttatgggaggacttacccagttcaagaatattttctggaagactgcattcagatgacccactttgttcctccaccaaaagacaaaaagaagaaggataaggatgatgatggtggtgaggatgatgatgcaaattgcaacttgatctgtggtgatgaatatggtccagaaacaaggttgagcatgtctcaattgaacgaaaaggaaactccttttgaactcatcgaggctctacttaagtacattgaaacccttaatgttcctggagctgtgttggtttttttgcctggctggaatctgatttatactatgcagaagcatttggaaatgaatccacattttggaagccatcggtatcagattctacccctgcattctcagattcctcgagaggaacagcgcaaagtgtttgatccagtaccagttggagtaaccaaggttattttgtccacaaatattgctgaaacaagcattaccataaacgatgttgtttatgtcattgactcctgcaagcagaaagtgaaactcttcactgctcacaacaatatgaccaactatgctaccgtatgggcatcaaaaacaaaccttgagcaacggaaagggcgagctggccgagtacggcctggattctgctttcacctgtgcagccgagctcgttttgagagacttgaaacccacatgacaccagagatgttccgaacaccattgcatgaaattgctcttagcataaaacttctgcgtctaggaggaattggccaatttctggccaaagcaattgaacctccccctttggatgctgtgattgaagcagaacacactcttagagagcttgatgcattagatgccaatgatgagttgactcctttgggacgaatcctggctaaactccccattgagcctcgttttggcaaaatgatgataatggggtgtattttctacgtgggagatgctatctgtaccattgctgctgctacctgctttccagagcctttcatcaatgaaggaaagcggctgggctatatccatcgaaattttgctggaaacagattttctgatcacgtagcccttttatcagtattccaagcctgggatgatgctagaatgggtggagaagaagcagagatacgtttttgtgagcacaaaagacttaatatggctacactaagaatgacttgggaagccaaagttcagctcaaagagattttgattaattctgggtttccagaagattgtttgttgacacaagtgtttactaacactggaccagataataatttggatgttgttatctccctcctggcctttggtgtgtaccccaatgtatgctatcataaggaaaagaggaagattctcaccactgaagggcgtaatgcacttatccacaaatcatctgttaattgtccttttagtagccaagacatgaagtacccatctcccttctttgtatttggtgaaaagattcgaactcgagccatctctgctaaaggcatgactttagtcacccccctgcagttgcttctctttgcctccaagaaagtccaatctgatgggcagattgtgcttgtagatgactggattaaactgcaaatatctcatgaagctgctgcctgtatcactggtctccgggcagccatggaggctttggttgttgaagtaaccaaacaacctgctatcatcagccagttggaccccgtaaatgaacgtatgctgaacatgatccgtcagatctctagaccctcagctgctggtatcaaccttatgattggcagtacacggtatggagatggtccacgtcctcccaagatggcccgatacgacaatggaagcggatatagaaggggaggttctagttacagtggtggaggctatggcggtggctatagcagtggaggctatggtagcggaggctatggtggcagcgccaactcctttcgggcaggatatggtgcaggtgttggtggaggctatagaggagtttcccgaggtggctttagaggcaactctggaggagactacagagggcctagtggaggctacagaggatctgggggattccagcgaggaggtggtaggggggcctatggaactggctactttggacagggaagaggaggtggcggctattaaaacttggttatgtcagttcctgtgtgtagacagtaaggaaaaaaaggcatgctatgtgttacgtgttttttccagtatgtttatttgccaccaaaaagtaaatgcattttcacccattctgtggttcattgtagtttaaggaaaccaagcatatagatgcattagtgattttgtttatattatgtaaaatataacgatctcttaaaaataccacagtttgtattttttctttaaggagtaaagatttgcctttaaataacttggtattttcctggctttcgtttaatacaatagaaaataaagtattacaccgaata

SEQ ID NO: 7943 - DNA, 1972 bp, Homo sapiens
atgcgtacgctcgctggccccgccccctagcgccgcggtcggagccatttcgccgattcctccatgcgagttgctgtgcgtttctctgttgtctcggtagaaggccagagtcacacacggtcctaagagctgggcaccaggaagcgaaggctgatctgaagaagacacttgaatcatgggtgacgttaaaaattttctgtatgcctggtgtggcaaaaggaagatgaccccatcctatgaaattagagcagtggggaacaaaaacaggcagaaattcatgtgtgaggttcaggtggaaggttataattacactggcatgggaaattccaccaataaaaaagatgcacaaagcaatgctgccagagactttgttaactatttggttcgaataaatgaaataaagagtgaagaagttccagcttttggggtagcatctccgcccccacttactgatactcctgacactacagcaaatgctgaaggagatttaccaacaaccatgggaggacctcttcctccacatctggctctcaaagcagaaaataattctgaggtaggggcctctggctatggtgttcctgggcccacctgggaccgaggagccaacttgaaggattactactcaagaaaggaagaacaagaagtgcaagcgactctagaatcagaagaagtggatttaaatgctgggcttcatggaaactggaccttggaaaatgctaaagctcgtctaaaccaatattttcagaaagaaaagatccaaggagaatataagtacacccaagtgggtcctgatcacaacaggagctttattgcagaaatgaccatttatatcaagcagctgggcagaaggatttttgcacgagaacatggatcaaataagaaattggcagcacagtcctgtgccctgtcacttgtcagacaactgtaccatcttggagtggttgaagcttactccggacttacaaagaagaaggaaggagagacagtggagccttacaaagtaaacctctctcaagatttagagcatcagctgcaaaacatcattcaagagctaaatcttgagattttgcccccgcctgaagatccttctgtgccagttgcactcaacattggcaaattggctcagttcgaaccatctcagcgacaaaaccaagtgggtgtggttccttggtcacctccacaatccaactggaatccttggactagtagcaacattgatgaggggcctctggcttttgctactccagagcaaataagcatggacctcaagaatgaattgatgtaccagttggaacaggatcatgatttgcaagcaatcttgcaggagagagagttactgcctgtgaagaaatttgaaagtgagattctggaagcaatcagccaaaattcagttgtcattattagaggggctactggatgtgggaaaaccacacaggttccccagttcattctagatgactttatccagaatgaccgagcagcagagtgtaacatcgtagtaactcagcccagaagaatcagtgcggtttctgtggcagagcgagttgcatttgaaagaggagaagagcctggaaaaagctgtggctacagcgttcgatttgagtctatacttcctcgtcctcatgccagtataatgttttgtactgtaggtgtgctcctgagaaaattagaagcaggcattcgaggaatcagtcatgtaattgtagatgaaatacatgaaagagatattaatactgacttccttttggtagtactgcgtgatgttgttcaggcttatcctgaagttcgcattgttcttatgtctgctactattgataccagcatgttttgtgaatatttcttcaattgccccatcattgaagtttatgggaggacttacccagttcaagaatattttctggaagactgcattcagatgacccactttgttcctccaccaaaagacaaaaagaagaaggataagaaaaagaag

SEQ ID NO: 7944 - DNA, 1649 bp, Homo sapiens
ccttttttgcagtctcaggacgggcgctttggagccggccccaggcagcgtgtgtcggtcgcctagtctggagaactagtcctcgactcacggtgagggaatggaccgacacgggtattgtaccgctgagggaaaggagcgggactccggacctccaggagtgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttccccatggccttcctcctcgctttgtgatgcaggtgaagacattcagtgaagcttgcctgatggtaaggaaaccagccctagaacttctgcattacctgaaaaacaccagttttgcttatccagctatacgatatcttctgtatggagagaagggaacaggaaaaaccctaagtctttgccatgttattcatttctgtgcaaaacaggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagataaaagttcaagagaagtatgtctggaataagagagaaagcactgagaaagggagtcctctgggagaagtggttgaacagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattggcatggaggcgccattgtgtcggctttgagccagactgggtctctctttaagccccggaaagcctatctgccccaggagttgctgggaaaggaaggatttgatgccctggatccctttattcccatcctggtttccaactataacccaaaggaatttgaaagttgtattcagtattatttggaaaacaattggcttcaacatgagaaagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggattggacaggactgcagttggctctggacctgcattaaaatgggtttcactgtgaatgcgtgacaataagatattcccttgttcctaaaactttatatcagtttattggatgtggtttttcacatttaagataattatggctcttttcctaaaaaataaaatatctttct

SEQ ID NO: 7945 - DNA, 2089 bp, Homo sapiens
gtcgtttcctgccggatgacccgacccttttttgcagtctcaggacgggcgctttggagccggccccaggcagcgtgtgtcggtcgcctagtctggagaactagtcctcgactcacgtgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttccccatggccttcctcctcgctttgtgatgcaggtgaagacattcagtgaagcttgcctgatggtaaggaaaccagccctagaacttctgcattacctgaaaaacaccagttttgcttatccagctatacgatatcttctgtatggagagaagggaacaggaaaaaccctaagtctttgccatgttattcatttctgtgcaaaacaggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagataaaagttcaagagaagtatgtctggaataagagagaaagcactgagaaagggagtcctctgggagaagtggttgaacagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattggcatggaggcgccattgtgtcggctttgagccagactgggtctctctttaagccccggaaagcctatctgccccaggagttgctgggaaaggaaggatttgatgccctggatccctttattcccatcctggtttccaactataacccaaaggaatttgaaagttgtattcagtattatttggaaaacaattggcttcaacatgagaaagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggattggacaggactgcagttggctctggacctgcattaaaatgggtttcactgtgaatgcgtgacaataagatattcccttgttcctaaaactttatatcagtttattggatgtggtttttcacatttaagataattatggctcttttcctaaaaaataaaatatctttctaaagtgttgtgttagattaataatatggaaggagtctttagattggccaaattgcatttctctgatattcctcttgttgcaggtcagaagagatcaattctacagaaatttccagtggttctgttgaggctttatggaattcagcatgtcaaaattcacagctggctgggcacagtggctcatgcctgtaatcccagcactttggaagcccaaggcgggcagactgcttgagttcaggagtttgcaaccagcctgggcaacatggtgaaaacctgtctctactaaaaatacaaaaattagccgggcacggtggcatgcgcctgtaatccaagctacttgggaggctgaggcaggagaattgcttcaacttgggaggcggatgttgcagtgagccaaaattgcaccactgcactccagcctgggcagcagagcaagactccgtctcaaaataaataaataaataaataaataaataaataataaa

SEQ ID NO: 7946 - DNA, 1470 bp, Homo sapiens
gcagtctcaggacgggcgctttggagccggccccaggcagcgtgtgtcggtcgcctagtctggagaactagtcctcgactcacgtgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggtgaagacattcagtgaagcttgcctgatggtaaggaaaccagccctagaacttctgcattacctgaaaaacaccagttttgcttatccagctatacgatatcttctgtatggagagaagggaacaggaaaaaccctaagtctttgccatgttattcatttctgtgcaaaacaggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagataaaagttcaagagaagtatgtctggaataagagagaaagcactgagaaagggagtcctctgggagaagtggttgaacagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattggcatggaggcgccattgtgtcggctttgagccagactgggtctctctttaagccccggaaagcctatctgccccaggagttgctgggaaaggaaggatttgatgccctggatccctttattcccatcctggtttccaactataacccaaaggaatttgaaagttgtattcagtattatttggaaaacaattggcttcaacatgagaaagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggattggacaggactgcagttggctctggacctgcattaaaatgggtttcactgtgaatgcgtgacaataagatattcccttgttcctaaaactttatatcagtttattggatgtggtttttcacatttaagataattatggctcttttcctaaaaaataaaatatctttct

SEQ ID NO: 7947 - DNA, 1449 bp, Homo sapiens
gcagtctcaggacgggcgctttggagccggccccaggcagcgtgtgtcggtcgcctagtctggagaactagtcctcgactcacgtgcaaggatgatgctgaaaggaataacaaggcttatctctaggatccataaggccaagcatggggatcagcacgagggtcagcactacaacatctccccccaggatttggagactgtatttccccatggccttcctcctcgctttgtgatgcaggtgaagacattcagtgaagcttgcctgatggtaaggaaaccagccctagaacttctgcattacctgaaaaacaccagttttgcttatccagctatacgatatcttctgtatggagagaagggaacaggaaaaaccctaagtctttgccatgttattcatttctgtgcaaaacaggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagataaaagttcaagagaagtatgtctggaataagagagaaagcactgagaaagggagtcctctgggagaagtggttgaacagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattggcatggaggcgccattgtgtcggctttgagccagactgggtctctctttaagccccggaaagcctatctgccccaggagttgctgggaaaggaaggatttgatgccctggatccctttattcccatcctggtttccaactataacccaaaggaatttgaaagttgtattcagtattatttggaaaacaattggcttcaacatgagaaagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggattggacaggactgcagttggctctggacctgcattaaaatgggtttcactgtgaatgcgtgacaataagatattcccttgttcctaaaactttatatcagtttattggatgtggtttttcacatttaagataattatggctcttttcctaaaaaataaaatatctttct

SEQ ID NO: 7948 - DNA, 1256 bp, Homo sapiens
gggaaattaagtttcttgcggagtacggtggggattgcagctgctgagcagggattctggaaagcattgcgtacctgagcccccagcatggcgggcctaaagcggcgggcaagccaggtgtggccagaagagcatggtgagcaggaacatgggctgtacagcctgcaccgcatgtttgacatcgtgggcactcatctgacacacagagatgtgcgcgtgctttctttcctctttgttgatgtcattgatgaccacgagcgtggactcatccgaaatggacgtgacttcttattggcactggagcgccagggccgctgtgatgaaagtaactttcgccaggtgctgcagctgctgcgcatcatcactcgccacgacctgctgccctacgtcaccctcaagaggagacgggctgtgtgccctgatcttgtagacaagtatctggaggagacatcaattcgctatgtgacccccagagccctcagtgatccagaaccaaggcctccccagccctctaaaacagtgcctccccactatcctgtggtgtgttgccccacttcgggtcctcagatgtgtagcaagcggccagcccgagggagagccacacttgggagccagcgaaaacgccggaagtcagtgacaccagatcccaaggagaagcagacatgtggtgaggaagttcaagggttccagagatggagcagacttgaaggagaatataaagaactgctgggacactgggcagtttatgctattcagtacatcagactgcgggttcgggctgaatactgccagcatgagactgctctgcagggcaatgtcttctctaacaagcaggacccacttgagcgccagtttgagcgctttaaccaggccaacaccatcctcaagtcccgggacctgggctccatcatctgtgacatcaagttctctgagctcacctacctcgatgcattctggcgtgactacatcaatggctctttattagaggcacttaaaggtgtcttcatcacagactccctcaagcaagctgtgggccatgaagccatcaagctgctggtaaatgtagacgaggaggactatgagctgggccgacagaaactcctgaggaacttgatgctgcaagcattgccctgacctattccctcttctcactttggggactgttcccatcacccacctctggagcttacactgttctggggtttgttctctacccttccaaccaatcacacccctgccttttttttttttttttt

SEQ ID NO: 7949 - DNA, 2345 bp, Homo sapiens
cacggccgcggcggcggcggcggcggcggctgctggagcccggatgcggcgccgtgaggcaggcccgggagagcggcgcggatggatccaacatggcggcgccgagcctgagccgagagaagagacctgggaaattaagtttcttgcggagtacggtggggattgcagctgctgagcagggattctggaaagcattgcgtacctgagcccccagcatggcgggcctaaagcggcgggcaagccaggtgtggccagaagagcatggtgagcaggaacatgggctgtacagcctgcaccgcatgtttgacatcgtgggcactcatctgacacacagagatgtgcgcgtgctttctttcctctttgttgatgtcattgatgaccacgagcgtggactcatccgaaatggacgtgacttcttattggcactggagcgccagggccgctgtgatgaaagtaactttcgccaggtgctgcagctgctgcgcatcatcactcgccacgacctgctgccctacgtcaccctcaagaggagacgggctgtgtgccctgatcttgtagacaagtatctggaggagacatcaattcgctatgtgacccccagagccctcagtgatccagaaccaaggcctccccagccctctaaaacagtgcctccccactatcctgtggtgtgttgccccacttcgggtcctcagatgtgtagcaagcggccagcccgagggagagccacacttgggagccagcgaaaacgccggaagtcagtgacaccagatcccaaggagaagcagacatgtgacatcagactgcgggttcgggctgaatactgccagcatgagactgctctgcagggcaatgtcttctctaacaagcaggacccacttgagcgccagtttgagcgctttaaccaggccaacaccatcctcaagtcccgggacctgggctccatcatctgtgacatcaagttctctgagctcacctacctcgatgcattctggcgtgactacatcaatggctctttattagaggcacttaaaggtgtcttcatcacagactccctcaagcaagctgtgggccatgaagccatcaagctgctggtaaatgtagacgaggaggactatgagctgggccgacagaaactcctgaggaacttgatgctgcaagcattgccctgacctattccctcttctcactttggggactgttcccatcacccacctctggagcttacactgttctggggtttgttctctacccttccaaccaatcacacccctgcctttttttttttttttttaaagaaaaagacaaaagaaagtggaagtggtattccccacccctccctgcacccatgtgcctgggcttcccctttatttcccttttccatttaccccgtaatgtgtctctacagctaccttaccactgagccgtaagacaaatgtataggaagaagcaaagtctacagcacatagtctttgtaagggattgatgtgaacacttttttttggatgcactaaggagttatcaatacttctggctttatgagagctcttaaattttgtctaaaaaaccaaagggctgtgagtaagggagctatgtggaaagtgggactctgaagtgtattttgaaaattaatcgccaccctcttccaaattatagaattttttaaaaacaagctgtggccctttccactctctcctggcctctggtgctgctcctctctgccgcctttcctccattccatggcttgaaacctctgcctgatgtggctccttcctttttcccatttgtcaaaccctcttcaaaggaggaacagataagactgggtcagcctagtcatgcctcccaactgtggtggtatatgtgtacacacatacacagggtggatggagaagaggttgctgattaaaatacactccccctataaaggggaagggggagtgtgacactttctttccatgttcaagtgaaaataaataatgtaccctgcagcccttttcccctttgctttcttctggcttgggcaaagggcatcataggtgtaagtgaagtaattcctttttccttccccctcctccactcctacgcccactcccatgcttgggagaatggggctgggacatgcactgagtgttgcacttttatttaggtagggaggcatgttgaatgagccaggaggtctagaactggagcttagtccagctggtacaataccaactccccttctagttcccaaaggcgatgtccagacacagactttatgattattatatttttcaatgccagtgctgctcagccctcagcagaacttcagtttccatgaaataaacaatgactatataaaattc

SEQ ID NO: 7950 - DNA, 2452 bp, Homo sapiens
cgcccgcctgtcccctcccccacggccgcggcggcggcggcggcggcggctgctggagcccggatgcggcgccgtgaggcaggcccgggagagcggcgcggatggatccaacatggcggcgccgagcctgagccgagagaagagacctgggaaattaagtttcttgcggagtacggtggggattgcagctgctgagcagggattctggaaagcattgcgtacctgagcccccagcatggcgggcctaaagcggcgggcaagccaggtgtggccagaagagcatggtgagcaggaacatgggctgtacagcctgcaccgcatgtttgacatcgtgggcactcatctgacacacagagatgtgcgcgtgctttctttcctctttgttgatgtcattgatgaccacgagcgtggactcatccgaaatggacgtgacttcttattggcactggagcgccagggccgctgtgatgaaagtaactttcgccaggtgctgcagctgctgcgcatcatcactcgccacgacctgctgccctacgtcaccctcaagaggagacgggctgtgtgccctgatcttgtagacaagtatctggaggagacatcaattcgctatgtgacccccagagccctcagtgatccagaaccaaggcctccccagccctctaaaacagtgcctccccactatcctgtggtgtgttgccccacttcgggtcctcagatgtgtagcaagcggccagcccgagggagagccacacttgggagccagcgaaaacgccggaagtcagtgacaccagatcccaaggagaagcagacatgtggtgaggaagttcaagggttccagagatggagcagacttgaaggagaatataaagaactgctgggacactgggcagtttatgctattcagtacatcagactgcgggttcgggctgaatactgccagcatgagactgctctgcagggcaatgtcttctctaacaagcaggacccacttgagcgccagtttgagcgctttaaccaggccaacaccatcctcaagtcccgggacctgggctccatcatctgtgacatcaagttctctgagctcacctacctcgatgcattctggcgtgactacatcaatggctctttattagaggcacttaaaggtgtcttcatcacagactccctcaagcaagctgtgggccatgaagccatcaagctgctggtaaatgtagacgaggaggactatgagctgggccgacagaaactcctgaggaacttgatgctgcaagcattgccctgacctattccctcttctcactttggggactgttcccatcacccacctctggagcttacactgttctggggtttgttctctacccttccaaccaatcacacccctgcctttttttttttttttttaaagaaaaagacaaaagaaagtggaagtggtattccccacccctccctgcacccatgtgcctgggcttcccctttatttcccttttccatttaccccgtaatgtgtctctacagctaccttaccactgagccgtaagacaaatgtataggaagaagcaaagtctacagcacatagtctttgtaagggattgatgtgaacacttttttttggatgcactaaggagttatcaatacttctggctttatgagagctcttaaattttgtctaaaaaaccaaagggctgtgagtaagggagctatgtggaaagtgggactctgaagtgtattttgaaaattaatcgccaccctcttccaaattatagaattttttaaaaacaagctgtggccctttccactctctcctggcctctggtgctgctcctctctgccgcctttcctccattccatggcttgaaacctctgcctgatgtggctccttcctttttcccatttgtcaaaccctcttcaaaggaggaacagataagactgggtcagcctagtcatgcctcccaactgtggtggtatatgtgtacacacatacacagggtggatggagaagaggttgctgattaaaatacactccccctataaaggggaagggggagtgtgacactttctttccatgttcaagtgaaaataaataatgtaccctgcagcccttttcccctttgctttcttctggcttgggcaaagggcatcataggtgtaagtgaagtaattcctttttccttccccctcctccactcctacgcccactcccatgcttgggagaatggggctgggacatgcactgagtgttgcacttttatttaggtagggaggcatgttgaatgagccaggaggtctagaactggagcttagtccagctggtacaataccaactccccttctagttcccaaaggcgatgtccagacacagactttatgattattatatttttcaatgccagtgctgctcagccctcagcagaacttcagtttccatgaaataaacaatgactatataaaa

SEQ ID NO: 7951 - DNA, 2300 bp, Homo sapiens
aggaaagtggagggggaggcggtggcgacgtccagcctgagaacctcaagagagggaggtgacgggacgctgagaggaagagacctgggaaattaagtttcttgcggagtacggtggggattgcagctgctgagcagggattctggaaagcattgcgtacctgagcccccagcatggcgggcctaaagcggcgggcaagccaggtgtggccagaagagcatggtgagcaggaacatgggctgtacagcctgcaccgcatgtttgacatcgtgggcactcatctgacacacagagatgtgcgcgtgctttctttcctctttgttgatgtcattgatgaccacgagcgtggactcatccgaaatggacgtgacttcttattggcactggagcgccagggccgctgtgatgaaagtaactttcgccaggtgctgcagctgctgcgcatcatcactcgccacgacctgctgccctacgtcaccctcaagaggagacgggctgtgtgccctgatcttgtagacaagtatctggaggagacatcaattcgctatgtgacccccagagccctcagtgatccagaaccaaggcctccccagccctctaaaacagtgcctccccactatcctgtggtgtgttgccccacttcgggtcctcagatgtgtagcaagcggccagcccgagggagagccacacttgggagccagcgaaaacgccggaagtcagtgacaccagatcccaaggagaagcagacatgtgacatcagactgcgggttcgggctgaatactgccagcatgagactgctctgcagggcaatgtcttctctaacaagcaggacccacttgagcgccagtttgagcgctttaaccaggccaacaccatcctcaagtcccgggacctgggctccatcatctgtgacatcaagttctctgagctcacctacctcgatgcattctggcgtgactacatcaatggctctttattagaggcacttaaaggtgtcttcatcacagactccctcaagcaagctgtgggccatgaagccatcaagctgctggtaaatgtagacgaggaggactatgagctgggccgacagaaactcctgaggaacttgatgctgcaagcattgccctgacctattccctcttctcactttggggactgttcccatcacccacctctggagcttacactgttctggggtttgttctctacccttccaaccaatcacacccctgcctttttttttttttttttaaagaaaaagacaaaagaaagtggaagtggtattccccacccctccctgcacccatgtgcctgggcttcccctttatttcccttttccatttaccccgtaatgtgtctctacagctaccttaccactgagccgtaagacaaatgtataggaagaagcaaagtctacagcacatagtctttgtaagggattgatgtgaacacttttttttggatgcactaaggagttatcaatacttctggctttatgagagctcttaaattttgtctaaaaaaccaaagggctgtgagtaagggagctatgtggaaagtgggactctgaagtgtattttgaaaattaatcgccaccctcttccaaattatagaattttttaaaaacaagctgtggccctttccactctctcctggcctctggtgctgctcctctctgccgcctttcctccattccatggcttgaaacctctgcctgatgtggctccttcctttttcccatttgtcaaaccctcttcaaaggaggaacagataagactgggtcagcctagtcatgcctcccaactgtggtggtatatgtgtacacacatacacagggtggatggagaagaggttgctgattaaaatacactccccctataaaggggaagggggagtgtgacactttctttccatgttcaagtgaaaataaataatgtaccctgcagcccttttcccctttgctttcttctggcttgggcaaagggcatcataggtgtaagtgaagtaattcctttttccttccccctcctccactcctacgcccactcccatgcttgggagaatggggctgggacatgcactgagtgttgcacttttatttaggtagggaggcatgttgaatgagccaggaggtctagaactggagcttagtccagctggtacaataccaactccccttctagttcccaaaggcgatgtccagacacagactttatgattattatatttttcaatgccagtgctgctcagccctcagcagaacttcagtttccatgaaataaacaatgactatataaaa

SEQ ID NO: 7952 - DNA, 1042 bp, Homo sapiens
atggatccaacatggcggcgccgagcctgagccgagagaagagacctgggaaattaagtttcttgcggagtacggtggggattgcagctgctgagcagggattctggaaagcattgcgtacctgagcccccagcatggcgggcctaaagcggcgggcaagccaggtgtggccagaagagcatggtgagcaggaacatgggctgtacagcctgcaccgcatgtttgacatcgtgggcactcatctgacacacagagatgtgctgcagctgctgcgcatcatcactcgccacgacctgctgccctacgtcaccctcaagaggagacgggctgtgtgccctgatcttgtagacaagtatctggaggagacatcaattcgctatgtgacccccagagccctcagtgatccagaaccaaggcctccccagccctctaaaacagtgcctccccactatcctgtggtgtgttgccccacttcgggtcctcagatgtgtagcaagcggccagcccgagggagagccacacttgggagccagcgaaaacgccggaagtcagtgacaccagatcccaaggagaagcagacatgtgacatcagactgcgggttcgggctgaatactgccagcatgagactgctctgcagggcaatgtcttctctaacaagcaggacccacttgagcgccagtttgagcgctttaaccaggccaacaccatcctcaagtcccgggacctgggctccatcatctgtgacatcaagttctctgagctcacctacctcgatgcattctggcgtgactacatcaatggctctttattagaggcacttaaaggtgtcttcatcacagactccctcaagcaagctgtgggccatgaagccatcaagctgctggtaaatgtagacgaggaggactatgagctgggccgacagaaactcctgaggaacttgatgctgcaagcattgccctgacctattccctcttctcactttggggactgttcccatcacccacctctggagcttacactgttctggggtttgttctctac

SEQ ID NO: 7953 - DNA, 1828 bp, Homo sapiens
gcgatccgctcgtattgaagggggaagagacctgggaaattaagtttcttgcggagtacggtggggattgcagctgctgagcagggattctggaaagcattgcgtacctgagcccccagcatggcgggcctaaagcggcgggcaagccaggtgtggccagaagagcatggtgagcaggaacatgggctgtacagcctgcaccgcatgtttgacatcgtgggcactcatctgacacacagagatgtgcgcgtgctttctttcctctttgttgatgtcattgatgaccacgagcgtggactcatccgaaatggacgtgacttcttattggcactggagcgccagggccgctgtgatgaaagtaactttcgccaggtgctgcagctgctgcgcatcatcactcgccacgacctgctgccctacgtcaccctcaagaggagacgggctgtgtgccctgatcttgtagacaagtatctggaggagacatcaattcgctatgtgacccccagagccctcagtgatccagaaccaaggcctccccagccctctaaaacagtgcctccccactatcctgtggtgtgttgccccacttcgggtcctcagatgtgtagcaagcggccagcccgagggagagccacacttgggagccagcgaaaacgccggaagtcagtgacaccagatcccaaggagaagcagacatgtgacatcagactgcgggttcgggctgaatactgccagcatgagactgctctgcagggcaatgtcttctctaacaagcaggacccacttgagcgccagtttgagcgctttaaccaggccaacaccatcctcaagtcccgggacctgggctccatcatctgtgacatcaagttctctgagctcacctacctcgatgcattctggcgtgactacatcaatggctctttattagaggcacttaaaggtgtcttcatcacagactccctcaagcaagctgtgggccatgaagccatcaagctgctggtaaatgtagacgaggaggactatgagctgggccgacagaaactcctgaggaacttgatgctgcaagcattgccctgacctattccctcttctcactttggggactgttcccatcacccacctctggagcttacactgttctggggtttgttctctacccttccaaccaatcacacccctccctgcacccatgtgcctgggcttcccctttatttcccttttccatttaccccgtaatgtgtctctacagctaccttaccactgagccgtaagacaaatgtataggaagaagcaaagtctacagcacatagtctttgtaagggattgatgtgaacacttttttttggatgcactaaggagttatcaatacttctggctttatgagagctcttaaattttgtctaaaaaaccaaagggctgtgagtaagggagctatgtggaaagtgggactctgaagtgtattttgaaaattaatcgccaccctcttccaaattatagaattttttaaaaacaagctgtggccctttccactctctcctggcctctggtgctgctcctctctgccgcctttcctccattccatggcttgaaacctctgcctgatgtggctccttcctttttcccatttgtcaaaccctcttcaaaggaggaacagataagactgggtcagcctagtcatgcctcccaactgtggtggtatatgtgtacacacatacacagggtggatggagaagaggttgctgattaaaatacactccccctataaaggggaagggggagtgtgacactttctttccatgttcaagtgaaaataaataatgtaccctgc

SEQ ID NO: 7954 - DNA, 2329 bp, Homo sapiens
cgcccgcctgtcccctcccccacggccgcggcggcggcggcggcggcggctgctggagcccggatgcggcgccgtgaggcaggcccgggagagcggcgcggatggatccaacatggcggcgccgagcctgagccgagatacggtggggattgcagctgctgagcagggattctggaaagcattgcgtacctgagcccccagcatggcgggcctaaagcggcgggcaagccaggtgtggccagaagagcatggtgagcaggaacatgggctgtacagcctgcaccgcatgtttgacatcgtgggcactcatctgacacacagagatgtgcgcgtgctttctttcctctttgttgatgtcattgatgaccacgagcgtggactcatccgaaatggacgtgacttcttattggcactggagcgccagggccgctgtgatgaaagtaactttcgccaggtgctgcagctgctgcgcatcatcactcgccacgacctgctgccctacgtcaccctcaagaggagacgggctgtgtgccctgatcttgtagacaagtatctggaggagacatcaattcgctatgtgacccccagagccctcagtgatccagaaccaaggcctccccagccctctaaaacagtgcctccccactatcctgtggtgtgttgccccacttcgggtcctcagatgtgtagcaagcggccagcccgagggagagccacacttgggagccagcgaaaacgccggaagtcagtgacaccagatcccaaggagaagcagacatgtgacatcagactgcgggttcgggctgaatactgccagcatgagactgctctgcagggcaatgtcttctctaacaagcaggacccacttgagcgccagtttgagcgctttaaccaggccaacaccatcctcaagtcccgggacctgggctccatcatctgtgacatcaagttctctgagctcacctacctcgatgcattctggcgtgactacatcaatggctctttattagaggcacttaaaggtgtcttcatcacagactccctcaagcaagctgtgggccatgaagccatcaagctgctggtaaatgtagacgaggaggactatgagctgggccgacagaaactcctgaggaacttgatgctgcaagcattgccctgacctattccctcttctcactttggggactgttcccatcacccacctctggagcttacactgttctggggtttgttctctacccttccaaccaatcacacccctgcctttttttttttttttttaaagaaaaagacaaaagaaagtggaagtggtattccccacccctccctgcacccatgtgcctgggcttcccctttatttcccttttccatttaccccgtaatgtgtctctacagctaccttaccactgagccgtaagacaaatgtataggaagaagcaaagtctacagcacatagtctttgtaagggattgatgtgaacacttttttttggatgcactaaggagttatcaatacttctggctttatgagagctcttaaattttgtctaaaaaaccaaagggctgtgagtaagggagctatgtggaaagtgggactctgaagtgtattttgaaaattaatcgccaccctcttccaaattatagaattttttaaaaacaagctgtggccctttccactctctcctggcctctggtgctgctcctctctgccgcctttcctccattccatggcttgaaacctctgcctgatgtggctccttcctttttcccatttgtcaaaccctcttcaaaggaggaacagataagactgggtcagcctagtcatgcctcccaactgtggtggtatatgtgtacacacatacacagggtggatggagaagaggttgctgattaaaatacactccccctataaaggggaagggggagtgtgacactttctttccatgttcaagtgaaaataaataatgtaccctgcagcccttttcccctttgctttcttctggcttgggcaaagggcatcataggtgtaagtgaagtaattcctttttccttccccctcctccactcctacgcccactcccatgcttgggagaatggggctgggacatgcactgagtgttgcacttttatttaggtagggaggcatgttgaatgagccaggaggtctagaactggagcttagtccagctggtacaataccaactccccttctagttcccaaaggcgatgtccagacacagactttatgattattatatttttcaatgccagtgctgctcagccctcagcagaacttcagtttccatgaaataaacaatgactatataaaa

SEQ ID NO: 7955 - DNA, 2339 bp, Homo sapiens
ggctgcgccacgtcggcgcgcggcggccgcgcccccttaacggcagtggcactcacccggctcgcgcggccccggcgccccacgcgcgcgcgtcgttctcccgcccgctcgctccccggcgctcacacctgagctcactcgcgcacgcccgcccggcccgagaaccgcgccgccgcctcggccccgcggaagccccgccgcgtcatgtcttcgcctcccgaagggaaactagagactaaagctggacacccgcccgccgtgaaagctggtggaatgcgaattgtgcagaaacacccacatacaggagacaccaaagaagagaaagacaaggatgaccaggaatgggaaagccccagtccacctaaacccactgtgttcatctctggggtcatcgcccggggtgacaaagatttccccccggcggctgcgcaggtggctcaccagaagccgcatgcctccatggacaagcatccttccccaagaacccagcacatccagcagccacgcaagtgagcctggagtccaccagcctgccccatggccccggctctgctgcacttggtatttccctgacagagagaaccagcagtttcgcccaaatcctactctgctgggaaatctaaggcaaaaccaagtgctctgtcctttgccttacatttccatatttaaaactagaaacagctccagcccaaaccttgtttatggggagtctggttggatgtcatttgaggatcattgtgcccctagaggtgccattagcagaatttgccaagatccgagaaaaattttagctttagttctatttcagcagtcacctgacgtccttgtctatggtcttaaaaacaagaaggcacacatttgagaagatgagattaaggttaggagaaaacctcagtcattgcatgctttttagtatgggccaataaaatctcaacacctgtgggagagtaagaactaagggaatgagtttgggcggcccctcataaaggaccttagaggcagggaacagcaatgccaaatttccctctctcgtgagatgggggatcctgtgcaggctgatgaggcacccatgagaaaagccgaaaaagcatgcatcttagaaatagcccctcaattccaggagtcaacatgccaaagaatgaggctggagacaggtagctccgagggaggacttctggcatgagatctcggcacggcaagcccagcatcgcctcagcccagacaggctccaccaggagatcaagcaagggctgcctttcaggagtcacctcctgagccacttcagagttctggaagtgaccacggaccagggtggaggaatagacttctagttcattctgggacacttgagccagagagttgaaagcttggaaagaccagataagaaacctgccctttgtctccctagggacatgagacaccacattccatttgtgctagaaaaacctatccactgatgagtctaactgttccaaacgcctcccacctggtgtgcacagctgcctgggtccattgtcacttgggtgcatcaggttgtcctccgatttttagatgagtttcctgtctagagatgtcctagtctgctcactggctggtggcagtagggtaccctgcgtcctcgaaaagccagagggttcacctagtcagacgaaactccagaacagtgcttgtggagggcctgactgtcctgctcacccacagccgatctgctgcaggtcagcaactgtgtcgtgagcagctgccaaccaccagcctttctggtgctgttctccagttcacgtctgccagctggtgagggcagaggcagacctggtcagacccagcgcccctcctccctgagggagcatggcacagcctcacacttgaaagacggtgtttggtttcccatctaatcaacttaagggaagccggcatgtacccttcaaggccctgtcaccacctatttcctgatcagttggtataaactgagggtggcttttagagacccagacttggttggcagcgctgccatggaacaccccagcaagcacctcccagcctgcctttcggagcagcacccaggaggggatgccgcgctccagcaacaccaggtcaggcctgtgcagacccctgccctgccgctgcagaaatccagaagcatccttaatgcttctcagtcttcagccagagggagggctgttatttccagaggtgcgctttttatgtacttttagctagatgtggcatgcatctgtgagctttagatcattaaatccaaaatgtttgcctaaatgagtttatcagttgttaacttcaagaatattaaatgatttataataaagctcctgcatttctctcca

SEQ ID NO: 7956 - DNA, 2603 bp, Homo sapiens
gattgtatgttccaggcctcaatgaggagtccaaacatggagccattcaagcagcagaaggtggaggacttttatgacatcggagaggagctggggagtggccagtttgccatcgtgaagaagtgccgggagaagagcacggggcttgagtatgcagccaagttcatcaagaagcggcagagccgggcgagccggcgcggtgtgagccgggaggagatcgagcgggaggtgagcatcctgcggcaggtgctgcaccacaatgtcatcacgctgcacgacgtctatgagaaccgcaccgacgtggtgctcatccttgagctagtgtctggaggagagctcttcgatttcctggcccagaaggagtcactgagtgaggaggaggccaccagcttcattaagcagatcctggatggggtgaactaccttcacacaaagaaaattgctcactttgatctcaagccagaaaacattatgttgttagacaagaatattcccattccacacatcaagctgattgactttggtctggctcacgaaatagaagatggagttgaatttaagaatatttttgggacgccggaatttgttgctccagaaattgtgaactacgagcccctgggtctggaggctgacatgtggagcataggcgtcatcacctacatcctcttaagtggagcatcccctttcctgggagacacgaagcaggaaacactggcaaatatcacagcagtgagttacgactttgatgaggaattcttcagccagacgagcgagctggccaaggactttattcggaagcttctggttaaagagacccggaaacggctcacaatccaagaggctctcagacacccctggatcacgccggtggacaaccagcaagccatggtgcgcagggagtctgtggtcaatctggagaacttcaggaagcagtatgtccgcaggcggtggaagctttccttcagcatcgtgtccctgtgcaaccacctcacccgctcgctgatgaagaaggtgcacctgaggccggatgaggacctgaggaactgtgagagtgacactgaggaggacatcgccaggaggaaagccctccacccacggaggaggagcagcacctcctaactggcctgacctgcagtggccgccagggaggtctgggcccagcggggctcccttctgtgcagacttttggacccagctcagcaccagcacccgggcgtcctgagcactttgcaagagagatgggcccaaggaattcagaagagcttgcaggcaagccaggagaccctgggagctgtggctgtcttctgtggaggaggctccagcattcccaaagctcttaattctccataaaatgggctttcctctgtctgccatcctcagagtctggggtgggagtgtggacttaggaaaacaatataaaggacatcctcatcatcacggggtgaaggtcagactaaggcagccttcttcacaggctgagggggttcagaaccagcctggccaaaaattacaccagagagacagagtcctccccattgggaacagggtgattgaggaaagtgaaccttgggtgtgagggaccaatcctgtgacctcccagaaccatggaagccaggacgtcaggctgaccaacacctcagaccttctgaagcagcccattgctggcccgccatgttgtaattttgctcatttttattaaacttctggtttacctgatgcttggcttcttttagggctacccccatctcatttcctttagcccgtgtgcctgtaactctgagggggggcacccagtggggtgctgagtgggcagaatctcagaaggtcctcctgaaccgtccgcgcaggcctgcagtgggcctgcctcctccttgcttccctaacaggaaggtgtccagttcaagagaacccacccagagactgggagtggtggctcacgcctataatccctgcgctttggcagtccgaggcaggggaattgcttgaactcaggagttggagaccagcctgggcaacatggcaaaacgcagtctgtacaaaaaatacaaaaaattagccaggtgtaggggtaggcacctggcatcccagctactccaggggctgaggtgacagcattgcttaagcccagaaggtcgaggctgcagtgagctgagatcacgccactgcactccagtctgggtgacagagagagaccatatccaaaaaaaaaaaaagttgccagagacgagtatgcccatgctccctctacctcactgccaccactcctgctgttaggagctgagtgtgtctccctaaaatttctatgttgaagtcttaacccttggtaccacagaatatcactgtatttggagatggggtctttagaaaggcacttaaattaaaatgagctcactgatatgggccccgatgcaatataattggtgtccttataagaaggggaggttaggacacgcaggaaagaccacatgaaggcccaggagtgggagggggaatagccatcgacaaactaagggggcctcagaggaaaccaaccctgctgacacctcaatcttagactctggcctcaaaaattgtaagaaaataaacttctgtcttttaagcca

SEQ ID NO: 7957 - DNA, 1741 bp, Homo sapiens
gaccgcggcagctcagcctcccgccgattgtatgttccaggcctcaatgaggagtccaaacatggagccattcaagcagcagaaggtggaggacttttatgacatcggagaggagctggggagtggccagtttgccatcgtgaagaagtgccgggagaagagcacggggcttgagtatgcagccaagttcatcaagaagcggcagagccgggcgagccggcgcggtgtgagccgggaggagatcgagcgggaggtgagcatcctgcggcaggtgctgcaccacaatgtcatcacgctgcacgacgtctatgagaaccgcaccgacgtggtgctcatccttgagctagtgtctggaggagagctcttcgatttcctggcccagaaggagtcactgagtgaggaggaggccaccagcttcattaagcagatcctggatggggtgaactaccttcacacaaagaaaattgctcactttgatctcaagccagaaaacattatgttgttagacaagaatattcccattccacacatcaagctgattgactttggtctggctcacgaaatagaagatggagttgaatttaagaatatttttgggacgccggaatttgttgctccagaaattgtgaactacgagcccctgggtctggaggctgacatgtggagcataggcgtcatcacctacatcctcttaagtggagcatcccctttcctgggagacacgaagcaggaaacactggcaaatatcacagcagtgagttacgactttgatgaggaattcttcagccagacgagcgagctggccaaggactttattcggaagcttctggttaaagagacccggaaacggctcacaatccaagaggctctcagacacccctggatcacgccggtggacaaccagcaagccatggtgcgcagggagtctgtggtcaatctggagaacttcaggaagcagtatgtccgcaggcggtggaagctttccttcagcatcgtgtccctgtgcaaccacctcacccgctcgctgatgaagaaggtgcacctgaggccggatgaggacctgaggaactgtgagagtgacactgaggaggacatcgccaggaggaaagccctccacccacggaggaggagcagcacctcctaactggcctgacctgcagtggccgccagggaggtctgggcccagcggggctcccttctgtgcagacttttggacccagctcagcaccagcacccgggcgtcctgagcactttgcaagagagatgggcccaaggaattcagaagagcttgcaggcaagccaggagaccctgggagctgtggctgtcttctgtggaggaggctccagcattcccaaagctcttaattctccataaaatgggctttcctctgtctgccatcctcagagtctggggtgggagtgtggacttaggaaaacaatataaaggacatcctcatcatcacggggtgaaggtcagactaaggcagccttcttcacaggctgagggggttcagaaccagcctggccaaaaattacaccagagagacagagtcctccccattgggaacagggtgattgaggaaagtgaaccttgggtgtgagggaccaatcctgtgacctcccagaaccatggaagccaggacgtcaggctgaccaacacctcagaccttctgaagcagcccattgctggcccgccatgttgtaattttgctcatttttattaaacttctggtttacctga

SEQ ID NO: 7958 - DNA, 724 bp, Homo sapiens
gaatccagctgctatgtcacgagaactcaagccaccctgtggagaattccacacggagtgcagctgaggcctcccaacaacaaccagcagcaatttgcaaaccatgtgtctcctacagctactggtgtgttttttgcatattggccttccaacatttcttgttgaattatttcaggctcaccttggtcataatgagtggatctggctttacccagggcttcagcctttagcatttcacatgaggaatatccactgagctgggggtcaagaggcctgacctttaatcttggctctgccccaggcaagtgtgaacttgggtaagaacactgaggccaggaaatgttgagtgacgtgtccatactcacatagcatggaagaatcagaggccatggggtcaggacctatgggcttaggatataccggaagaggcctgatttccagtcgagcatttgccaaaaatcagcagcgtgatttgggattgtatgttccaggcctcaatgaggagtccaaacatggagccattcaagcagcagaaggtggaggacttttatgacatcggagaggagctggggagtggccagtttgccatcgtgaagaagtgccgggagaagagcacggggcttgagtatgcagccaagttcatcaagaagcggcagagccgggcgagccggcgcggtgtgagccgggaggagatcgagcgggaggtgagcatcctgcggcaggt

SEQ ID NO: 7959 - DNA, 2615 bp, Homo sapiens
gacaatatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgagcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatacgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaaaagcttaagttttacacagaaacattaataaacaataaagttcttttcttactgta

SEQ ID NO: 7960 - DNA, 2614 bp, Homo sapiens
gacaatatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgagcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaaagcttaagttttacacagaaacattaataaacaataaagttcttttcttactgta

SEQ ID NO: 7961 - DNA, 2608 bp, Homo sapiens
atatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatacgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaaaagcttaagttttacacagaaacattaataaacaataaagttcttttcttactgta

SEQ ID NO: 7962 - DNA, 2607 bp, Homo sapiens
atatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaaagcttaagttttacacagaaacattaataaacaataaagttcttttcttactgta

SEQ ID NO: 7963 - DNA, 751 bp, Homo sapiens
ggatgtgttcctggcatttgcccagggtccctcccctcccaggggtcccgtgcgacgtgccttggacaaggctttctttatcttcctggccctcttcctgacactgctgatgctggaggctgcttataagctgctgtggttactactatgggcaaagttaggggactggctcctggggacacctcagaaggaggaggagctggaattgtgaccacctttcctataaacatcttctttccccaccaaggagctcacctctggacccagccttgcctccacgagtccctccagcctccctaaacacaacgagcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagct

SEQ ID NO: 7964 - DNA, 371 bp, Homo sapiens
ttggggagagctgggcgctgagtctgaggggaatgctgtggtaccttcctgtccctgaaagggagtggagcggccgggggctgaactgggggagggggatttggcgggaagcgcatctagcggaccggccggacccacggttgggatctaagaggaatcgcgagagcgtagcgcgcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccaga

SEQ ID NO: 7965 - DNA, 751 bp, Homo sapiens; identical to SEQ ID NO: 7963

SEQ ID NO: 7966 - DNA, 371 bp, Homo sapiens; identical to SEQ ID NO: 7964

SEQ ID NO: 7967 - DNA, 702 bp, Homo sapiens
ggtgggagtgggaaggaaggcggagggaaccatgcgaggttctgagaattgcggcgagggtcgcctcgagagacggtttctgaggggctcattctgaggccccatccccttccagcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctc

SEQ ID NO: 7968 - DNA, 702 bp, Homo sapiens; identical to SEQ ID NO: 7967

SEQ ID NO: 7969 - DNA, 2522 bp, Homo sapiens
ggcggagggaaccatgcgaggttctgagaattgcggcgagggtcgcctcgagagacggtttctgaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaagcttaagttttacacagaaacattaataaacaataaagttcttttcttactgta

SEQ ID NO: 7970 - DNA, 2615 bp, Homo sapiens; identical to SEQ ID NO: 7959

SEQ ID NO: 7971 - DNA, 751 bp, Homo sapiens; identical to SEQ ID NO: 7963

SEQ ID NO: 7972 - DNA, 702 bp, Homo sapiens; identical to SEQ ID NO: 7967

SEQ ID NO: 7973 - DNA, 2545 bp, Homo sapiens
gcggtgggagtgggaaggaaggcggagggaaccatgcgaggttctgagaattgcggcgagggtcgcctcgagagacggtttctgagcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaagcttaagttttacacagaaacattaataaacaataaagttcttttcttactgta

SEQ ID NO: 7974 - DNA, 371 bp, Homo sapiens
ttggggagagctgggcgctgagtctgaggggaaagctgtggtaccttcctgtccctgaaagggagtggagcggccgggggctgaactgggggagggggatttggcgggaagcgcatctagcggaccggccggacccacggttgggatctaagaggaatcgcgagagcgtagcgcgcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccaga

SEQ ID NO: 7975 - DNA, 751 bp, Homo sapiens; identical to SEQ ID NO: 7963

SEQ ID NO: 7976 - DNA, 702 bp, Homo sapiens; identical to SEQ ID NO: 7967

SEQ ID NO: 7977 - DNA, 2608 bp, Homo sapiens; identical to SEQ ID NO: 7961

SEQ ID NO: 7978 - DNA, 371 bp, Homo sapiens; identical to SEQ ID NO: 7964

SEQ ID NO: 7979 - DNA, 2152 bp, Homo sapiens
gtgacttccggtccgtagtggggcctgcggtgggagtgggaaggaaggcggagggaaccatgcgaggttctgagaattgcggcgagggtcgcctcgagagacggtttctgagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctcc

SEQ ID NO: 7980 - DNA, 2152 bp, Homo sapiens; identical to SEQ ID NO: 7979

SEQ ID NO: 7981 - DNA, 2152 bp, Homo sapiens
gtgacttccggtccgtagtggggcctgcggtgggagtgggaaggaaggcggagggaaccatgcgaggttctgagaattgcggcgagggtcgcctcgagagacggtttctgagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatacgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctcc

SEQ ID NO: 7982 - DNA, 2152 bp, Homo sapiens; identical to SEQ ID NO: 7981

SEQ ID NO: 7983 - DNA, 2392 bp, Homo sapiens
aatgctacttgtaaacaaggctagaaagggtggagaatgaaatgagatggggggtggggaaacaaaccctttagttacaatatcttagggaaatgaatctacaataagacaaatttcaaatcaagttgctccactatactgcataagcagtttagaatcttaagcagatgcaaaaagaataaagcaaatgggaggaaaaaaaaggccgataaagtttctggctacaatacaagagacatatcattaccatatgatctaatgtgggtgtcagccggattgtgttcattgagggaaaccttattttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaattactattgtatacaagcttaattgttaatattccctaaacacaattttatgaagggagaagacattggtttgttgacaataacagtacatcttttcaagttctcagctatttcttctacctctccctatcttacatttgagtatggtaacttatgtcatctatgttgaatgtaagcttataaagcacaaagcatacatttcctgactggtctagagaactgatgtttcaatttacccctctgctaaataaatattaaaactatcatgtgacttcatgtaa

SEQ ID NO: 7984 - DNA, 1960 bp, Homo sapiens
gaatctacaataagacaaatttcaaatcaagttgctccactatactgcataagcagtttagaatcttaagcagatgcaaaaagaataaagcaaatgggaggaaaaaaaaggccgataaagtttctggctacaatacaagagacatatcattaccatatgatctaatgtgggtgtcagccggattgtgttcattgagggaaaccttattttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttggaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaattactattgtatacaagcttaattgttaatattccctaaacacaattttatgaagggagaagacattggtttgttgacaataacagtacatcttttcaagttctcagctatttcttctacctctccctatcttacatttgagtatggtaacttatgtcatctatgttgaatgtaagcttataaagcacaaagcatacatttcctgactggtctagagaactgatgtttcaatttacccctctgctaaataaatattaaaactatcatgtg

SEQ ID NO: 7985 - DNA, 1726 bp, Homo sapiens
gaatctacaataagacaaatttcaaatcaagttgctccactatactgcataagcagtttagaatcttaagcagatgcaaaaagaataaagcaaatgggaggaaaaaaaaggccgataaagtttctggctacaatacaagagacatatcattaccatatgatctaatgtgggtgtcagccggattgtgttcattgagggaaaccttattttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaattactattgtatacaagcttaattgttaatattccctaaacacaattttatgaagggagaagacattggtttgttgacaataacagtacatcttttcaagttctcagctatttcttctacctctccctatcttacatttgagtatggtaacttatgtcatctatgttgaatgtaagcttataaagcacaaagcatacatttcctgactggtctagagaactgatgtttcaatttacccctctgctaaataaatattaaaactatcatgtg

SEQ ID NO: 7986 - DNA, 2133 bp, Homo sapiens
ggaataataagacacgccctgaaggagtacatcgtctagtgagggacagaccaagcacgcaaaacaaattgcaatataatgtgataagttctttaaaagaggtaagagcaacgtgctttgggagcagagaagagggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaattactattgtatacaagcttaattgttaatattccctaaacacaattttatgaagggagaagacattggtttgttgacaataacagtacatcttttcaagttctcagctatttcttctacctctccctatcttacatttgagtatggtaacttatgtcatctatgttgaatgtaagcttataaagcacaaagcatacatttcctgactggtctagagaactgatgtttcaatttacccctctgctaaataaatattaaaactatcatgtg

SEQ ID NO: 7987 - DNA, 753 bp, Homo sapiens
atgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttggaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaa

SEQ ID NO: 7988 - DNA, 1438 bp, Homo sapiens
atgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaattactattgtatacaagcttaattgttaatattccctaaacacaattttatgaagggagaagacattggtttgttgacaataacagtacatcttttcaagttctcagctatttcttctacctctccctatcttacatttgagtatggtaacttatgtcatctatgttgaatgtaagcttataaagcacaaagcatacatttcctgactggtctagagaactgatgtttcaatttacccctctgctaaataaatattaaaactatcatgtg

SEQ ID NO: 7989 - DNA, 519 bp, Homo sapiens
atgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaa

SEQ ID NO: 7990 - DNA, 228 bp, Homo sapiens
atgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggttgtctaccttcataa

SEQ ID NO: 7991 - DNA, 823 bp, Homo sapiens
gagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaa

SEQ ID NO: 7992 - DNA, 750 bp, Homo sapiens
tttctttttctctttctttctttccttttctttcttccttctttctttctttcttccttccttctttctttcttcttttttttaatatgctacaattggataatgactcaaaacagctgtaagattctacttacgaacgtacagctttaatatggattcgtctaagtgtacaattcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatag

SEQ ID NO: 7993 - DNA, 920 bp, Homo sapiens
aacattttctttttgtgggttgttagtgaaacaaccaggcatgttctgctctggagaaaagatttcaaagtgacatctgcattaactgtcgttgctatttattaaatctgcaatgactttgcttcatttttcttttaaacttgtaagacattaaatatgcaaggctagcaagcttgtggtaaaccataaacattgcatttttaatgggaaacagatacaaaaccactccctcagatacaatccaaaggaacaggctgccaaaacaaaagtcttctcttaaagggatactcagtaactgaatgagagtgggctgctagaagaagcttaatgttgaacttaaagtggcagtgtgaataataatctttatgatattttgttaaatgaaaagccacaagcctgtattcaacatgtgctgccttagacacatatcagtagtaaatataaactaagaacaaacatgtaagaaactgaaaaacatttgtttcttctctagagaatctaggcaaaaattcccagaagataccttaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaag

SEQ ID NO: 7994 - DNA, 593 bp, Homo sapiens
attctacatggcaagtagctttgattgtcagggttcaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaac

SEQ ID NO: 7995 - DNA, 648 bp, Homo sapiens
atggttttcaataattgtcctgaactctgctacagactaataaaacttcggtcaagttgcgagcaaaagggattatttggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcat

SEQ ID NO: 7996 - DNA, 1930 bp, Homo sapiens
attttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaagactgattgcttggaacaaatggaataaatcgtcttgtcaataaagtgatggtcaattgagtcatttgtgtgcaaaatattgtgcaaggcccgggtacagaacaaggaataataagacacgccctgaaggagtacatcgtctagtgagggacagaccaagcacgcaaaacaaattgcaatataatgtgataagttctttaaaagaggtaagagcaacgtgctttgggagcagagaagagggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttcca

SEQ ID NO: 7997 - DNA, 6797 bp, Homo sapiens
ctccgccgcaaactttttcctccccatcctgtcgcggctcgaaaggaatggaaaatggcggcctagacgcggagtttcctgcccgacccgcggcggctccggcggcgccatgacgcgctgggtgcccaccaagcgcgaggagaagtacggcgtggctttttataactatgatgccagaggagcggatgaactttctttacagatcggagacactgtgcacatcttagaaacatatgaagggtggtaccgaggttacacgttacgaaaaaagtctaagaagggtatatttcctgcttcatatattcatcttaaagaagcgatagttgaaggaaaagggcaacatgaaacagtcatcccgggtgacctccccctcatccaggaagtcaccacgacactccgagagtggtccaccatctggaggcagctctacgtgcaagataacagggagatgtttcgaagtgtgcggcacatgatctatgaccttattgaatggcgatcacaaattctttctggaactctgcctcaggatgaactcaaagaactgaagaagaaggtcacagccaaaattgattatggaaacagaattctagatttggacctggtggttagagatgaagatgggaatattttggatccagaattaactagcacgattagtctcttcagagctcatgaaatagcttctaaacaagtggaggaaaggttacaagaggaaaaatctcaaaagcagaacatagatattaacagacaagccaagtttgctgcaaccccttctctggccttgtttgtgaacctcaaaaatgtggtttgtaaaataggagaagatgctgaagtcctcatgtctctatatgaccctgtggagtccaaattcatcagtgagaactacctggttcgctggtccagttcaggattacctaaagacatagacagattacataatttgcgagccgtgtttactgacctcggaagcaaagacctgaaaagggagaaaatcagttttgtctgtcagattgttcgcgtgggtcgcatggagctgagggacaacaacaccaggaaactgacctcggggttgcggcgaccttttggagtggctgtgatggatgtaacagatataataaatggaaaagtagatgatgaagataagcagcatttcattccctttcagccggtggcaggggagaatgacttccttcagactgttataaacaaagtcatcgctgccaaagaagtcaaccacaaggggcagggtttgtgggtaacattgaaattacttcctggagatatccatcagatccgaaaagagtttccgcatttagtggacaggaccacagctgtggctcgaaaaacagggtttccggagataatcatgcctggtgatgttcgaaatgatatctatgtaacattagttcaaggagattttgataaaggaagcaaaacaacagcgaagaacgtggaggtcacggtgtctgtgtacgatgaggatgggaaacgattagagcatgtgattttcccgggtgctggtgatgaagcgatttcagagtacaaatctgtgatttactaccaagtaaagcagccacgctggtttgagactgttaaggtggccattcccatcgaggacgttaaccgcagtcaccttcggtttaccttccgccacaggtcatcacaggactctaaggataaatctgagaaaatatttgcactagcatttgtcaagctgatgagatacgatggtaccaccctgcgagacggagagcacgatcttatcgtctataaggccgaagcaaagaagctggaagatgctgccacgtacttgagtctgccctccacgaaggcagagttggaagaaaagggccactcggccaccggcaagagcatgcagagccttgggagctgcaccattagcaaggactccttccagatctccacgctcgtgtgctccaccaaactgactcagaacgtggaccttctggggctcttgaaatggcgctccaacaccagcctgctgcagcagaacttgaggcagctgatgaaagtcgatggtggtgaagtagtgaagtttcttcaggacacgttggatgccctcttcaacatcatgatggagaactcagagagtgagacttttgacacgttagtctttgatgctctggtatttatcattggactgattgctgatagaaaatttcagcattttaatcctgttttggaaacttacattaagaaacactttagtgcaacgttagcctacacgaagttgacaaaagtgttgaagaactacgtggacggtgctgagaagccgggagtaaatgagcagctgtacaaagccatgaaagcgctagaatccatcttcaagttcatcgtgcgctccaggatcctgttcaatcaactgtatgaaaacaagggagaggctgacttcgtggaatctttgctgcagctcttcaggtccatcaatgacatgatgagcagcatgtcagaccagaccgtccgggtgaagggggcagcactgaaatacttaccaacgatcgtcaacgatgtgaaattggtgtttgatcccaaagagctcagcaaaatgtttactgaattcatcctcaatgttcccatgggcttgctgaccatccagaaactctactgcttgatcgaaatcgtccacagtgacctcttcacacagcatgactgcagagagatcctgcttcccatgatgaccgatcagctcaagtaccatctggagagacaggaggacctggaggcctgctgtcagctgctcagccacatcctggaggtgctgtacaggaaggacgtggggccaacccagaggcacgtccagattatcatggagaaacttctccggaccgtgaaccgaaccgtcatttccatgggacgagattctgaactcattggaaacttcgtggcttgcatgacagctattttacgacaaatggaagattaccattatgcccacttgatcaagacttttgggaaaatgaggactgatgtggtagatttcctaatggaaacattcatcatgtttaagaacctcattggaaagaacgtttaccccttcgactgggtgatcatgaacatggtgcaaaataaagtcttcctgcgagcaattaatcagtatgcagatatgctgaacaaaaaatttctggatcaagccaactttgagctacagctgtggaacaactactttcacctggctgttgctttccttactcaagagtccctgcaactggagaatttttcaagtgccaagagagccaaaatccttaacaagtacggagatatgaggagacagattggctttgaaatcagagacatgtggtacaaccttggtcaacacaagataaagttcattccagaaatggtgggcccaatattagaaatgacattaattcccgagacggagctgcgcaaagccaccatccccatcttctttgatatgatgcagtgtgaattccattcgacccgaagcttccaaatgtttgaaaatgagatcatcaccaagctggatcatgaagtcgaaggaggcagaggagacgaacagtacaaagtgttatttgataaaatccttctggaacactgcaggaagcacaaatacctcgccaaaacaggagaaacttttgtaaaactcgttgtgcgcttaatggaaaggcttttggattatagaaccatcatgcacgacgagaacaaagaaaaccgcatgagctgcaccgtcaatgtgctgaatttctacaaagaaattgaaagagaagaaatgtatataaggtatttgtacaagctctgtgacctgcacaaggagtgtgataactacaccgaagcggcttacaccttgcttctccatgcaaagcttcttaagtggtcggaggatgtgtgtgtggcccacctcacccagcgggacgggtaccaggccaccacgcagggacagctgaaggagcagctctaccaggaaatcatccactacttcgacaaaggcaagatgtgggaggaggccattgccttgggcaaggagctagccgagcagtatgagaacgaaatgtttgattatgagcaactcagcgaattgctgaaaaaacaggctcagttttatgaaaacatcgtcaaagtgatcaggcccaagcctgactattttgctgttggctactacggacaagggttccccacattcctgcggggaaaagttttcatttaccgagggaaagagtatgagcgccgggaagattttgaggctcggctcttaactcagtttccaaacgccgagaaaatgaagacaacatctccaccaggcgacgatattaaaaactctcctggccagtatattcagtgcttcacagtgaagcccaaactcgatctgcctcctaagtttcacaggccagtgtcagagcagattgtaagtttttacagggtgaacgaggtccagcgatttgaatattctcggccaatccggaagggagagaaaaacccagacaatgaatttgcgaatatgtggatcgagagaaccatatatacaactgcatataaattacctggaattttaaggtggtttgaggtcaagtctgttttcatggtggaaatcagccccctggagaatgccattgagaccatgcagctgacgaacgacaagatcaacagcatggtgcagcagcacctggatgaccccagcctgcccatcaacccgctctccatgctcctgaacggcatcgtggacccagctgtcatggggggcttcgcaaactacgaaaaggccttctttacagaccggtacctgcaggagcaccctgaggcccatgaaaagatcgagaagctcaaggacctgattgcttggcagattccttttctggccgaagggatcagaatccatggagacaaagtcacggaggcactgaggccgttccacgagaggatggaggcctgtttcaaacagctgaaggaaaaggtggagaaagagtacggcgtccgaatcatgccctcaagtctggatgatagaagaggcagccgcccccggtccatggtgcggtccttcacgatgccttcctcatcccgccctctgtctgtggcctctgtctcttccctctcatcggacagcaccccttccagaccaggctccgacgggtttgccctggagcctctcctgccaaagaaaatgcactccaggtcccaggacaagctggacaaggatgacctggagaaggagaagaaggacaagaagaaggaaaaaaggaacagcaaacatcaagagatatttgagaaagaatttaaacccaccgacatttccctgcagcagtctgaggctgtgatcctttcggaaacgataagtcccctgcggccccagagaccgaagagccaggtgatgaacgtcattggaagcgaaaggcgcttctcggtgtccccctcgtcaccgtcctcccagcaaacaccccctccagttacaccaagggccaagctcagcttcagcatgcagtcgagcttggagctgaacggcatgacgggggcggacgtggccgatgtcccaccccctctgcctctcaaaggcagcgtggcagattacgggaatttgatggaaaaccaggacttgctgggctcgccaacacctccacctccccctccacaccagaggcatctgccacctccactgcccagcaaaactccgcctcctccccctccaaagacaactcgcaagcaggcatcggtggactccgggatcgtgcagtgacgtcgcaagcctctctggaaagagtgtgctgcccctccccatctccatgccctctccttctgtgtcccctgagtctgctgtttacctcattgggcctgtgatgttaacatttcgtgcgactgctttttcttcaaaggagttcagttctcaccatggagtgagtggcctttagcgtcatggagcaaggtgggtctgggaggtagatatgggtccgggatgtgctatcgtagttatcagagttgggggcctctgagtgtgtctggctctgagagagtctgagtcttgcccaaacattctttctttttgtgccaaatgacttgcatttgcaaagagctcaattgctctgagctcagccaagtaggagaggctaggccatcactcttaggaagctgtgtagtgatgatgtataagaatcctcctcactgtcatgggatgttgtatccagcccctccttgttccagccggtggtgtgacttcgttggttgaggtgtgtctccaacctacatcagaccatgaagttcaacccctccagggaagctcctgatttcccctgcataattgaaaataggatatttctcagctattgaacagttactaatttatggggtggaaacagcattaagaatactgaatcaaatggaaaaacaaatgaatacaggaagataagtgttcgttcttttctgaaaaagagtatgtgtaccacaagagctggttttaattgggtgaattgtttttgtcctcattctgtacagaaatttgtatatatgatggttcttagaacttgttttaatttttgtggtccttccgtttattataataggcgtccaccaatgattatccatatgtgttcttaatttttaactgctggaagtgttaaaacacacacacacacacacacacattttttttttgagaactccaaagtcctgaaaattttggtggacaatgatttttaaaaaactaactttgtataacctaatatttgtattctctcatctatatttttttattcactataatcatgatactcttctaatagacttaaaagttaatcattgacaacgaaaaataaaatgttattttaaaagac

SEQ ID NO: 7998 - DNA, 7260 bp, Homo sapiens
aaggttggcgcggggaagaccggcgggaggcgcgccccgggcccgcggcgcgattggcgtgaccggcgatggccggtgagcggacccgcaggttcacccggagcctgttgagacctgggcaggcggccgagctccggcacagcgccgcgtccgccgccgcggtggcagtcagcagccggcagcagcagcggcaagaaaagcctaggcttctcgagcctttggattatgagactgtcattgaagaacttgaaaagacctaccggaatgatcctcttcaagatctcttgttcttccccagtgatgacttttcagcagccacagtttcctgggatatccgcacgttgtactcaacagtacctgaagatgcagagcacaaggcagaaaatttactggttaaggaggcttgtaaattttatagttcccagtggcatgtggtaaactacaaatatgaacaatattctggagacattcgacagctaccccgagcagaatacaaaccagagaagcttccttcacattcctttgagattgaccatgaagatgctgataaggatgaagataccacttcccactcgtcttccaaggggggtggaggagcgggaggaactggtgttttcaagtccggctggctctacaaggggaattttaacagcaccgtgaacaacaccgttactgttcggtcattcaaaaagcgctacttccagctgactcagttaccagataactcctacattatgaacttttacaaagatgagaaaatatccaaagaacccaaaggatgcatctttttggattcctgtacaggagtggtgcagaataacagactaagaaaatatgcctttgaattgaaaatgaatgatctgacctattttgtgctggcagctgaaacagagtcagatatggatgaatggatccacaccctcaaccgcattctgcaaatcagtcctgaggggcccctccaagggaggaggagcacagagctcactgatctgggtctggattcgctggataattctgtaacttgtgaatgcacgccagaggaaacagattcttcagagaacaacctacacgcagactttgcaaagtacctcacagaaacagaagatactgtaaaaacaactcgaaacatggagaggctaaatctgttctctctagatccagacatagataccttgaaacttcaaaaaaaagatctcttggaacctgagtctgtgatcaaaccatttgaagaaaaagctgccaagagaatcatgatcatctgtaaagccctcaactcaaatcttcagggatgtgttacggagaatgaaaatgatccgataacgaatattgagcctttttttgtgagtgtggcactttatgacctcagagacagcaggaagatttctgctgattttcatgtggatctaaaccatgctgctgtcagacagatgctcttgggggcttctgtggctttggaaaatggcaacatcgacaccatcactccaagacaatcagaagaacctcacatcaagggacttccagaggaatggctaaaatttccaaagcaggctgtattttctgtaagcaatccacattctgaaattgttttggtggccaaaatcgaaaaagtcttgatgggaaacattgcaagtggtgccgaaccttatattaagaacccagactccaacaagtatgcacaaaagatactaaaatccaacagacaattctgcagcaaattgggaaaataccgtatgccttttgcttgggcagtaagatcagtatttaaggacaaccagggaaatgtggacagagactcaagattttcaccattgtttagacaagaaagtagcaagatttcaactgaggacctagttaaactagtatcagattatagaagggccgacagaataagcaaaatgcagaccattcctggaagcctggatattgctgttgacaacgttcccttggagcatccaaattgtgtaacatcgtcctttatccctgtcaagcctttcaacatgatggctcaaacagaacccacagtggaggtggaagaatttgtttacgattcaacaaagtattgtcggccttacagagtatataaaaatcaaatttatatttaccccaaacacctcaagtatgatagccagaaatgcttcaacaaggcacggaatataactgtgtgcattgaattcaaaaattcagatgaagaaagtgccaagcccctgaagtgtatttatggaaaacctggagggcccctcttcacctcagccgcctacacagcagttctgcaccactctcagaatccggatttctcagatgaggtgaaaattgagctaccaacacaactccatgagaaacaccatattttgttttctttttatcacgtcacctgtgacatcaatgcaaaagctaatgccaaaaagaaggaggctctggaaacgtcagttggatatgcttggcttcctctgatgaaacacgatcagatagcttctcaagagtacaacatcccaatagcaacaagtctgcctcctaattatttaagctttcaagattctgcaagtggaaagcatggtgggagtgacattaaatgggttgatggtggcaaaccacttttcaaagtgtcgacatttgttgtatcaacagtaaatactcaggatccacatgtgaatgcatttttccaagagtgccaaaaaagagagaaagatatgtctcagtcacctacctcaaatttcatccgctcttgtaagaacttattgaatgtggaaaagattcatgcaatcatgagttttctgcctataattttgaatcagctcttcaaagttctggtacagaatgaggaagatgaaataactacaactgtcaccagggttctgaccgacattgtggccaagtgccatgaggagcagctggatcattctgtccagtcatatattaagttcgtgttcaagaccagggcatgcaaggagaggactgtacatgaggaactggctaaaaatgtgactggtcttttgaaatcaaatgactcaacaacagtaaagcatgtcctaaagcattcctggttcttctttgcaattatcctaaaatcgatggcacagcacttgattgacacaaataaaatccagcttccccggcctcagagatttcctgaatcttaccaaaatgaattggacaatcttgtcatggtcctatccgaccatgtgatttggaaatacaaggatgcacttgaagaaacaagaagggcaaaccacagcgttgccagatttctcaagcgctgctttacatttatggaccgagggtatgtgtttaagatggtcaacaattacatcagcatgttctcctccggtgaccttaagaccttgtgccagtataaatttgattttcttcaagaagtatgtcaacatgaacactttatccctttgtgtctgcccataagatcagcaaacattccagatcctttgacaccttcagaatcgactcaagagttacatgcatcagatatgcctgaatattcagtcacaaatgaattttgtcgcaaacacttcttaatcggaattctgctccgagaagttggctttgccctgcaggaagaccaagatgtcagacacttagctttagctgtcctaaaaaatctaatggctaagcattcatttgatgatcgatacagagagccaagaaagcaggcccagatagcaagtttatacatgcccctgtacggcatgctcctggacaatatgccaaggatttatctgaaggacctgtatccttttactgtcaatacatctaatcaggggtctagagatgatctaagcaccaatggaggatttcaaagccagacagctatcaaacatgcaaactctgtggatacatcattttctaaagatgttttaaattccatagcagcattttcatcaatagctatttctacagtaaaccatgctgactccagagcatctttagcaagtcttgactccaatccaagtaccaatgagaagagcagtgagaagacggacaactgtgaaaagatcccaagacccttgtctttgattggctcaactcttcgatttgacaagttagatcaagcagaaaccaggagtctcctgatgtgttttcttcacattatgaaaacgatttcgtacgagactctgattgcctactggcagagagctcccagcccagaggtgtccgacttcttcagcatcttggacgtttgtcttcaaaatttcagatacctaggaaaacgcaacataataagaaaaattgctgctgcatttaaatttgtgcagtccacccagaacaatggaactctcaaaggatccaatccttcctgccagacatcaggtctcttgtcacaatggatgcactccacttccagtcatgaaggccataagcagcacagatcacaaactttacctataattcgaggcaaaaatgcactttctaaccccaaactcttacagatgttagacaataccatgaccagcaactccaatgaaatagacatcgtgcatcatgtagacactgaggccaatatagctacggaggtttgcctcactattctggacctgttatccctcttcacacagactcatcagagacaactccaacaatgtgactgtcaaaattcattgatgaaaagggtctttgatacctacatgctctttttccaagtcaatcagtcagccacagcgctgaagcatgtgtttgcctccttgagactgtttgtatgcaagtttccttcagcgttctttcaagggcctgctgacctctgtggatcattctgttacgaagtcctaaaatgctgtaaccacaggtcacggtcaactcagacagaagcctcagcccttctgtactttttcatgaggaagaattttgaatttaacaagcagaagtcaattgtccggtcccacttacaactcatcaaagctgtgagccagttaatagccgatgctgggattggaggctctcggtttcaacattcgcttgcaattaccaataatttcgccaatggagataagcaaatgaaaaacagcaatttcccagcagaggtgaaggacctgactaagcgtataaggactgttttgatggccacagctcagatgaaggagcacgagaaggaccccgagatgctggtggatctccagtacagcctggcaaactcctacgcaagcactcctgaactacgcaggacctggctggaaagtatggccaagattcatgccagaaacggagatttatctgaggctgccatgtgttacatccatattgctgctctcattgcagagtatctgaaaagaaagggttactggaaagtggaaaagatttgcacagcatccctgctctcggaggatacccacccctgtgatagcaactcattactaacaactcccagtggaggaagcatgttctctatgggatggccagcttttttgagcattacaccaaacattaaggaagaaggagcgatgaaagaggattctggaatgcaagatacaccatacaatgagaatatcctggtggagcagctatacatgtgtgtggagtttctctggaagtctgagcgatatgaactcattgctgatgtcaacaagcccatcattgctgtctttgagaaacaacgagacttcaaaaaattgtcagatctctactacgacattcatcggtcatatctgaaagtggcagaggtggtgaattcggagaagcggctgtttggtcgctactatcgtgtggcattttatgggcagggcttttttgaagaagaagaaggtaaagagtatatttataaagagcctaagctgacaggtctgtccgagatttcccaaagattactcaagctctatgcagataaatttggagcagacaatgtgaagataatccaggattccaacaaggtaaaccccaaggatttggaccccaaatatgcctacatccaggtgacctatgtgacgccgttctttgaggaaaaggaaatcgaagaccggaagacagatttcgaaatgcaccacaacatcaaccgctttgtcttcgagacacccttcacgctgtcgggcaagaagcacggtggggtggcggagcagtgcaagcggcggacgatcctgacaacgagtcacctgttcccctacgtgaagaagagaatacaagtaattagccaatcgagcacagaactgaatccaattgaagtggcaattgacgagatgtccaagaaggtttctgagcttaatcagctttgcacaatggaagaagtggacatgatcagactgcagctcaaactgcaaggaagtgtcagcgtgaaggttaatgctgggccaatggcctatgcacgagcttttcttgaagaaaccaatgcaaagaagtaccctgacaaccaagtaaagcttttgaaggagatcttcaggcaatttgcagatgcatgtgggcaggcccttgacgtgaatgagcgcctcatcaaagaggaccagctggagtaccaggaagaactgaggtcccactacaaggacatgctcagcgaactctccacagtcatgaatgagcagattacgggcagggacgacctgtcaaagcgcggagtggaccaaacctgcactcgagtaattagcaaagcaactccggccctacccacggtctccatctcatctagtgctgaagtctgagggctctgcagcatcagacccacctctaagagaactttctgaatttgcagctaatctcggggaagagaaagataggtttaatttatttgaagttttcatggtgttaatatttttgtttacctcgctagcttcagaattttgccaacctctgaatttgcacattttgtataatttttttttctttgagcagtgttgatcaagccaggttgaatatttgccatgaaattccagtgaatgtgtagctcaaatgcaaaccctaagtttgctgtcagttattgtatggtcagtaccccagtcctagtacacatattttaaaggttaaagtgaatgtttttgtaacatttaagcatatttcagatgtaaataaaagattgtaaaatatacggtttttaccaaatttaaaagatcctttttagttaatactatgacagtactaaaaatatatgaataacatttcagataccattatattaaaatatttgtgtatgtgtacaaaagcgttgataaatactaatctttaaagtttgtggagttcctttatttgtaatatatgtgctcttaaaagcaatgggatgtgaaattatgaaagtattttattgttcatagaaataaaaaacacagttactttgca

SEQ ID NO: 7999 - DNA, 4257 bp, Homo sapiens
gtcttttgaaatcaaatgactcaacaacagtaaagcatgtcctaaagcattcctggttcttctttgcaattatcctaaaatcgatggcacagcacttgattgacacaaataaaatccagcttccccggcctcagagatttcctgaatcttaccaaaatgaattggacaatcttgtcatggtcctatccgaccatgtgatttggaaatacaaggatgcacttgaagaaacaagaagggcaaaccacagcgttgccagatttctcaagcgctgctttacatttatggaccgagggtatgtgtttaagatggtcaacaattacatcagcatgttctcctccggtgaccttaagaccttgtgccagtataaatttgattttcttcaagaagtatgtcaacatgaacactttatccctttgtgtctgcccataagatcagcaaacattccagatcctttgacaccttcagaatcgactcaagagttacatgcatcagatatgcctgaatattcagtcacaaatgaattttgtcgcaaacacttcttaatcggaattctgctccgagaagttggctttgccctgcaggaagaccaagatgtcagacacttagctttagctgtcctaaaaaatctaatggctaagcattcatttgatgatcgatacagagagccaagaaagcaggcccagatagcaagtttatacatgcccctgtacggcatgctcctggacaatatgccaaggatttatctgaaggacctgtatccttttactgtcaatacatctaatcaggggtctagagatgatctaagcaccaatggaggatttcaaagccagacagctatcaaacatgcaaactctgtggatacatcattttctaaagatgttttaaattccatagcagcattttcatcaatagctatttctacagtaaaccatgctgactccagagcatctttagcaagtcttgactccaatccaagtaccaatgagaagagcagtgagaagacggacaactgtgaaaagatcccaagacccttgtctttgattggctcaactcttcgatttgacaagttagatcaagcagaaaccaggagtctcctgatgtgttttcttcacattatgaaaacgatttcgtacgagactctgattgcctactggcagagagctcccagcccagaggtgtccgacttcttcagcatcttggacgtttgtcttcaaaatttcagatacctaggaaaacgcaacataataagaaaaattgctgctgcatttaaatttgtgcagtccacccagaacaatggaactctcaaaggatccaatccttcctgccagacatcaggtctcttgtcacaatggatgcactccacttccagtcatgaaggccataagcagcacagatcacaaactttacctataattcgaggcaaaaatgcactttctaaccccaaactcttacagatgttagacaataccatgaccagcaactccaatgaaatagacatcgtgcatcatgtagacactgaggccaatatagctacggaggtttgcctcactattctggacctgttatccctcttcacacagactcatcagagacaactccaacaatgtgactgtcaaaattcattgatgaaaagggtctttgatacctacatgctctttttccaagtcaatcagtcagccacagcgctgaagcatgtgtttgcctccttgagactgtttgtatgcaagtttccttcagcgttctttcaagggcctgctgacctctgtggatcattctgttacgaagtcctaaaatgctgtaaccacaggtcacggtcaactcagacagaagcctcagcccttctgtactttttcatgaggaagaattttgaatttaacaagcagaagtcaattgtccggtcccacttacaactcatcaaagctgtgagccagttaatagccgatgctgggattggaggctctcggtttcaacattcgcttgcaattaccaataatttcgccaatggagataagcaaatgaaaaacagcaatttcccagcagaggtgaaggacctgactaagcgtataaggactgttttgatggccacagctcagatgaaggagcacgagaaggaccccgagatgctggtggatctccagtacagcctggcaaactcctacgcaagcactcctgaactacgcaggacctggctggaaagtatggccaagattcatgccagaaacggagatttatctgaggctgccatgtgttacatccatattgctgctctcattgcagagtatctgaaaagaaagggcatgttctctatgggatggccagcttttttgagcattacaccaaacattaaggaagaaggagcgatgaaagaggattctggaatgcaagatacaccatacaatgagaatatcctggtggagcagctatacatgtgtgtggagtttctctggaagtctgagcgatatgaactcattgctgatgtcaacaagcccatcattgctgtctttgagaaacaacgagacttcaaaaaattgtcagatctctactacgacattcatcggtcatatctgaaagtggcagaggtggtgaattcggagaagcggctgtttggtcgctactatcgtgtggcattttatgggcagggtgttggcttttttgaagaagaagaaggtaaagagtatatttataaagagcctaagctgacaggtctgtccgagatttcccaaagattactcaagctctatgcagataaatttggagcagacaatgtgaagataatccaggattccaacaaggtaaaccccaaggatttggaccccaaatatgcctacatccaggtgacctatgtgacgccgttctttgaggaaaaggaaatcgaagaccggaagacagatttcgaaatgcaccacaacatcaaccgctttgtcttcgagacacccttcacgctgtcgggcaagaagcacggtggggtggcggagcagtgcaagcggcggacgatcctgacaacgagtcacctgttcccctacgtgaagaagagaatacaagtaattagccaatcgagcacagaactgaatccaattgaagtggcaattgacgagatgtccaagaaggtttctgagcttaatcagctttgcacaatggaagaagtggacatgatcagactgcagctcaaactgcaaggaagtgtcagcgtgaaggttaatgctgggccaatggcctatgcacgagcttttcttgaagaaaccaatgcaaagaagtaccctgacaaccaagtaaagcttttgaaggagatcttcaggcaatttgcagatgcatgtgggcaggcccttgacgtgaatgagcgcctcatcaaagaggaccagctggagtaccaggaagaactgaggtcccactacaaggacatgctcagcgaactctccacagtcatgaatgagcagctctgtcgaggtccgtgtttatacagcttctgttcctctgtgtctagtatttccctcagtactgtaagcaaaagtgattacgggcagggacgacctgtcaaagcgcggagtggaccaaacctgcactcgagtaattagcaaagcaactccggccctacccacggtctccatctcatctagtgctgaagtctgagggctctgcagcatcagacccacctctaagagaactttctgaatttgcagctaatctcggggaagagaaagataggtttaatttatttgaagttttcatggtgttaatatttttgtttacctcgctagcttcagaattttgccaacctctgaatttgcacattttgtataatttttttttctttgagcagtgttgatcaagccaggttgaatatttgccatgaaattccagtgaatgtgtagctcaaatgcaaaccctaagtttgctgtcagttattgtatggtcagtaccccagtcctagtacacatattttaaaggttaaagtgaatgtttttgtaacatttaagcatatttcagatgtaaataaaagattgtaaaatatacggtttttaccaaatttaaaagatcctttttagttaatactatgacagtactaaaaatatatgaataacatttcagataccattatattaaaatatttgtgtatgtgtacaaaagcgttgataaatactaatctttaaagtttgtggagttcctttatttgtaatatatgtgctcttaaaagcaatgggatgtgaaattatgaaagtattttattgttcatagaaataaaaaacacagttactttgc

SEQ ID NO: 8000 - DNA, 7288 bp, Homo sapiens
atttccctttttaccaagaagaaagatttgttcagcctggtgacgcttcagaagagaagagtttaacgacattgatattttgaaatattttgtgactcaaattatagcaatacgatgagttttcgagggaaggtttttaaacgggagcccagtgaattttggaagaagagacgaactgtgaggagagtaaaccaagaagaaatccacagatttagttctcaagaaaagcctaggcttctcgagcctttggattatgagactgtcattgaagaacttgaaaagacctaccggaatgatcctcttcaagatctcttgttcttccccagtgatgacttttcagcagccacagtttcctgggatatccgcacgttgtactcaacagtacctgaagatgcagagcacaaggcagaaaatttactggttaaggaggcttgtaaattttatagttcccagtggcatgtggtaaactacaaatatgaacaatattctggagacattcgacagctaccccgagcagaatacaaaccagagaagcttccttcacattcctttgagattgaccatgaagatgctgataaggatgaagataccacttcccactcgtcttccaaggggggtggaggagcgggaggaactggtgttttcaagtccggctggctctacaaggggaattttaacagcaccgtgaacaacaccgttactgttcggtcattcaaaaagcgctacttccagctgactcagttaccagataactcctacattatgaacttttacaaagatgagaaaatatccaaagaacccaaaggatgcatctttttggattcctgtacaggagtggtgcagaataacagactaagaaaatatgcctttgaattgaaaatgaatgatctgacctattttgtgctggcagctgaaacagagtcagatatggatgaatggatccacaccctcaaccgcattctgcaaatcagtcctgaggggcccctccaagggaggaggagcacagagctcactgatctgggtctggattcgctggataattctgtaacttgtgaatgcacgccagaggaaacagattcttcagagaacaacctacacgcagactttgcaaagtacctcacagaaacagaagatactgtaaaaacaactcgaaacatggagaggctaaatctgttctctctagatccagacatagataccttgaaacttcaaaaaaaagatctcttggaacctgagtctgtgatcaaaccatttgaagaaaaagctgccaagagaatcatgatcatctgtaaagccctcaactcaaatcttcagggatgtgttacggagaatgaaaatgatccgataacgaatattgagcctttttttgtgagtgtggcactttatgacctcagagacagcaggaagatttctgctgattttcatgtggatctaaaccatgctgctgtcagacagatgctcttgggggcttctgtggctttggaaaatggcaacatcgacaccatcactccaagacaatcagaagaacctcacatcaagggacttccagaggaatggctaaaatttccaaagcaggctgtattttctgtaagcaatccacattctgaaattgttttggtggccaaaatcgaaaaagtcttgatgggaaacattgcaagtggtgccgaaccttatattaagaacccagactccaacaagtatgcacaaaagatactaaaatccaacagacaattctgcagcaaattgggaaaataccgtatgccttttgcttgggcagtaagatcagtatttaaggacaaccagggaaatgtggacagagactcaagattttcaccattgtttagacaagaaagtagcaagatttcaactgaggacctagttaaactagtatcagattatagaagggccgacagaataagcaaaatgcagaccattcctggaagcctggatattgctgttgacaacgttcccttggagcatccaaattgtgtaacatcgtcctttatccctgtcaagcctttcaacatgatggctcaaacagaacccacagtggaggtggaagaatttgtttacgattcaacaaagtattgtcggccttacagagtatataaaaatcaaatttatatttaccccaaacacctcaagtatgatagccagaaatgcttcaacaaggcacggaatataactgtgtgcattgaattcaaaaattcagatgaagaaagtgccaagcccctgaagtgtatttatggaaaacctggagggcccctcttcacctcagccgcctacacagcagttctgcaccactctcagaatccggatttctcagatgaggtgaaaattgagctaccaacacaactccatgagaaacaccatattttgttttctttttatcacgtcacctgtgacatcaatgcaaaagctaatgccaaaaagaaggaggctctggaaacgtcagttggatatgcttggcttcctctgatgaaacacgatcagatagcttctcaagagtacaacatcccaatagcaacaagtctgcctcctaattatttaagctttcaagattctgcaagtggaaagcatggtgggagtgacattaaatgggttgatggtggcaaaccacttttcaaagtgtcgacatttgttgtatcaacagtaaatactcaggatccacatgtgaatgcatttttccaagagtgccaaaaaagagagaaagatatgtctcagtcacctacctcaaatttcatccgctcttgtaagaacttattgaatgtggaaaagattcatgcaatcatgagttttctgcctataattttgaatcagctcttcaaagttctggtacagaatgaggaagatgaaataactacaactgtcaccagggttctgaccgacattgtggccaagtgccatgaggagcagctggatcattctgtccagtcatatattaagttcgtgttcaagaccagggcatgcaaggagaggactgtacatgaggaactggctaaaaatgtgactggtcttttgaaatcaaatgactcaacaacagtaaagcatgtcctaaagcattcctggttcttctttgcaattatcctaaaatcgatggcacagcacttgattgacacaaataaaatccagcttccccggcctcagagatttcctgaatcttaccaaaatgaattggacaatcttgtcatggtcctatccgaccatgtgatttggaaatacaaggatgcacttgaagaaacaagaagggcaaaccacagcgttgccagatttctcaagcgctgctttacatttatggaccgagggtatgtgtttaagatggtcaacaattacatcagcatgttctcctccggtgaccttaagaccttgtgccagtataaatttgattttcttcaagaagtatgtcaacatgaacactttatccctttgtgtctgcccataagatcagcaaacattccagatcctttgacaccttcagaatcgactcaagagttacatgcatcagatatgcctgaatattcagtcacaaatgaattttgtcgcaaacacttcttaatcggaattctgctccgagaagttggctttgccctgcaggaagaccaagatgtcagacacttagctttagctgtcctaaaaaatctaatggctaagcattcatttgatgatcgatacagagagccaagaaagcaggcccagatagcaagtttatacatgcccctgtacggcatgctcctggacaatatgccaaggatttatctgaaggacctgtatccttttactgtcaatacatctaatcaggggtctagagatgatctaagcaccaatggaggatttcaaagccagacagctatcaaacatgcaaactctgtggatacatcattttctaaagatgttttaaattccatagcagcattttcatcaatagctatttctacagtaaaccatgctgactccagagcatctttagcaagtcttgactccaatccaagtaccaatgagaagagcagtgagaagacggacaactgtgaaaagatcccaagacccttgtctttgattggctcaactcttcgatttgacaagttagatcaagcagaaaccaggagtctcctgatgtgttttcttcacattatgaaaacgatttcgtacgagactctgattgcctactggcagagagctcccagcccagaggtgtccgacttcttcagcatcttggacgtttgtcttcaaaatttcagatacctaggaaaacgcaacataataagaaaaattgctgctgcatttaaatttgtgcagtccacccagaacaatggaactctcaaaggatccaatccttcctgccagacatcaggtctcttgtcacaatggatgcactccacttccagtcatgaaggccataagcagcacagatcacaaactttacctataattcgaggcaaaaatgcactttctaaccccaaactcttacagatgttagacaataccatgaccagcaactccaatgaaatagacatcgtgcatcatgtagacactgaggccaatatagctacggaggtttgcctcactattctggacctgttatccctcttcacacagactcatcagagacaactccaacaatgtgactgtcaaaattcattgatgaaaagggtctttgatacctacatgctctttttccaagtcaatcagtcagccacagcgctgaagcatgtgtttgcctccttgagactgtttgtatgcaagtttccttcagcgttctttcaagggcctgctgacctctgtggatcattctgttacgaagtcctaaaatgctgtaaccacaggtcacggtcaactcagacagaagcctcagcccttctgtactttttcatgaggaagaattttgaatttaacaagcagaagtcaattgtccggtcccacttacaactcatcaaagctgtgagccagttaatagccgatgctgggattggaggctctcggtttcaacattcgcttgcaattaccaataatttcgccaatggagataagcaaatgaaaaacagcaatttcccagcagaggtgaaggacctgactaagcgtataaggactgttttgatggccacagctcagatgaaggagcacgagaaggaccccgagatgctggtggatctccagtacagcctggcaaactcctacgcaagcactcctgaactacgcaggacctggctggaaagtatggccaagattcatgccagaaacggagatttatctgaggctgccatgtgttacatccatattgctgctctcattgcagagtatctgaaaagaaagggttactggaaagtggaaaagatttgcacagcatccctgctctcggaggatacccacccctgtgatagcaactcattactaacaactcccagtggaggaagcatgttctctatgggatggccagcttttttgagcattacaccaaacattaaggaagaaggagcgatgaaagaggattctggaatgcaagatacaccatacaatgagaatatcctggtggagcagctatacatgtgtgtggagtttctctggaagtctgagcgatatgaactcattgctgatgtcaacaagcccatcattgctgtctttgagaaacaacgagacttcaaaaaattgtcagatctctactacgacattcatcggtcatatctgaaagtggcagaggtggtgaattcggagaagcggctgtttggtcgctactatcgtgtggcattttatgggcagggcttttttgaagaagaagaaggtaaagagtatatttataaagagcctaagctgacaggtctgtccgagatttcccaaagattactcaagctctatgcagataaatttggagcagacaatgtgaagataatccaggattccaacaaggtaaaccccaaggatttggaccccaaatatgcctacatccaggtgacctatgtgacgccgttctttgaggaaaaggaaatcgaagaccggaagacagatttcgaaatgcaccacaacatcaaccgctttgtcttcgagacacccttcacgctgtcgggcaagaagcacggtggggtggcggagcagtgcaagcggcggacgatcctgacaacgagtcacctgttcccctacgtgaagaagagaatacaagtaattagccaatcgagcacagaactgaatccaattgaagtggcaattgacgagatgtccaagaaggtttctgagcttaatcagctttgcacaatggaagaagtggacatgatcagactgcagctcaaactgcaaggaagtgtcagcgtgaaggttaatgctgggccaatggcctatgcacgagcttttcttgaagaaaccaatgcaaagaagtaccctgacaaccaagtaaagcttttgaaggagatcttcaggcaatttgcagatgcatgtgggcaggcccttgacgtgaatgagcgcctcatcaaagaggaccagctggagtaccaggaagaactgaggtcccactacaaggacatgctcagcgaactctccacagtcatgaatgagcagattacgggcagggacgacctgtcaaagcgcggagtggaccaaacctgcactcgagtaattagcaaagcaactccggccctacccacggtctccatctcatctagtgctgaagtctgagggctctgcagcatcagacccacctctaagagaactttctgaatttgcagctaatctcggggaagagaaagataggtttaatttatttgaagttttcatggtgttaatatttttgtttacctcgctagcttcagaattttgccaacctctgaatttgcacattttgtataatttttttttctttgagcagtgttgatcaagccaggttgaatatttgccatgaaattccagtgaatgtgtagctcaaatgcaaaccctaagtttgctgtcagttattgtatggtcagtaccccagtcctagtacacatattttaaaggttaaagtgaatgtttttgtaacatttaagcatatttcagatgtaaataaaagattgtaaaatatacggtttttaccaaatttaaaagatcctttttagttaatactatgacagtactaaaaatatatgaataacatttcagataccattatattaaaatatttgtgtatgtgtacaaaagcgttgataaatactaatctttaaagtttgtggagttcctttatttgtaatatatgtgctcttaaaagcaatgggatgtgaaattatgaaagtattttattgttcatagaaataaaaaacacagttactttgca

SEQ ID NO: 8001 - DNA, 6097 bp, Homo sapiens
aggaaggaagtggggccctgcggcgcccagccaccccctgacggcttccccacgggaggacgcgaggccccggcccagccatggccccctggcgcaaagctgacaaggagcggcacggcgtggccatatacaacttccaaggcagcggagccccccagctctccctgcagatcggcgatgtggtgcgaatacaggagacgtgtggagactggtataggggatacctcataaagcacaaaatgttacagggcatttttcctaagtcatttatccacatcaaggaagtgacagttgagaaaagaagaaatactgagaacatcattcctgcagaaattcctctggcacaagaagtgacaacgacactttgggaatggggaagcatctggaaacaactctatgtggccagcaaaaaggagcgttttctccaggtgcagtccatgatgtacgatctgatggagtggaggtcccagcttctctcaggaaccttacccaaggatgagctgaaggaactgaagcagaaagtcacgtccaaaattgactatggcaacaaaatccttgagcttgatttgattgtcagagatgaagacggaaatatcttggaccctgataataccagtgtcatcagcttgttccatgcacatgaggaagcaactgataaaatcacagagcgtatcaaagaagaaatgtcaaaagaccagccagattatgcaatgtattcccggatctcctcatcccccacccatagcctctatgtgtttgtgagaaactttgtgtgcagaattggggaagatgctgagctcttcatgtctctctacgaccccaacaagcaaacggtcataagtgagaactacctagtgcgatggggcagccggggcttccctaaggagattgagatgctcaacaatctgaaggtggtcttcacggatcttggaaacaaagacctcaacagggataaaatttacttgatttgtcaaatagtccgggtcggcaagatggatcttaaggatactggtgcaaagaagtgcacgcagggactgaggaggccctttggggtggcagttatggatataacagacatcatcaaggggaaagcagagagtgatgaagaaaagcagcacttcattccttttcacccggttacagctgagaatgacttcctacacagcctgctgggcaaagtcatagcctccaagggggacagtggagggcaaggcctctgggtgaccatgaagatgctggtgggtgacatcattcagattcgcaaggactatccacacctggtggacaggaccaccgtggtggccaggaagctgggattcccagagatcatcatgccaggggatgtcaggaacgacatctacattactctcttacaaggtgactttgacaagtacaacaagaccacacagaggaatgtggaagtcatcatgtgtgtgtgcgcggaggatggcaaaacgctgcctaatgcaatttgcgtgggagcaggggacaagcccatgaatgagtatcgctccgttgtgtactatcaagtcaaacagccacgctggatggaaacagtcaaggtggctgtccctattgaagacatgcagaggatccatctgcgattcatgtttcgacatcggtcatctctggaatctaaagataaaggagaaaagaactttgccatgtcctatgtgaagctgatgaaagaagatgggactactctacacgatggattccatgacttagttgtcctcaagggggacagcaagaagatggaggatgccagcgcatacctgacccttccttcttatcgacaccatgtggaaaacaagggggccacgctgagcaggagctccagcagtgttggggggctttctgtcagctcccgggatgtgttctccatttccaccctggtgtgctccacaaagctcactcagaatgtgggcttgctgggtttgctgaagtggcgtatgaagcctcaactgctacaggagaatttagaaaagttgaagattgtggatggagaggaagtggtgaagtttctccaggatactctggatgccctcttcaacatcatgatggagcattctcaaagtgatgaatatgacatcctcgtctttgatgccttgatttacataataggactcattgcagaccggaaatttcagcatttcaacaccgttctggaggcttacatccaacagcatttcagtgcgaccttggcttacaagaaattgatgacagtgctgaagacttacttggatacctccagcagaggggagcaatgtgagccaatcctaagaacgctgaaggctttggaatatgtgttcaagttcattgttcggtcgaggacattattttcacagctttatgaaggcaaagaacagatggagtttgaagaatccatgagacggctctttgaatccatcaacaatctgatgaaaagtcaatacaaaactaccatccttttgcaggtggcggctttgaaatacatcccatctgtcctgcatgatgtagaaatggtctttgatgcgaagttactcagccaactcctgtatgagttctacacctgcatccctcctgtgaaactccagaagcagaaagtacagtctatgaatgagatagtccagagcaacctctttaaaaagcaagaatgccgggacattctgcttcctgtcatcaccaaagagctgaaggagctgctggagcagaaggatgacatgcaacaccaggtcctggagaggaagtactgcgttgaattgctcaacagcatcttggaagtccttagctaccaggatgcggccttcacctaccaccatatccaggagatcatggtccagctgctgcggacagtgaaccggacagtcatcaccatgggccgggatcacattctgattagtcactttgtggcatgtatgacagccatcttaaaccagatgggtgaccagcactactccttctacattgagaccttccagaccagctctgaacttgtggacttcttgatggagaccttcatcatgttcaaggacctcattggaaagaacgtgtaccctggagactggatggccatgagcatggttcaaaacagggtcttcctgagagctatcaacaagtttgcagaaaccatgaaccagaagttcctagaacacacgaactttgagttccagctgtggaacaactattttcatctggcagtggcttttatcacccaggattctctgcagctggagcagttctcacacgccaaatacaacaaaatcctgaataagtatggggacatgagacggctaattggcttctccatccgtgatatgtggtacaagcttggtcagaacaaaatctgcttcatcccaggcatggtaggacctatattagagatgacacttatccctgaggctgagctccggaaagccaccataccaatcttcttcgacatgatgctgtgtgaatatcaaagaagtggggatttcaaaaagtttgaaaacgaaatcatcctgaagctggaccacgaggtagaagggggccgaggcgacgagcagtacatgcagctcctggagtcaatcctgatggaatgtgctgcagagcacccaaccattgccaagtcggtggagaacttcgtgaacctggtcaaaggcctcctggagaagctgctggattaccggggtgtgatgacagatgagagcaaagacaaccgcatgagctgcaccgtgaacctgctgaatttctacaaagataacaacagggaggagatgtacataaggtacctgtacaaactccgcgatcttcacctggactgtgacaattacacagaggctgcctacacgctccttctccacacctggcttctcaagtggtcggatgagcagtgtgcatcacaggtcatgcagacaggccagcagcacccccagacacaccggcagctgaaggagacgctctacgagaccatcataggctactttgacaaaggaaagatgtgggaagaggccataagtctgtgcaaggagctggcggaacagtacgagatggagatctttgactatgagctgctcagccagaacctgatccagcaggcaaaattctatgaaagcatcatgaaaatcctcaggcccaaaccagactactttgctgttggatactacggccagggattcccctccttcctgcggaacaaagtgttcatctaccgcgggaaggaatatgagcgaagagaagatttccagatgcagctgatgacccagttccccaatgcagagaagatgaacaccacctctgccccgggagatgatgtgaagaatgccccaggccagtatatccagtgcttcactgtccagcctgtcttggatgaacatcccaggttcaagaataagccagtgcctgaccagattataaacttctacaaatccaactacgtgcaaaggttccactactcccggcccgtgcgcagggggaccgtagacccagagaatgagtttgcttccatgtggattgagagaacctccttcgtgactgcatacaagctgccggggatcctgcgctggtttgaggtggtgcacatgtcgcagaccacaattagtcctctggagaatgccatagaaaccatgtccacggccaatgagaagatcctgatgatgataaaccagtaccagagtgatgagaccctccccatcaacccactctccatgctcctgaacgggattgtggaccctgctgtcatgggaggcttcgccaagtatgagaaggccttcttcactgaagagtatgtcagggaccaccctgaggaccaggacaagctgacccacctcaaggacctgattgcatggcagatccccttcttgggagctgggattaagatccatgagaaaagggtgtcagataacttgcgacccttccatgaccggatggaggaatgtttcaagaacctgaaaatgaaggtggagaaggagtacggtgtccgagagatgcctgactttgacgacaggagagtgggccgtcccaggtctatgctgcgctcatacagacagatgtccatcatctctctggcttccatgaattctgactgcagcacccccagcaagcctacctcagagagctttgacctggaattagcatcacccaagacgccgagagtggagcaggaggaaccgatctccccggggagcaccctgcctgaggtcaagctgcggaggtccaagaagaggacaaagagaagcagcgtagtttttgcggatgagaaagcagctgcagagtcggacctgaagcggctttccaggaagcatgagttcatgagtgacaccaacctctcggagcatgcggccatccccctcaaggcgtctgtcctctctcaaatgagctttgccagccagtccatgcctaccatcccagccctggcgctctcagtggcaggcatccctgggttggatgaggccaacacatctccccgcctcagccagaccttcctccaactctcagatggtgacaagaagacactcacacggaagaaggtcaatcagttcttcaagacaatgctggccagcaaatcggctgaagaaggcaaacagatcccagactcgctgtccacggacctgtgagctgctgctgactagggctgcatgggagagccagggaggggagtttctggaagaggaaagccatgcgtggaacatcgaagcctcagagagtgggagactgtccccatcagttgtccttacttagaggagacagagaggccaatcaggtcccagagcttgaatgctaacaagcccagcatcccctggggctgtgatcatggtggatgaggaagcctcaacgtagattcctgaactcaaggtaccagcaagaatgccttctcccagtgtgctctccccaacatcctaggcacagctttcataacccagtttcttaggtgtaagaaactgtttttatctcatttattaagtctcagaacttaacagaaaaggaagccttttaaatattctttttaattttattttagattaacagttttgtactttacatttttttatacaaccaaccagtttcttttctagccaatcatctctgaagagttgctgtttcttactgacaataaaaaatgttctcttggttcgaataa

SEQ ID NO: 8002 - DNA, 2438 bp, Homo sapiens
aggaaggaagtggggccctgcggcgcccagccaccccctgacggcttccccacgggaggacgcgaggccccggcccagccatggccccctggcgcaaagctgacaaggagcggcacggcgtggccatatacaacttccaaggcagcggagccccccagctctccctgcagatcggcgatgtggtgcgaatacaggagacgtgtggagactggtataggggatacctcataaagcacaaaatgttacagggcatttttcctaagtcatttatccacatcaaggaagtgacagttgagaaaagaagaaatactgagaacatcattcctgcagaaattcctctggcacaagaagtgacaacgacactttgggaatggggaagcatctggaaacaactctatgtggccagcaaaaaggagcgttttctccaggtgcagtccatgatgtacgatctgatggagtggaggtcccagcttctctcaggaaccttacccaaggatgagctgaaggaactgaagcagaaagtcacgtccaaaattgactatggcaacaaaatccttgagcttgatttgattgtcagagatgaagacggaaatatcttggaccctgataataccagtgtcatcagcttgttccatgcacatgaggaagcaactgataaaatcacagagcgtatcaaagaagaaatgtcaaaagaccagccagattatgcaatgtattcccggatctcctcatcccccacccatagcctctatgtgtttgtgagaaactttgtgtgcagaattggggaagatgctgagctcttcatgtctctctacgaccccaacaagcaaacggtcataagtgagaactacctagtgcgatggggcagccggggcttccctaaggagattgagatgctcaacaatctgaaggtggtcttcacggatcttggaaacaaagacctcaacagggataaaatttacttgatttgtcaaatagtccgggtcggcaagatggatcttaaggatactggtgcaaagaagtgcacgcagggactgaggaggccctttggggtggcagttatggatataacagacatcatcaaggggaaagcagagagtgatgaagaaaagcagcacttcattccttttcacccggttacagctgagaatgacttcctacacagcctgctgggcaaagtcatagcctccaagggggacagtggagggcaaggcctctgggtgaccatgaagatgctggtgggtgacatcattcagattcgcaaggactatccacacctggtggacaggaccaccgtggtggccaggaagctgggattcccagagatcatcatgccaggggatgtcaggaacgacatctacattactctcttacaaggtgactttgacaagtacaacaagaccacacagaggaatgtggaagtcatcatgtgtgtgtgcgcggaggatggcaaaacgctgcctgtggctgtccctattgaagacatgcagaggatccatctgcgattcatgtttcgacatcggtcatctctggaatctaaagataaaggagaaaagaactttgccatgtcctatgtgaagctgatgaaagaagatgggactactctacacgatggattccatgacttagttgtcctcaagggggacagcaagaagatggaggatgccagcgcatacctgacccttccttcttatcgacaccatgtggaaaacaagggggccacgctgagcaggagctccagcagtgttggggggctttctgtcagctcccgggatgtgttctccatttccaccctggtgtgctccacaaagctcactcagaatgtgggcttgctgggtttgctgaagtggcgtatgaagcctcaactggaagaatccatgagacggctctttgaatccatcaacaatctgatgaaaagtcaatacaaaactaccatccttttgcaggtggcggctttgaaatacatcccatctgtcctgcatgatgtagaaatggtctttgatgcgaagttactcagccaactcctgtatgagttctacacctgcatccctcctgtgaaactccagaagcagaaagtacagtctatgaatgagatagtccagagcaacctctttaaaaagcaagaatgccgggacattctgcttcctgtcatcaccaaagagctgaaggagctgctggagcagaaggatgacatgcaacaccaggtcctggagaggaagtactgcgttgaattgctcaacagcatcttggaagtccttagctaccaggatgcggccttcacctaccaccatatccaggagatcatggtccagctgctgcggacagtgaaccggacagtcatcaccatgggccgggatcacattctgattggagcttgctgcaactgcggattcccatcctccaccccacactctctgattcagtggctttggggctga

SEQ ID NO: 8003 - DNA, 4652 bp, Homo sapiens
aaaagacacagttaacaggcaagcagccatcttatctcctgtctgagccactctttcttccacttttgtcaccctttcaagtcactaccgagcaggctgagcagatgcacttatccaagatgagtagaatgcaatttgcgtgggagcaggggacaagcccatgaatgagtatcgctccgttgtgtactatcaagtcaaacagccacgctggatggaaacagtcaaggtggctgtccctattgaagacatgcagaggatccatctgcgattcatgtttcgacatcggtcatctctggaatggggacagcaagaagatggaggatgccagcgcatacctgacccttccttcttatcgacaccatgtggaaaacaagggggccacgctgagcaggagctccagcagtgttggggggctttctgtcagctcccgggatgtgttctccatttccaccctggtgtgctccacaaagctcactcagaatgtgggcttgctgggtttgctgaagtggcgtatgaagcctcaactgctacaggagaatttagaaaagttgaagattgtggatggagaggaagtggtgaagtttctccaggatactctggatgccctcttcaacatcatgatggagcattctcaaagtgatgaatatgacatcctcgtctttgatgccttgatttacataataggactcattgcagaccggaaatttcagcatttcaacaccgttctggaggcttacatccaacagcatttcagtgcgaccttggcttacaagaaattgatgacagtgctgaagacttacttggatacctccagcagaggggagcaatgtgagccaatcctaagaacgctgaaggctttggaatatgtgttcaagttcattgttcggtcgaggacattattttcacagctttatgaaggcaaagaacagatggagtttgaagaatccatgagacggctctttgaatccatcaacaatctgatgaaaagtcaatacaaaactaccatccttttgcaggtggcggctttgaaatacatcccatctgtcctgcatgatgtagaaatggtctttgatgcgaagttactcagccaactcctgtatgagttctacacctgcatccctcctgtgaaactccagaagcagaaagtacagtctatgaatgagatagtccagagcaacctctttaaaaagcaagaatgccgggacattctgcttcctgtcatcaccaaagagctgaaggagctgctggagcagaaggatgacatgcaacaccaggtcctggagaggaagtactgcgttgaattgctcaacagcatcttggaagtccttagctaccaggatgcggccttcacctaccaccatatccaggagatcatggtccagctgctgcggacagtgaaccggacagtcatcaccatgggccgggatcacattctgattagtcactttgtggcatgtatgacagccatcttaaaccagatgggtgaccagcactactccttctacattgagaccttccagaccagctctgaacttgtggacttcttgatggagaccttcatcatgttcaaggacctcattggaaagaacgtgtaccctggagactggatggccatgagcatggttcaaaacagggtcttcctgagagctatcaacaagtttgcagaaaccatgaaccagaagttcctagaacacacgaactttgagttccagctgtggaacaactattttcatctggcagtggcttttatcacccaggattctctgcagctggagcagttctcacacgccaaatacaacaaaatcctgaataagtatggggacatgagacggctaattggcttctccatccgtgatatgtggtacaagcttggtcagaacaaaatctgcttcatcccaggcatggtaggacctatattagagatgacacttatccctgaggctgagctccggaaagccaccataccaatcttcttcgacatgatgctgtgtgaatatcaaagaagtggggatttcaaaaagtttgaaaacgaaatcatcctgaagctggaccacgaggtagaagggggccgaggcgacgagcagtacatgcagctcctggagtcaatcctgatggaatgtgctgcagagcacccaaccattgccaagtcggtggagaacttcgtgaacctggtcaaaggcctcctggagaagctgctggattaccggggtgtgatgacagatgagagcaaagacaaccgcatgagctgcaccgtgaacctgctgaatttctacaaagataacaacagggaggagatgtacataaggtacctgtacaaactccgcgatcttcacctggactgtgacaattacacagaggctgcctacacgctccttctccacacctggcttctcaagtggtcggatgagcagtgtgcatcacaggtcatgcagacaggccagcagcacccccagacacaccggcagctgaaggagacgctctacgagaccatcataggctactttgacaaaggaaagatgtgggaagaggccataagtctgtgcaaggagctggcggaacagtacgagatggagatctttgactatgagctgctcagccagaacctgatccagcaggcaaaattctatgaaagcatcatgaaaatcctcaggcccaaaccagactactttgctgttggatactacggccagggattcccctccttcctgcggaacaaagtgttcatctaccgcgggaaggaatatgagcgaagagaagatttccagatgcagctgatgacccagttccccaatgcagagaagatgaacaccacctctgccccgggagatgatgtgaagaatgccccaggccagtatatccagtgcttcactgtccagcctgtcttggatgaacatcccaggttcaagaataagccagtgcctgaccagattataaacttctacaaatccaactacgtgcaaaggttccactactcccggcccgtgcgcagggggaccgtagacccagagaatgagtttgcttccatgtggattgagagaacctccttcgtgactgcatacaagctgccggggatcctgcgctggtttgaggtggtgcacatgtcgcagaccacaattagtcctctggagaatgccatagaaaccatgtccacggccaatgagaagatcctgatgatgataaaccagtaccagagtgatgagaccctccccatcaacccactctccatgctcctgaacgggattgtggaccctgctgtcatgggaggcttcgccaagtatgagaaggccttcttcactgaagagtatgtcagggaccaccctgaggaccaggacaagctgacccacctcaaggacctgattgcatggcagatccccttcttgggagctgggattaagatccatgagaaaagggtgtcagataacttgcgacccttccatgaccggatggaggaatgtttcaagaacctgaaaatgaaggtggagaaggagtacggtgtccgagagatgcctgactttgacgacaggagagtgggccgtcccaggtctatgctgcgctcatacagacagatgtccatcatctctctggcttccatgaattctgactgcagcacccccagcaagcctacctcagagagctttgacctggaattagcatcacccaagacgccgagagtggagcaggaggaaccgatctccccggggagcaccctgcctgaggtcaagctgcggaggtccaagaagaggacaaagagaagcagcgtagtttttgcggatgagaaagcagctgcagagtcggacctgaagcggctttccaggaagcatgagttcatgagtgacaccaacctctcggagcatgcggccatccccctcaaggcgtctgtcctctctcaaatgagctttgccagccagtccatgcctaccatcccagccctggcgctctcagtggcaggcatccctgggttggatgaggccaacacatctccccgcctcagccagaccttcctccaactctcagatggtgacaagaagacactcacacggaagaaggtcaatcagttcttcaagacaatgctggccagcaaatcggctgaagaaggcaaacagatcccagactcgctgtccacggacctgtgagctgctgctgactagggctgcatgggagagccagggaggggagtttctggaagaggaaagccatgcgtggaacatcgaagcctcagagagtgggagactgtccccatcagttgtccttacttagaggagacagagaggccaatcaggtcccagagcttgaatgctaacaagcccagcatcccctggggctgtgatcatggtggatgaggaagcctcaacgtagattcctgaactcaaggtaccagcaagaatgccttctcccagtgtgctctccccaacatcctaggcacagctttcataacccagtttcttaggtgtaagaaactgtttttatctcatttattaagtctcagaacttaacagaaaaggaagccttttaaatattctttttaattttattttagattaacagttttgtactttacatttttttatacaaccaaccagtttcttttctagccaatcatctctgaagagttgctgtttcttactgacaataaaaaatgttctcttggttcg

SEQ ID NO: 8004 - DNA, 8455 bp, Homo sapiens
gcggggccgcgcccggcacggccatgtggacccccacggaggaggagaaatacggcgtagtgatatgcagctttcgaggatctgtccctcaagggttggtcttagaaataggagaaacagtccagattcttgaaaaatgtgaaggttggtacagaggagtttcaacaaagaagccaaatgtgaaggggatctttcctgcaaattacattcacttgaaaaaggcaattgtcagtaatagggggcagtatgaaactgtggttccacttgaagattctattgtgactgaggttacagcaactctacaagaatgggcaagtttgtggaaacagttgtatgtgaaacacaaagtagatcttttctacaaactacgccatgtgatgaatgaacttattgacctgcgaaggcagctactgtctggtcacctgactcaggatcaggtgcgggaggttaagcggcacatcaccgtgcgcctggactggggtaatgaacatttgggcctggacctggtgcctcggaaggactttgaagtagtggactcggaccagattagtgtctcagatctctataagatgcatttatctagccggcagagtgtacagcaaagcacatcccaggtagatacaatgcgcccacgtcatggggaaacatgtcggatgccagtgccacatcacttcttcctcagcctgaagagtttcacttacaatactattggggaagataccgatgtcttcttttccttatatgacatgagggaaggcaagcagatcagtgagcggtttctggtaagactgaacaagaatggtgggccgaggaacccagagaagatagaacgaatgtgtgccctttttacagatctgagcagcaaagatatgaagagagatttgtatatcgttgcccatgtgatccgaataggccggatgctcctgaacgactcaaagaaaggtcctcctcacctgcactacaggcgaccatatggctgtgcggtcctaagcatcttggatgtcctacagtcactcacagaagtaaaggaagaaaaggattttgttcttaaggtttacacgtgcaacaacgagagtgagtggtcccagatccacgagaacatcatccgaaagtccagtgccaagtactctgcccccagcgccagccatggtcttatcatttctctgcagcttcttcgtggagacatggaacagattcggagagaaaatcccatgatatttaataggggattggcaattacaagaaaattgggatttcctgatgtcattatgccaggtgatatccgcaatgacctgtacctaaccctggagaagggggatttcgagagaggaggaaagagtgtacaaaagaatattgaagtgaccatgtatgtgctttatgcagatggagaaatcttgaaggattgcatcagcttgggttcaggagagccaaataggagttcctaccactcctttgtcctctaccacagtaatagtcctcgctggggagaaattatcaaattgcctatccccattgaccggttccggggctcccacctgcgctttgagttcagacattgttccacaaaggacaaaggggaaaagaaactctttggctttgcattctcaaccctgatgcgtgatgatggcaccaccctctcagatgatattcacgagctttatgtgtacaagtgtgatgagaatagcacgtttaataaccatgctctgtacctgggcctgccctgctgcaaagaggactacaatggctgccctaatattccttctagcctcatcttccagcgcagcaccaaagagtctttcttcatctccactcagctctcctctaccaaactcacccagaatgtggacctcctagctctgctgaagtggaaagccttccccgaccggatcatggatgtactagggcggctgcggcatgtcagtggggaggaaattgttaagtttctgcaggacatcttagatacactctttgtgattttggatgataatacagagaagtacggcctgttggtttttcagtctctggtgttcatcatcaacctgctccgagacatcaagtattttcactttcgacctgtgatggacacgtatatccagaagcactttgctggagctctggcatacaaggagctcatccgctgtttgaagtggtatatggactgctcagcagaactgattcgacaggaccacattcaagaagctatgcgggccttggagtaccttttcaagttcattgtacagtcacggatcctgtactcacgagccacttgtggaatggaagaggaacaattcagatccagtatccaagaacttttccagtccatccggtttgtgctcagtctggacagccgaaactcagaaacactcctttttactcaggctgcactcctcaattctttcccaaccatctttgatgagcttctgcaaatgttcaccgtgcaagaggtggcagagtttgtgagagggacactggggagcatgcccagcactgtgcacattgggcagtcaatggacgtggtcaagctgcagtccattgccaggacagtggatagccgcctgttttctttctcagaatcccgccgcatcctgcttcctgtggttctccatcacattcaccttcacctgaggcagcagaaagagctgctaatttgctcagggattcttggcagcatcttctccatcgtcaagaccagctctctggaggcagatgtcatggaggaagtagagatgatggtggagagcctcctggacgtgctcttgcagactctgctcaccatcatgagcaaatcgcacgctcaggaggcggtaagagggcagcggtgcccgcagtgcacagccgagatcactggcgagtatgtgtcctgccttctctcactgctccgccagatgtgtgacacccatttccagcacctcctggacaacttccagagcaaagatgaactcaaggaatttctgctgaagattttttgcgtgttccggaacctgatgaagatgagtgtcttccctcgggactggatggtaatgagactgctcacaagcaatattatagtcactactgtccagtacctgtcctctgcactgcacaagaatttcacagagactgactttgactttaaggtgtggaattcttactttagcctggcagttctattcataaatcagccaagccttcagctagaaattatcacctcagccaaaaggaagaagattctagataagtatggggacatgcgtgtaatgatggcctatgaactgttcagcatgtggcagaatttgggtgaacataagatccactttattccgggaatgattggtccttttctgggtgtgacactggtcccacagccagaagtacggaatatcatgattcccatctttcatgacatgatggactgggagcagagaaaaaatggcaacttcaaacaggtggaggccgagttgattgacaagctggacagcatggtgtcagaagggaaaggtgacgagagctacagggagctcttcagcctactaacccagctgtttgggccctaccccagcctgctggagaaggttgaacaagaaacatggcgcgagaccggcatttcctttgtgacctcagtcacccgcctcatggaacgtcttcttgactacagggactgcatgaaaggagaggaaacagagaataagaagataggctgcactgttaacctgatgaatttttacaaatctgagattaacaaggaagaaatgtatatccgctacatccataagctttgtgacatgcacttgcaggccgaaaactacacagaggccgcatttaccctgctcctttactgtgagctgctgcagtgggaggaccggccactacgggaattcctccactacccatcgcagacagagtggcagcggaaggagggactgtgccggaagatcattcactacttcaacaaaggcaagagctgggagtttgggatcccactgtgcagggagctggcgtgtcagtacgagagcctctatgattaccagagcctcagctggattcggaaaatggaggccagctactatgacaacattatggagcagcaacgcctggagcctgagttctttcgggtcggcttctatggcaggaagtttcctttctttcttcggaacaaagaatacgtgtgccgtggccatgactacgagaggctggaggccttccagcagaggatgctcagtgagtttccgcaggctgtcgccatgcagcaccccaaccatcctgatgacgccatcctacagtgcgatgcccagtacttgcagatctatgcagtgacgcccattccagattatgtggatgttctgcagatggatagggtaccagatcgagtcaagagcttctatcgcgtcaacaatgtgaggaagttccggtatgacaggccttttcacaaaggccccaaggacaaggagaatgaattcaagagcctgtggattgaacgtaccacactgaccctgacccacagcttgcctggcatctctcggtggtttgaagtggagaggagggaactggtggaggtgagccctctggagaatgccatccaagtggttgagaataagaaccaggagctacgctccctgatcagccagtatcaacacaagcaggtgcatggcaacattaacctgctaagcatgtgcctgaatggtgtcattgatgcagctgtcaatggaggcattgcacgctatcaggaggccttctttgataaagattacatcaacaagcacccaggagatgctgagaagatcacccagctcaaggagcttatgcaggagcaggttcatgtccttggagttgggctagcagttcatgagaagtttgtgcacccagaaatgcggcctctgcataagaagctaattgatcagttccagatgatgcgggccagtctctaccatgagtttccaggtttggataagctaagtcctgcatgttcaggcaccagcaccccacggggaaatgttctggcatcccatagccccatgagtccggagagcatcaagatgacccaccggcacagccccatgaacttgatgggcacaggccgccattcatcatcctctctctcctcacatgcgtctagtgaagcaggaaacatggtgatgctgggtgacggctccatgggtgatgctcctgaggacctgtaccaccacatgcagctcgcgtatcccaaccccaggtaccaaggctcagtcaccaacgtctctgttctgtcctcgtcccaggcaagcccttcttcctccagcctgagttccactcactcagcaccatcccagatgattacctctgccccttccagtgcccgaggctctccctctctgccagataagtaccgccatgcccgtgaaatgatgttgttgctgcccacataccgggaccgcccaagcagtgccatgtatccagcagccatcctggagaacggacagccgccgaatttccagcgagccctgttccagcaagtggtcggagcctgcaaaccctgcagtgatcccaatctgtctgtggctgaaaaaggtcattactccctacactttgacgccttccaccaccctctgggtgatacccccccagccctccctgcccggaccctgcgcaagtctcctctccaccctatcccagcctcccccacaagcccccagtcaggtctggacggcagcaactctacgctgtccggcagtgccagcagcggcgtgtcctccttgagtgagagtaactttgggcactcctcggaggccccacctcgcactgacaccatggactccatgccaagtcaggcctggaatgctgacgaagatcttgagccaccctacctccctgtccactacagcctctctgagtctgccgtcctggactccatcaaggcccagccatgccgaagccactcagccccagggtgcgtcatccctcaggaccccatggacccgcctgcgctgccgcccaagccctaccacccccgcctgccggccctggagcacgatgagggggtgctgctgcgtgaagagactgagaggcctcgaggcctgcaccgcaaggctccattgcctcctgggagcgctaaggaggagcaggcccgcatggcctgggagcacggccgaggggagcagtgaggggcaacgaggcggctgggatgccgccctcagtaagcagcttgccaatcactccaggtctgaaaagcaagtcccccagccccaccccagggagccagagaggcttgcactcaggagagaaccacccccaagtctccgttctactgccgtgaactcatgtgttgccatgtacagaggccacagcagcatgaagggttgtggcttccctttttatttttttacatttccatttctatgggttttcctttctttcctttatgcagtagatgctttcttcctcctgcagttctggaccatgtggagctacatggagaaattgcacagacagaatcactttgccacactgcagggcccaggagtgggagcccaggccctccctccagggtagagatgcaccgaatggaaattgcactaaggacctcttcctttgctgtatggacagaagagttcatggttgcattcagggattgcaaggaccatatagacatgtcacaggtggaaaaagggccacaagccgttttgcacaaatgcctgcccacctgcccctcttccatccaggagtgtgctactgaggggctggctggaccaacctgctggctcaggcatgtgactggcctaactgcatgcccagggcactgccagggttcaatgggccagccgtctcctactccaccttggatttttctctccatcacatcatttctgaccatttgctcccttccattcttgaaacacctcatgccccacaggagccccagtggtgactggatctgcaagggttatctcccgccctctggggtttgagtggaggtatggagccagagaggctatcctagctaccttcctcctagggggagctggtccccttcctatgtggtagagagactggtgtaagagtgtggggtgtggcaggcgccggaaatcctcaaagctttcagaagcatccagaatgcctaccatcagctcctgaatcagggattttcagcactacctctgagccatggggttggctgcccagccaggcttccaggccctgaggacatgtggtcaggttcagcaggctcctgggtaaagagggtgggagggggcttctccttttggaagcagatagccatgcaggtagaattgtcatctcccaagtggccacatacagcaacccactccaggccatggggaccaccactcagggttcggggctggcaggagggtagtttctccagtctccccagtctgttggtgtctttataggaaactataaagcagagcagtggtgtctttagaggaaactcattcaagtcagggcactgattttcctctcagtttattatttggggggatagggtcaggtgggtatagtagtactttaccagggtgcttttaagttactttaaaaaaagcctacaaaatattttttttcttttatttgctcgagttcacattaatgatggtcacaaggctgccttgttgggcaggcgtattgcccccagttcctcttctgctggcctgtatgacctccacagccaggccctgggcccaagccccttgtcccttctccactgcccctctttccagacagtaaaggccatggtcagtgtgtttttctcttgtaaacaaaccccagcttgtttaacagaaatgctaataacctactgggaaagatggaggtctaaattacctccagggtttttctgggggtttatcaccagtgtgggtcccttctgataccaccaggttcactccaggcagagtggggcggaaggctgctgaggatatgggtcagttacagcagccctcacctcaaagggctggcctgcttctcagcctacattcatttgcaagcttcaatctctggaccatctggtgttcacaggtgttagagggttaggggttaggggctagttttggatttgattcataggtaggagggcttagattttaaggcacttctgaaagtcaatccctggacaaggcagtcatcacataagaacagctaccttctccacttggtggcacaagaggtagggaggggagtatgggttcatttggcttcgcattatgcaaggtgaaaccgtttgttttccctctccattttccctaactaaatgaaaaggacacattctgaaatcccttttgttggagaataagtcagtctgaggggaaatgggaggccagagatgagaaccctttgaaaagattgtaaaatactgattttcattctttcaagcttatttgtaaatacctatttgaatgctgtgtatttgtacaggaatttgagcaaaaaatgtatagagtgtgatgtccaattggtattcagcactataaatgtgtttttaacctcc

SEQ ID NO: 8005 - DNA, 5120 bp, Homo sapiens
atgccaaagtggctagaggaaacagagaataagaagataggctgcactgttaacctgatgaatttttacaaatctgagattaacaaggaagaaatgtatatccgctacatccataagctttgtgacatgcacttgcaggccgaaaactacacagaggccgcatttaccctgctcctttactgtgagctgctgcagtgggaggaccggccactacgggaattcctccactacccatcgcagacagagtggcagcggaaggagggactgtgccggaagatcattcactacttcaacaaaggcaagagctgggagtttgggatcccactgtgcagggagctggcgtgtcagtacgagagcctctatgattaccagagcctcagctggattcggaaaatggaggccagctactatgacaacattatggagcagcaacgcctggagcctgagttctttcgggtcggcttctatggcaggaagtttcctttctttcttcggaacaaagaatacgtgtgccgtggccatgactacgagaggctggaggccttccagcagaggatgctcagtgagtttccgcaggctgtcgccatgcagcaccccaaccatcctgatgacgccatcctacagtgcgatgcccagtacttgcagatctatgcagtgacgcccattccagattatgtggatgttctgcagatggatagggtaccagatcgagtcaagagcttctatcgcgtcaacaatgtgaggaagttccggtatgacaggccttttcacaaaggccccaaggacaaggagaatgaattcaagagcctgtggattgaacgtaccacactgaccctgacccacagcttgcctggcatctctcggtggtttgaagtggagaggagggaactggtggaggtgagccctctggagaatgccatccaagtggttgagaataagaaccaggagctacgctccctgatcagccagtatcaacacaagcaggtgcatggcaacattaacctgctaagcatgtgcctgaatggtgtcattgatgcagctgtcaatggaggcattgcacgctatcaggaggccttctttgataaagattacatcaacaagcacccaggagatgctgagaagatcacccagctcaaggagcttatgcaggagcaggttcatgtccttggagttgggctagcagttcatgagaagtttgtgcacccagaaatgcggcctctgcataagaagctaattgatcagttccagatgatgcgggccagtctctaccatgagtttccaggtttggataagctaagtcctgcatgttcaggcaccagcaccccacggggaaatgttctggcatcccatagccccatgagtccggagagcatcaagatgacccaccggcacagccccatgaacttgatgggcacaggccgccattcatcatcctctctctcctcacatgcgtctagtgaagcaggaaacatggtgatgctgggtgacggctccatgggtgatgctcctgaggacctgtaccaccacatgcagctcgcgtatcccaaccccaggtaccaaggctcagtcaccaacgtctctgttctgtcctcgtcccaggcaagcccttcttcctccagcctgagttccactcactcagcaccatcccagatgattacctctgccccttccagtgcccgaggctctccctctctgccagataagtaccgccatgcccgtgaaatgatgttgttgctgcccacataccgggaccgcccaagcagtgccatgtatccagcagccatcctggagaacggacagccgccgaatttccagcgagccctgttccagcaagtggtcggagcctgcaaaccctgcagtgatcccaatctgtctgtggctgaaaaaggtcattactccctacactttgacgccttccaccaccctctgggtgatacccccccagccctccctgcccggaccctgcgcaagtctcctctccaccctatcccagcctcccccacaagcccccagtcaggtctggacggcagcaactctacgctgtccggcagtgccagcagcggcgtgtcctccttgagtgagagtaactttgggcactcctcggaggccccacctcgcactgacaccatggactccatgccaagtcaggcctggaatgctgacgaagatcttgagccaccctacctccctgtccactacagcctctctgagtctgccgtcctggactccatcaaggcccagccatgccgaagccactcagccccagggtgcgtcatccctcaggaccccatggacccgcctgcgctgccgcccaagccctaccacccccgcctgccggccctggagcacgatgagggggtgctgctgcgtgaagagactgagaggcctcgaggcctgcaccgcaaggctccattgcctcctgggagcgctaaggaggagcaggcccgcatggcctgggagcacggccgaggggagcagtgaggggcaacgaggcggctgggatgccgccctcagtaagcagcttgccaatcactccaggtctgaaaagcaagtcccccagccccaccccagggagccagagaggcttgcactcaggagagaaccacccccaagtctccgttctactgccgtgaactcatgtgttgccatgtacagaggccacagcagcatgaagggttgtggcttccctttttatttttttacatttccatttctatgggttttcctttctttcctttatgcagtagatgctttcttcctcctgcagttctggaccatgtggagctacatggagaaattgcacagacagaatcactttgccacactgcagggcccaggagtgggagcccaggccctccctccagggtagagatgcaccgaatggaaattgcactaaggacctcttcctttgctgtatggacagaagagttcatggttgcattcagggattgcaaggaccatatagacatgtcacaggtggaaaaagggccacaagccgttttgcacaaatgcctgcccacctgcccctcttccatccaggagtgtgctactgaggggctggctggaccaacctgctggctcaggcatgtgactggcctaactgcatgcccagggcactgccagggttcaatgggccagccgtctcctactccaccttggatttttctctccatcacatcatttctgaccatttgctcccttccattcttgaaacacctcatgccccacaggagccccagtggtgactggatctgcaagggttatctcccgccctctggggtttgagtggaggtatggagccagagaggctatcctagctaccttcctcctagggggagctggtccccttcctatgtggtagagagactggtgtaagagtgtggggtgtggcaggcgccggaaatcctcaaagctttcagaagcatccagaatgcctaccatcagctcctgaatcagggattttcagcactacctctgagccatggggttggctgcccagccaggcttccaggccctgaggacatgtggtcaggttcagcaggctcctgggtaaagagggtgggagggggcttctccttttggaagcagatagccatgcaggtagaattgtcatctcccaagtggccacatacagcaacccactccaggccatggggaccaccactcagggttcggggctggcaggagggtagtttctccagtctccccagtctgttggtgtctttataggaaactataaagcagagcagtggtgtctttagaggaaactcattcaagtcagggcactgattttcctctcagtttattatttggggggatagggtcaggtgggtatagtagtactttaccagggtgcttttaagttactttaaaaaaagcctacaaaatattttttttcttttatttgctcgagttcacattaatgatggtcacaaggctgccttgttgggcaggcgtattgcccccagttcctcttctgctggcctgtatgacctccacagccaggccctgggcccaagccccttgtcccttctccactgcccctctttccagacagtaaaggccatggtcagtgtgtttttctcttgtaaacaaaccccagcttgtttaacagaaatgctaataacctactgggaaagatggaggtctaaattacctccagggtttttctgggggtttatcaccagtgtgggtcccttctgataccaccaggttcactccaggcagagtggggcggaaggctgctgaggatatgggtcagttacagcagccctcacctcaaagggctggcctgcttctcagcctacattcatttgcaagcttcaatctctggaccatctggtgttcacaggtgttagagggttaggggttaggggctagttttggatttgattcataggtaggagggcttagattttaaggcacttctgaaagtcaatccctggacaaggcagtcatcacataagaacagctaccttctccacttggtggcacaagaggtagggaggggagtatgggttcatttggcttcgcattatgcaaggtgaaaccgtttgttttccctctccattttccctaactaaatgaaaaggacacattctgaaatcccttttgttggagaataagtcagtctgaggggaaatgggaggccagagatgagaaccctttgaaaagattgtaaaatactgattttcattctttcaagcttatttgtaaatacctatttgaatgctgtgtatttgtacaggaatttgagcaaaaaatgtatagagtgtgatgtccaattggtattcagcactataaatgtgtttttaacctcccgcattctgtgcttatttaaaacaaggaaacttctaaccatttcttttgtgtattcatgtttaaagaaaaaaagtgatttaaaaatgatcttacctgtaccagaaaagcaaagttaaaggaaacaaaatttgtaccattgtcccaagaggtattttactgtatatattgtggtagcatgttcaaaatccaacaagtaatgtgaattttagatgtaaatatctgccacttgattttttttccccctttccccacttccttgactgctgtgatgtgaattaaagataaatacgtgatactga

SEQ ID NO: 8006 - DNA, 5778 bp, Homo sapiens
gttattgccagtttccgaggaaccgttccatatggcctgtcattggaaattggagatacagttcagatcctggagaagtgtgatggctggtacagaggatttgccttaaaaaacccaaatatcaagggtatatttccttccagctacgttcacttgaaaaatgcctgtgtaaagaacaaaggacaatttgaaatggttattcccactgaagactctgttatcacagaaatgacatcaacattaagagactggggaaccatgtggaaacaactctatgtgcgtaatgaaggcgatctcttccaccggctgtggcacatcatgaatgaaatcctggacctgaggcggcaggtgctggtgggccacctcacccacgaccggatgaaggacgtgaagcgccacattactgcccggcttgactggggcaatgaacaactgggactggacctggtgcctaggaaagagtacgcaatggtggatccggaagacatcagcattactgagctctaccgattgatggaacatcgacatcggaagaaagacaccccggtgcaggccagcagtcaccacctctttgtccagatgaagagcctcatgtgttccaacctgggagaggagctggaggtcatcttctcactctttgacagtaaagagaaccggccaatcagtgagagatttttcttgaggctgaatagaaacgggcttcccaaagcccctgataaaccggaacgacattgctccctctttgtggatttgggcagcagtgagctaagaaaggacatttatatcaccgtgcacattatccgaatcggtcgaatgggagcaggagaaaaaaagaatgcctgtagtgtccagtaccgacgaccctttggctgtgcagttcttagcatcgctgacctgctaacaggagagacaaaggatgacctcattctgaaagtatacatgtgtaacacagagagtgagtggtaccaaatccatgagaacatcatcaaaaagctgaatgcacgttataacttgactggctccaatgcaggtttagcagtttccttacagctattgcacggagacattgaacaaatcagaagggaatattcatcagtattttctcatggagtatccataacaaggaagctgggattttcaaatattattatgcctggtgaaatgaggaatgatttatatatcactattgaaaggggagaatttgagaaaggagggaagagcgtggccagaaatgtggaagttacgatgttcattgtagacagtagtggccaaaccctgaaggattttatctccttcggctctggggagccaccagccagtgagtaccactcctttgtgctttaccataacaacagtcccaggtggtctgaactgctgaaacttcccattcctgtggataaattccggggtgcacacatccgcttcgagtttcggcattgttccacaaaggagaaaggagagaagaagttgtttgggttttcttttgtccctctgatgcaagaagatggtaggactcttccagatggcactcatgagctcatcgtgcataagtgtgaagaaaacacaaatcttcaggatactacccgctacctcaaacttcccttttccaagggcattttccttgggaataataatcaagccatgaaggccacaaaggagtccttttgtattacatcttttctctgttccacaaaactcacacaaaatggtgatatgcttgatcttttgaaatggagaacccacccagacaagatcactggctgtctctctaaattaaaagaaattgatggctcagagatagtaaagtttctgcaggatacactggataccttatttggaattttagatgaaaattcccaaaaatatgggtctaaagtgtttgattctttggttcacataataaatttgctgcaagatagcaaatttcatcattttaaacctgtaatggacacttacattgagagtcattttgctggggcacttgcatacagagatctcatcaaagtgctcaaatggtacgtggaccggatcacagaagcagagcggcaagagcatatccaggaggtgctgaaggcacaagaatacatttttaagtatatagttcaatctcgaaggctgttttcccttgccactggtgggcaaaacgaagaggagttccgctgctgcattcaggagcttctcatgtcagtccgtttctttctttcgcaagagagcaaagggtctggagcattatctcagtcacaggctgtgtttctgagctctttccctgccgtgtactcagaactgttgaagctctttgatgtccgggaagtagccaacttggtccaggacaccctgggcagtctgccgaccatcctgcatgtggatgattccctgcaggccatcaaactgcagtgcattggcaaaaccgtggaaagccagctttataccaacccagattcccgatacattcttctgcctgtcgtgttacatcacctccacattcacttgcaagaacagaaggacctgatcatgtgtgcacgtatccttagcaacgtattttgtcttatcaagaaaaatagctcagaaaaatctgtgctggaggaaatagatgtgatagtggccagcttgctggatattctgctgaggaccatattggagatcaccagccgacctcagccatccagctcagcaatgcggttccagttccaggatgtcactggggagtttgttgcttgtctcctgtccctattacgacaaatgacagatagacattatcaacagcttcttgatagttttaatacaaaggaagaactaagggatttcctgctgcagatatttactgtgttccgaatattgatacgcccggagatgtttccaaaggactggactgttatgcgcttggttgctaacaatgttattattacaacagttctatacctctcagatgcacttcgtaagaacttcttaaatgaaaactttgattataagatctgggattcctacttttacctcgcagtcatttttataaaccagttgtgtctgcagttggagatgttcacaccttccaagaagaaaaaggtgttagaaaagtatggtgacatgcgggtaacaatgggttgtgaaattttcagcatgtggcaaaacctaggagagcacaagcttcattttatccctgccctgattggccccttcctagaagtgaccttgataccccagccagatcttcggaatgtcatgattccaatttttcatgatatgatggactgggagcagaggcggagtggcaactttaaacaggtggaagccaagctaattgacaaactggatagcctgatgtcagaaggcaaaggtgacgaaacataccgcgagctcttcaacagtataattccactatttggtccctatcctagtctactaaagaaaattgagcgggaaacatggcgggaaagtggcgtttcattaattgctactgtaactcgtctaatggagaggttgttagattacagggactgcatgaaaatgggagaggtagatggcaaaaagattggctgcacagttagccttctgaacttctataagactgaactgaacaaggaggagatgtatatacgctacattcacaaactctatgatctgcatctcaaagcacagaactttacagaagctgcatataccctcctcttatatgacgagctactggaatggtctgatcggcccctcagggagttcctgacctaccccatgcaaacagaatggcagcgcaaagagcacctgcacctcaccatcatccagaactttgacagaggcaaatgttgggagaatggcattatcttgtgccggaagattgcagagcagtatgagagttattatgactacagaaacctgagcaagatgcggatgatggaagcctctttgtatgacaaaattatggaccagcaacgtcttgaaccagagttcttcagagttggattttatggaaaaaaatttccatttttcttaagaaataaggagtttgtgtgtcgagggcatgactacgagaggctggaagccttccaacagagaatgctgaacgagttcccccatgccatcgccatgcagcacgccaaccagcccgatgagaccatcttccaggcagaagctcagtatttgcagatatatgctgtgactcccattccagagagccaggaggtcctgcagagagagggtgttccggacaacatcaaaagcttctataaagtgaatcacatctggaaattccgctatgaccgaccatttcacaaaggcacaaaagataaagagaatgaattcaagagtctctgggtggagagaacgtcattatacttggtgcagagtttgcctggcatctctcgctggtttgaagtggaaaagcgtgaagtggtagaaatgagtcctctggaaaatgcaattgaagtgctagaaaataagaatcagcagctgaagactctgattagtcagtgtcagacaagacagatgcagaatattaatcccctgactatgtgcctgaatggagttatagatgctgcagttaatggtggcgtttccaggtatcaagaggcattctttgtcaaagaatatatcttaagtcaccctgaagatggggagaaaattgcacgattaagagagctgatgcttgagcaggcacagattctggaatttggtttggccgtgcatgagaagtttgtacctcaagatatgagaccccttcacaaaaagctggttgaccaattctttgtgatgaagtcgagcttagggatacaggagttctctgcttgtatgcaagccagtcctgtccattttcctaatggaagccctcgtgtgtgtagaaactcagcacctgcttctgtgagcccagatggtaccagggtaattcctagacgcagcccgttaagttacccagctgtcaaccgatattcttcctcctcactgtcctcacaagcttctgctgaagtaagcaatattacagggcaatcagaaagctctgatgaagtctttaacatgcagccaagtccatctacctcaagcttgagttctactcactcggcttcacctaatgtgacaagttctgctccatcgagtgccagagcttctcctttgttgtctgacaaacacaaacattcccgagaaaactcttgcctgtcaccaagagagagaccatgcagtgccatctatccaacacctgtggagccttcgcagaggatgctgtttaatcatattggagacggggccttgccacgcagtgacccaaatctctctgcacctgaaaaagcttcaccagcaagacacacgacatcagtatccccctcgcctgccgggcgatctccattgaagggctctgtgcagtctttcaccccctctccagtggagtaccactcgccaggactcatctccaactcccctgtcttgtcgggcagctacagcagtgggatttcttctctcagccggtgcagcacgtcggaaacctcaggctttgaaaatcaggtgaatgaacagtcggcccccctgccggtgccagtgccggtgcccgtgccgagctacggcggggaggagccagtgcgcaaggagagcaagactccgcccccgtacagcgtctacgagcggactctgcggcgccccgtcccgctacctcacagcctctccatccccgtcacgtcggagccgcccgcgctgccccccaagcctctggcagcgcgatccagccacctggagaatggggcccggaggactgaccccggcccgcggcccaggcccctgccccgcaaggtctctcagttataa

SEQ ID NO: 8007 - DNA, 8027 bp, Homo sapiens
gttattgccagtttccgaggaaccgttccatatggcctgtcattggaaattggagatacagttcagatcctggagaagtgtgatggctggtacagaggatttgccttaaaaaacccaaatatcaagggtatatttccttccagctacgttcacttgaaaaatgcctgtgtaaagaacaaaggacaatttgaaatggttattcccactgaagactctgttatcacagaaatgacatcaacattaagagactggggaaccatgtggaaacaactctatgtgcgtaatgaaggcgatctcttccaccggctgtggcacatcatgaatgaaatcctggacctgaggcggcaggtgctggtgggccacctcacccacgaccggatgaaggacgtgaagcgccacattactgcccggcttgactggggcaatgaacaactgggactggacctggtgcctaggaaagagtacgcaatggtggatccggaagacatcagcattactgagctctaccgattgatggaacatcgacatcggaagaaagacaccccggtgcaggccagcagtcaccacctctttgtccagatgaagagcctcatgtgttccaacctgggagaggagctggaggtcatcttctcactctttgacagtaaagagaaccggccaatcagtgagagatttttcttgaggctgaatagaaacgggcttcccaaagcccctgataaaccggaacgacattgctccctctttgtggatttgggcagcagtgagctaagaaaggacatttatatcaccgtgcacattatccgaatcggtcgaatgggagcaggagaaaaaaagaatgcctgtagtgtccagtaccgacgaccctttggctgtgcagttcttagcatcgctgacctgctaacaggagagacaaaggatgacctcattctgaaagtatacatgtgtaacacagagagtgagtggtaccaaatccatgagaacatcatcaaaaagctgaatgcacgttataacttgactggctccaatgcaggtttagcagtttccttacagctattgcacggagacattgaacaaatcagaagggaatattcatcagtattttctcatggagtatccataacaaggaagctgggattttcaaatattattatgcctggtgaaatgaggaatgatttatatatcactattgaaaggggagaatttgagaaaggagggaagagcgtggccagaaatgtggaagttacgatgttcattgtagacagtagtggccaaaccctgaaggattttatctccttcggctctggggagccaccagccagtgagtaccactcctttgtgctttaccataacaacagtcccaggtggtctgaactgctgaaacttcccattcctgtggataaattccggggtgcacacatccgcttcgagtttcggcattgttccacaaaggagaaaggagagaagaagttgtttgggttttcttttgtccctctgatgcaagaagatggtaggactcttccagatggcactcatgagctcatcgtgcataagtgtgaagaaaacacaaatcttcaggatactacccgctacctcaaacttcccttttccaagggcattttccttgggaataataatcaagccatgaaggccacaaaggagtccttttgtattacatcttttctctgttccacaaaactcacacaaaatggtgatatgcttgatcttttgaaatggagaacccacccagacaagatcactggctgtctctctaaattaaaagaaattgatggctcagagatagtaaagtttctgcaggatacactggataccttatttggaattttagatgaaaattcccaaaaatatgggtctaaagtgtttgattctttggttcacataataaatttgctgcaagatagcaaatttcatcattttaaacctgtaatggacacttacattgagagtcattttgctggggcacttgcatacagagatctcatcaaagtgctcaaatggtacgtggaccggatcacagaagcagagcggcaagagcatatccaggaggtgctgaaggcacaagaatacatttttaagtatatagttcaatctcgaaggctgttttcccttgccactggtgggcaaaacgaagaggagttccgctgctgcattcaggagcttctcatgtcagtccgtttctttctttcgcaagagagcaaagggtctggagcattatctcagtcacaggctgtgtttctgagctctttccctgccgtgtactcagaactgttgaagctctttgatgtccgggaagtagccaacttggtccaggacaccctgggcagtctgccgaccatcctgcatgtggatgattccctgcaggccatcaaactgcagtgcattggcaaaaccgtggaaagccagctttataccaacccagattcccgatacattcttctgcctgtcgtgttacatcacctccacattcacttgcaagaacagaaggacctgatcatgtgtgcacgtatccttagcaacgtattttgtcttatcaagaaaaatagctcagaaaaatctgtgctggaggaaatagatgtgatagtggccagcttgctggatattctgctgaggaccatattggagatcaccagccgacctcagccatccagctcagcaatgcggttccagttccaggatgtcactggggagtttgttgcttgtctcctgtccctattacgacaaatgacagatagacattatcaacagcttcttgatagttttaatacaaaggaagaactaagggatttcctgctgcagatatttactgtgttccgaatattgatacgcccggagatgtttccaaaggactggactgttatgcgcttggttgctaacaatgttattattacaacagttctatacctctcagatgcacttcgtaagaacttcttaaatgaaaactttgattataagatctgggattcctacttttacctcgcagtcatttttataaaccagttgtgtctgcagttggagatgttcacaccttccaagaagaaaaaggtgttagaaaagtatggtgacatgcgggtaacaatgggttgtgaaattttcagcatgtggcaaaacctaggagagcacaagcttcattttatccctgccctgattggccccttcctagaagtgaccttgataccccagccagatcttcggaatgtcatgattccaatttttcatgatatgatggactgggagcagaggcggagtggcaactttaaacaggtggaagccaagctaattgacaaactggatagcctgatgtcagaaggcaaaggtgacgaaacataccgcgagctcttcaacagtattctactaaagaaaattgagcgggaaacatggcgggaaagtggcgtttcattaattgctactgtaactcgtctaatggagaggttgttagattacagggactgcatgaaaatgggagaggtagatggcaaaaagattggctgcacagttagccttctgaacttctataagactgaactgaacaaggaggagatgtatatacgctacattcacaaactctatgatctgcatctcaaagcacagaactttacagaagctgcatataccctcctcttatatgacgagctactggaatggtctgatcggcccctcagggagttcctgacctaccccatgcaaacagaatggcagcgcaaagagcacctgcacctcaccatcatccagaactttgacagaggcaaatgttgggagaatggcattatcttgtgccggaagattgcagagcagtatgagagttattatgactacagaaacctgagcaagatgcggatgatggaagcctctttgtatgacaaaattatggaccagcaacgtcttgaaccagagttcttcagagttggattttatggaaaaaaatttccatttttcttaagaaataaggagtttgtgtgtcgagggcatgactacgagaggctggaagccttccaacagagaatgctgaacgagttcccccatgccatcgccatgcagcacgccaaccagcccgatgagaccatcttccaggcagaagctcagtatttgcagatatatgctgtgactcccattccagagagccaggaggtcctgcagagagagggtgttccggacaacatcaaaagcttctataaagtgaatcacatctggaaattccgctatgaccgaccatttcacaaaggcacaaaagataaagagaatgaattcaagagtctctgggtggagagaacgtcattatacttggtgcagagtttgcctggcatctctcgctggtttgaagtggaaaagcgtgaagtggtagaaatgagtcctctggaaaatgcaattgaagtgctagaaaataagaatcagcagctgaagactctgattagtcagtgtcagacaagacagatgcagaatattaatcccctgactatgtgcctgaatggagttatagatgctgcagttaatggtggcgtttccaggtatcaagaggcattctttgtcaaagaatatatcttaagtcaccctgaagatggggagaaaattgcacgattaagagagctgatgcttgagcaggcacagattctggaatttggtttggccgtgcatgagaagtttgtacctcaagatatgagaccccttcacaaaaagctggttgaccaattctttgtgatgaagtcgagcttagggatacaggagttctctgcttgtatgcaagccagtcctgtccattttcctaatggaagccctcgtgtgtgtagaaactcagcacctgcttctgtgagcccagatggtaccagggtaattcctagacgcagcccgttaagttacccagctgtcaaccgatattcttcctcctcactgtcctcacaagcttctgctgaagtaagcaatattacagggcaatcagaaagctctgatgaagtctttaacatgcagccaagtccatctacctcaagcttgagttctactcactcggcttcacctaatgtgacaagttctgctccatcgagtgccagagcttctcctttgttgtctgacaaacacaaacattcccgagaaaactcttgcctgtcaccaagagagagaccatgcagtgccatctatccaacacctgtggagccttcgcagaggatgctgtttaatcatattggagacggggccttgccacgcagtgacccaaatctctctgcacctgaaaaagctgtgaaccccacccctagcagctggagcctggacagtgggaaggaagccaagaacatgtcggatagtgggaaacttatctctccccctgtccctccaagacccacacagactgcttcaccagcaagacacacgacatcagtatccccctcgcctgccgggcgatctccattgaagggctctgtgcagtctttcaccccctctccagtggagtaccactcgccaggactcatctccaactcccctgtcttgtcgggcagctacagcagtgggatttcttctctcagccggtgcagcacgtcggaaacctcaggctttgaaaatcaggtgaatgaacagtcggcccccctgccggtgccagtgccggtgcccgtgccgagctacggcggggaggagccagtgcgcaaggagagcaagactccgcccccgtacagcgtctacgagcggactctgcggcgccccgtcccgctacctcacagcctctccatccccgtcacgtcggagccgcccgcgctgccccccaagcctctggcagcgcgatccagccacctggagaatggggcccggaggactgaccccggcccgcggcccaggcccctgccccgcaaggtctctcagttataagtcacttttctatgtacctgcgatgcattctttgcccgtttacaaaataagaagtatgatgagaagacatttagtgtaggcactttaataacttactcagctccttcgatgaatggaattaaaacttgcttattaaatatcatgttgcacaatattaaaagttgctgatctaaaacgccagatgttaaatgaagtatggctgaatttcattaaaacgtttctcatttggaagtggtaaatagtgataaagactccttttgtacctttttatgttcacttttttttatatagtttaatcttaaaaccaatacgatattgtcaaacgatacaatgtgtgacaatgttgtatcgtttttactgaatacttgatacttggagaaagcttattaagtcagtgcacatcctaacacagtggtccttattttagaagacttctgtaaataaggcaaggtttatcagtgcagatcatcagaattaaagttcaagcaggcgagcaagacagtatacttaaggggttgcaaagcttgggactggaaattgttttgttcttgaaacaaaatacttctttaaggttgcttttgctgtttgactgctgtctacattcgtaaaattctattttgtgaattggtagctaaatcccttactaccctgacaccgtggtatctactgtatttcttttcaaggtgcaatttgcttcagagttccaatcagctagattaagcaagaggctccagaagaaatgtttacttgaattttgcgcttcctttcttgatagtttcctatataaaatttgtcattgaacaagagcaaatgctgaagtattaatgaggcacaaatgactgtgccccattagcaagaattcaggaatcaatacagacagtattaaattaatagcttaagtgaagaaaaaaaaaacttagtgaaaatgtattagcacgattaaatggcaaaaggacttataaaaggcaagggcattaactttcagtcctgcacaaaataaaaaattcctcacgactctccacttttaccagtggagtttgtcttagctgacctgtcgtctttctcttgaaggaggattgctgtagacttctctagcttgaatattgcaacatagcatcttaggtctagatagggatgctaatgccagttgtagaagtgtgaaaaaagcaccttgtatgtagtaatgtattttatatctttgttttttcttttactgactgtttataacactcaattgacaatagatatgaactgtattttaaatcatactgttaaatattttccctcttttgttgggaagctcattttagtttaaccatgtttgttttgttggtagcttacctggaaggcagtgaccacttttttatattctcttaatgaaaccattcagcaggtatatgctgttgaggctggttatagaggttttctataataaatgttcaagtatttttgtatataactggttaattttaataagagataccattatgtgtaaaaaaaagtaaaaataaacgcaaacagttgttgatgcagtatgattgttataattatgccaaatactttacgtatggaaaaagaatatttgtacatatgtgcttttaacaattctgccatattgactttacaattttgaatgtcggaaaaattaatatatgttaaatatttatgtttagtgaaagtgttcataattgagaaaaggaacatatgcattttagctttgtatcttgcaagttttgcagtcagaaattttttgaactagcttttgcttttgataacacttcgtgtttgtaaccacattcatatatatatacatatatatgtgaagctccatatttctgttgctttaaagaagtaaaaccttccatttaaataagatgacatgcataagataacaaagcttccttgatttccttttcctgtgtaatttaatagatttgttgactagtgcttgggcacattataaatcagtgttatttgctcttggagccattttttaaaaaaaattttggcagtgagcagttgaatttatcttgaatttatcatgtgtgtgtatttctgaagcagctacatagcagaacattttaagagattctgttagcccacatgttcatgttggttgctgctgaatggtaaatattaaataaaattaccagattaatctt

SEQ ID NO: 8008 - DNA, 7997 bp, Homo sapiens
gcttagttcagtgaatcagaacaatgactgcgccgccgggtacccgggagcgcgtcggaggactgtgagcagccgccgccgggagagctgcgggcggcgcagtgtcaacgctgggctcgggagcctccagcgcagatcctgcccagcgcccgcagcccgcgcgaagccgctgggctccggcactgcagcgctgctcggggactgtgcattgttgtgagccggagaaggggcgcggggattacaaagcctgaagaccccggagcccctttagccatgtggatacctacggagcacgagaaatacggcgtggttattgccagtttccgaggaaccgttccatatggcctgtcattggaaattggagatacagttcagatcctggagaagtgtgatggctggtacagaggatttgccttaaaaaacccaaatatcaagggtatatttccttccagctacgttcacttgaaaaatgcctgtgtaaagaacaaaggacaatttgaaatggttattcccactgaagactctgttatcacagaaatgacatcaacattaagagactggggaaccatgtggaaacaactctatgtgcgtaatgaaggcgatctcttccaccggctgtggcacatcatgaatgaaatcctggacctgaggcggcaggtgctggtgggccacctcacccacgaccggatgaaggacgtgaagcgccacattactgcccggcttgactggggcaatgaacaactgggactggacctggtgcctaggaaagagtacgcaatggtggatccggaagacatcagcattactgagctctaccgattgatggaacatcgacatcggaagaaagacaccccggtgcaggccagcagtcaccacctctttgtccagatgaagagcctcatgtgttccaacctgggagaggagctggaggtcatcttctcactctttgacagtaaagagaaccggccaatcagtgagagatttttcttgaggctgaatagaaacgggcttcccaaagcccctgataaaccggaacgacattgctccctctttgtggatttgggcagcagtgagctaagaaaggacatttatatcaccgtgcacattatccgaatcggtcgaatgggagcaggagaaaaaaagaatgcctgtagtgtccagtaccgacgaccctttggctgtgcagttcttagcatcgctgacctgctaacaggagagacaaaggatgacctcattctgaaagtatacatgtgtaacacagagagtgagtggtaccaaatccatgagaacatcatcaaaaagctgaatgcacgttataacttgactggctccaatgcaggtttagcagtttccttacagctattgcacggagacattgaacaaatcagaagggaatattcatcagtattttctcatggagtatccataacaaggaagctgggattttcaaatattattatgcctggtgaaatgaggaatgatttatatatcactattgaaaggggagaatttgagaaaggagggaagagcgtggccagaaatgtggaagttacgatgttcattgtagacagtagtggccaaaccctgaaggattttatctccttcggctctggggagccaccagccagtgagtaccactcctttgtgctttaccataacaacagtcccaggtggtctgaactgctgaaacttcccattcctgtggataaattccggggtgcacacatccgcttcgagtttcggcattgttccacaaaggagaaaggagagaagaagttgtttgggttttcttttgtccctctgatgcaagaagatggtaggactcttccagatggcactcatgagctcatcgtgcataagtgtgaagaaaacacaaatcttcaggatactacccgctacctcaaacttcccttttccaagggcattttccttgggaataataatcaagccatgaaggccacaaaggagtccttttgtattacatcttttctctgttccacaaaactcacacaaaatggtgatatgcttgatcttttgaaatggagaacccacccagacaagatcactggctgtctctctaaattaaaagaaattgatggctcagagatagtaaagtttctgcaggatacactggataccttatttggaattttagatgaaaattcccaaaaatatgggtctaaagtgtttgattctttggttcacataataaatttgctgcaagatagcaaatttcatcattttaaacctgtaatggacacttacattgagagtcattttgctggggcacttgcatacagagatctcatcaaagtgctcaaatggtacgtggaccggatcacagaagcagagcggcaagagcatatccaggaggtgctgaaggcacaagaatacatttttaagtatatagttcaatctcgaaggctgttttcccttgccactggtgggcaaaacgaagaggagttccgctgctgcattcaggagcttctcatgtcagtccgtttctttctttcgcaagagagcaaagggtctggagcattatctcagtcacaggctgtgtttctgagctctttccctgccgtgtactcagaactgttgaagctctttgatgtccgggaagtagccaacttggtccaggacaccctgggcagtctgccgaccatcctgcatgtggatgattccctgcaggccatcaaactgcagtgcattggcaaaaccgtggaaagccagctttataccaacccagattcccgatacattcttctgcctgtcgtgttacatcacctccacattcacttgcaagaacagaaggacctgatcatgtgtgcacgtatccttagcaacgtattttgtcttatcaagaaaaatagctcagaaaaatctgtgctggaggaaatagatgtgatagtggccagcttgctggatattctgctgaggaccatattggagatcaccagccgacctcagccatccagctcagcaatgcggttccagttccaggatgtcactggggagtttgttgcttgtctcctgtccctattacgacaaatgacagatagacattatcaacagcttcttgatagttttaatacaaaggaagaactaagggatttcctgctgcagatatttactgtgttccgaatattgatacgcccggagatgtttccaaaggactggactgttatgcgcttggttgctaacaatgttattattacaacagttctatacctctcagatgcacttcgtaagaacttcttaaatgaaaactttgattataagatctgggattcctacttttacctcgcagtcatttttataaaccagttgtgtctgcagttggagatgttcacaccttccaagaagaaaaaggtgttagaaaagtatggtgacatgcgggtaacaatgggttgtgaaattttcagcatgtggcaaaacctaggagagcacaagcttcattttatccctgccctgattggccccttcctagaagtgaccttgataccccagccagatcttcggaatgtcatgattccaatttttcatgatatgatggactgggagcagaggcggagtggcaactttaaacaggtggaagccaagctaattgacaaactggatagcctgatgtcagaaggcaaaggtgacgaaacataccgcgagctcttcaacagtataattccactatttggtccctatcctagtctactaaagaaaattgagcgggaaacatggcgggaaagtggcgtttcattaattgctactgtaactcgtctaatggagaggttgttagattacagggactgcatgaaaatgggagaggtagatggcaaaaagattggctgcacagttagccttctgaacttctataagactgaactgaacaaggaggagatgtatatacgctacattcacaaactctatgatctgcatctcaaagcacagaactttacagaagctgcatataccctcctcttatatgacgagctactggaatggtctgatcggcccctcagggagttcctgacctaccccatgcaaacagaatggcagcgcaaagagcacctgcacctcaccatcatccagaactttgacagaggcaaatgttgggagaatggcattatcttgtgccggaagattgcagagcagtatgagagttattatgactacagaaacctgagcaagatgcggatgatggaagcctctttgtatgacaaaattatggaccagcaacgtcttgaaccagagttcttcagagttggattttatggaaaaaaatttccatttttcttaagaaataaggagtttgtgtgtcgagggcatgactacgagaggctggaagccttccaacagagaatgctgaacgagttcccccatgccatcgccatgcagcacgccaaccagcccgatgagaccatcttccaggcagaagctcagtatttgcagatatatgctgtgactcccattccagagagccaggaggtcctgcagagagagggtgttccggacaacatcaaaagcttctataaagtgaatcacatctggaaattccgctatgaccgaccatttcacaaaggcacaaaagataaagagaatgaattcaagagtctctgggtggagagaacgtcattatacttggtgcagagtttgcctggcatctctcgctggtttgaagtggaaaagcgtgaagtggtagaaatgagtcctctggaaaatgcaattgaagtgctagaaaataagaatcagcagctgaagactctgattagtcagtgtcagacaagacagatgcagaatattaatcccctgactatgtgcctgaatggagttatagatgctgcagttaatggtggcgtttccaggtatcaagaggcattctttgtcaaagaatatatcttaagtcaccctgaagatggggagaaaattgcacgattaagagagctgatgcttgagcaggcacagattctggaatttggtttggccgtgcatgagaagtttgtacctcaagatatgagaccccttcacaaaaagctggttgaccaattctttgtgatgaagtcgagcttagggatacaggagttctctgcttgtatgcaagccagtcctgtccattttcctaatggaagccctcgtgtgtgtagaaactcagcacctgcttctgtgagcccagatggtaccagggtaattcctagacgcagcccgttaagttacccagctgtcaaccgatattcttcctcctcactgtcctcacaagcttctgctgaagtaagcaatattacagggcaatcagaaagctctgatgaagtctttaacatgcagccaagtccatctacctcaagcttgagttctactcactcggcttcacctaatgtgacaagttctgctccatcgagtgccagagcttctcctttgttgtctgacaaacacaaacattcccgagaaaactcttgcctgtcaccaagagagagaccatgcagtgccatctatccaacacctgtggagccttcgcagaggatgctgtttaatcatattggagacggggccttgccacgcagtgacccaaatctctctgcacctgaaaaagctgtgaaccccacccctagcagctggagcctggacagtgggaaggaagccaagaacatgtcggatagtgggaaacttatctctccccctgtccctccaagacccacacagactgcttcaccagcaagacacacgacatcagtatccccctcgcctgccgggcgatctccattgaagggctctgtgcagtctttcaccccctctccagtggagtaccactcgccaggactcatctccaactcccctgtcttgtcgggcagctacagcagtgggatttcttctctcagccggtgcagcacgtcggaaacctcaggctttgaaaatcaggtgaatgaacagtcggcccccctgccggtgccagtgccggtgcccgtgccgagctacggcggggaggagccagtgcgcaaggagagcaagactccgcccccgtacagcgtctacgagcggactctgcggcgccccgtcccgctacctcacagcctctccatccccgtcacgtcggagccgcccgcgctgccccccaagcctctggcagcgcgatccagccacctggagaatggggcccggaggactgaccccggcccgcggcccaggcccctgccccgcaaggtctctcagttataagtcacttttctatgtacctgcgatgcattctttgcccgtttacaaaataagaagtatgatgagaagacatttagtgtaggcactttaataacttactcagctccttcgatgaatggaattaaaacttgcttattaaatatcatgttgcacaatattaaaagttgctgatctaaaacgccagatgttaaatgaagtatggctgaatttcattaaaacgtttctcatttggaagtggtaaatagtgataaagactccttttgtacctttttatgttcacttttttttatatagtttaatcttaaaaccaatacgatattgtcaaacgatacaatgtgtgacaatgttgtatcgtttttactgaatacttgatacttggagaaagcttattaagtcagtgcacatcctaacacagtggtccttattttagaagacttctgtaaataaggcaaggtttatcagtgcagatcatcagaattaaagttcaagcaggcgagcaagacagtatacttaaggggttgcaaagcttgggactggaaattgttttgttcttgaaacaaaatacttctttaaggttgcttttgctgtttgactgctgtctacattcgtaaaattctattttgtgaattggtagctaaatcccttactaccctgacaccgtggtatctactgtatttcttttcaaggtgcaatttgcttcagagttccaatcagctagattaagcaagaggctccagaagaaatgtttacttgaattttgcgcttcctttcttgatagtttcctatataaaatttgtcattgaacaagagcaaatgctgaagtattaatgaggcacaaatgactgtgccccattagcaagaattcaggaatcaatacagacagtattaaattaatagcttaagtgaagaaaaaaaaaacttagtgaaaatgtattagcacgattaaatggcaaaaggacttataaaaggcaagggcattaactttcagtcctgcacaaaataaaaaattcctcacgactctccacttttaccagtggagtttgtcttagctgacctgtcgtctttctcttgaaggaggattgctgtagacttctctagcttgaatattgcaacatagcatcttaggtctagatagggatgctaatgccagttgtagaagtgtgaaaaaagcaccttgtatgtagtaatgtattttatatctttgttttttcttttactgactgtttataacactcaattgacaatagatatgaactgtattttaaatcatactgttaaatattttccctcttttgttgggaagctcattttagtttaaccatgtttgttttgttggtagcttacctggaaggcagtgaccacttttttatattctcttaatgaaaccattcagcaggtatatgctgttgaggctggttatagaggttttctataataaatgttcaagtatttttgtatataactggttaattttaataagagataccattatgtgtaaaaaaaagtaaaaataaacgcaaacagttgttgatgcagtatgattgttataattatgccaaatactttacgtatggaaaaagaatatttgtacatatgtgcttttaacaattctgccatattgactttacaattttgaatgtcggaaaaattaatatatgttaaatatttatgtttagtgaaagtgttcataattgagaaaaggaacatatgcattttagctttgtatcttgcaagttttgcagtcagaaattttttgaactagcttttgcttttgataacacttcgtgtttgtaaccaca

SEQ ID NO: 8009 - DNA, 6212 bp, Homo sapiens
cagaacaatgactgcgccgccgggtacccgggagcgcgtcggaggactgtgagcagccgccgccgggagagctgcgggcggcgcagtgtcaacgctgggctcgggagcctccagcgcagatcctgcccagcgcccgcagcccgcgcgaagccgctgggctccggcactgcagcgctgctcggggactgtgcattgttgtgagccggagaaggggcgcggggattacaaagcctgaagaccccggagcccctttagccatgtggatacctacggagcacgagaaatacggcgtggttattgccagtttccgaggaaccgttccatatggcctgtcattggaaattggagatacagttcagatcctggagaagtgtgatggctggtacagaggatttgccttaaaaaacccaaatatcaagggtatatttccttccagctacgttcacttgaaaaatgcctgtgtaaagaacaaaggacaatttgaaatggttattcccactgaagactctgttatcacagaaatgacatcaacattaagagactggggaaccatgtggaaacaactctatgtgcgtaatgaaggcgatctcttccaccggctgtggcacatcatgaatgaaatcctggacctgaggcggcaggtgctggtgggccacctcacccacgaccggatgaaggacgtgaagcgccacattactgcccggcttgactggggcaatgaacaactgggactggacctggtgcctaggaaagagtacgcaatggtggatccggaagacatcagcattactgagctctaccgattgatggaacatcgacatcggaagaaagacaccccggtgcaggccagcagtcaccacctctttgtccagatgaagagcctcatgtgttccaacctgggagaggagctggaggtcatcttctcactctttgacagtaaagagaaccggccaatcagtgagagatttttcttgaggctgaatagaaacgggcttcccaaagcccctgataaaccggaacgacattgctccctctttgtggatttgggcagcagtgagctaagaaaggacatttatatcaccgtgcacattatccgaatcggtcgaatgggagcaggagaaaaaaagaatgcctgtagtgtccagtaccgacgaccctttggctgtgcagttcttagcatcgctgacctgctaacaggagagacaaaggatgacctcattctgaaagtatacatgtgtaacacagagagtgagtggtaccaaatccatgagaacatcatcaaaaagctgaatgcacgttataacttgactggctccaatgcaggtttagcagtttccttacagctattgcacggagacattgaacaaatcagaagggaatattcatcagtattttctcatggagtatccataacaaggaagctgggattttcaaatattattatgcctggtgaaatgaggaatgatttatatatcactattgaaaggggagaatttgagaaaggagggaagagcgtggccagaaatgtggaagttacgatgttcattgtagacagtagtggccaaaccctgaaggattttatctccttcggctctggggagccaccagccagtgagtaccactcctttgtgctttaccataacaacagtcccaggtggtctgaactgctgaaacttcccattcctgtggataaattccggggtgcacacatccgcttcgagtttcggcattgttccacaaaggagaaaggagagaagaagttgtttgggttttcttttgtccctctgatgcaagaagatggtaggactcttccagatggcactcatgagctcatcgtgcataagtgtgaagaaaacacaaatcttcaggatactacccgctacctcaaacttcccttttccaagggcattttccttgggaataataatcaagccatgaaggccacaaaggagtccttttgtattacatcttttctctgttccacaaaactcacacaaaatggtgatatgcttgatcttttgaaatggagaacccacccagacaagatcactggctgtctctctaaattaaaagaaattgatggctcagagatagtaaagtttctgcaggatacactggataccttatttggaattttagatgaaaattcccaaaaatatgggtctaaagtgtttgattctttggttcacataataaatttgctgcaagatagcaaatttcatcattttaaacctgtaatggacacttacattgagagtcattttgctggggcacttgcatacagagatctcatcaaagtgctcaaatggtacgtggaccggatcacagaagcagagcggcaagagcatatccaggaggtgctgaaggcacaagaatacatttttaagtatatagttcaatctcgaaggctgttttcccttgccactggtgggcaaaacgaagaggagttccgctgctgcattcaggagcttctcatgtcagtccgtttctttctttcgcaagagagcaaagggtctggagcattatctcagtcacaggctgtgtttctgagctctttccctgccgtgtactcagaactgttgaagctctttgatgtccgggaagtagccaacttggtccaggacaccctgggcagtctgccgaccatcctgcatgtggatgattccctgcaggccatcaaactgcagtgcattggcaaaaccgtggaaagccagctttataccaacccagattcccgatacattcttctgcctgtcgtgttacatcacctccacattcacttgcaagaacagaaggacctgatcatgtgtgcacgtatccttagcaacgtattttgtcttatcaagaaaaatagctcagaaaaatctgtgctggaggaaatagatgtgatagtggccagcttgctggatattctgctgaggaccatattggagatcaccagccgacctcagccatccagctcagcaatgcggttccagttccaggatgtcactggggagtttgttgcttgtctcctgtccctattacgacaaatgacagatagacattatcaacagcttcttgatagttttaatacaaaggaagaactaagggatttcctgctgcagatatttactgtgttccgaatattgatacgcccggagatgtttccaaaggactggactgttatgcgcttggttgctaacaatgttattattacaacagttctatacctctcagatgcacttcgtaagaacttcttaaatgaaaactttgattataagatctgggattcctacttttacctcgcagtcatttttataaaccagttgtgtctgcagttggagatgttcacaccttccaagaagaaaaaggtgttagaaaagtatggtgacatgcgggtaacaatgggttgtgaaattttcagcatgtggcaaaacctaggagagcacaagcttcattttatccctgccctgattggccccttcctagaagtgaccttgataccccagccagatcttcggaatgtcatgattccaatttttcatgatatgatggactgggagcagaggcggagtggcaactttaaacaggtggaagccaagctaattgacaaactggatagcctgatgtcagaaggcaaaggtgacgaaacataccgcgagctcttcaacagtattctactaaagaaaattgagcgggaaacatggcgggaaagtggcgtttcattaattgctactgtaactcgtctaatggagaggttgttagattacagggactgcatgaaaatgggagaggtagatggcaaaaagattggctgcacagttagccttctgaacttctataagactgaactgaacaaggaggagatgtatatacgctacattcacaaactctatgatctgcatctcaaagcacagaactttacagaagctgcatataccctcctcttatatgacgagctactggaatggtctgatcggcccctcagggagttcctgacctaccccatgcaaacagaatggcagcgcaaagagcacctgcacctcaccatcatccagaactttgacagaggcaaatgttgggagaatggcattatcttgtgccggaagattgcagagcagtatgagagttattatgactacagaaacctgagcaagatgcggatgatggaagcctctttgtatgacaaaattatggaccagcaacgtcttgaaccagagttcttcagagttggattttatggaaaaaaatttccatttttcttaagaaataaggagtttgtgtgtcgagggcatgactacgagaggctggaagccttccaacagagaatgctgaacgagttcccccatgccatcgccatgcagcacgccaaccagcccgatgagaccatcttccaggcagaagctcagtatttgcagatatatgctgtgactcccattccagagagccaggaggtcctgcagagagagggtgttccggacaacatcaaaagcttctataaagtgaatcacatctggaaattccgctatgaccgaccatttcacaaaggcacaaaagataaagagaatgaattcaagagtctctgggtggagagaacgtcattatacttggtgcagagtttgcctggcatctctcgctggtttgaagtggaaaagcgtgaagtggtagaaatgagtcctctggaaaatgcaattgaagtgctagaaaataagaatcagcagctgaagactctgattagtcagtgtcagacaagacagatgcagaatattaatcccctgactatgtgcctgaatggagttatagatgctgcagttaatggtggcgtttccaggtatcaagaggcattctttgtcaaagaatatatcttaagtcaccctgaagatggggagaaaattgcacgattaagagagctgatgcttgagcaggcacagattctggaatttggtttggccgtgcatgagaagtttgtacctcaagatatgagaccccttcacaaaaagctggttgaccaattctttgtgatgaagtcgagcttagggatacaggagttctctgcttgtatgcaagccagtcctgtccattttcctaatggaagccctcgtgtgtgtagaaactcagcacctgcttctgtgagcccagatggtaccagggtaattcctagacgcagcccgttaagttacccagctgtcaaccgatattcttcctcctcactgtcctcacaagcttctgctgaagtaagcaatattacagggcaatcagaaagctctgatgaagtctttaacatgcagccaagtccatctacctcaagcttgagttctactcactcggcttcacctaatgtgacaagttctgctccatcgagtgccagagcttctcctttgttgtctgacaaacacaaacattcccgagaaaactcttgcctgtcaccaagagagagaccatgcagtgccatctatccaacacctgtggagccttcgcagaggatgctgtttaatcatattggagacggggccttgccacgcagtgacccaaatctctctgcacctgaaaaagctgtgaaccccacccctagcagctggagcctggacagtgggaaggaagccaagaacatgtcggatagtgggaaacttatctctccccctgtccctccaagacccacacagactgcttcaccagcaagacacacgacatcagtatccccctcgcctgccgggcgatctccattgaagggctctgtgcagtctttcaccccctctccagtggagtaccactcgccaggactcatctccaactcccctgtcttgtcgggcagctacagcagtgggatttcttctctcagccggtgcagcacgtcggaaacctcaggctttgaaaatcaggtgaatgaacagtcggcccccctgccggtgccagtgccggtgcccgtgccgagctacggcggggaggagccagtgcgcaaggagagcaagactccgcccccgtacagcgtctacgagcggactctgcggcgccccgtcccgctacctcacagcctctccatccccgtcacgtcggagccgcccgcgctgccccccaagcctctggcagcgcgatccagccacctggagaatggggcccggaggactgaccccggcccgcggcccaggcccctgccccgcaaggtctctcagttataagtcacttttctatgtacctgcgatgcattctttgcccgtttacaaaataagaag

SEQ ID NO: 8010 - DNA, 2857 bp, Homo sapiens
aaggaaaaaacgcaaaacgtcataccagctgtacaaggattttcctgtagcagttgcattgcagtaaaattgcttggatgaagatgcattccactgagagaattccactatttggtccctatcctagtctactaaagaaaattgagcgggaaacatggcgggaaagtggcgtttcattaattgctactgtaactcgtctaatggagaggttgttagattacagggactgcatgaaaatgggagaggtagatggcaaaaagattggctgcacagttagccttctgaacttctataagactgaactgaacaaggaggagatgtatatacgctacattcacaaactctatgatctgcatctcaaagcacagaactttacagaagctgcatataccctcctcttatatgacgagctactggaatggtctgatcggcccctcagggagttcctgacctaccccatgcaaacagaatggcagcgcaaagagcacctgcacctcaccatcatccagaactttgacagaggcaaatgttgggagaatggcattatcttgtgccggaagattgcagagcagtatgagagttattatgactacagaaacctgagcaagatgcggatgatggaagcctctttgtatgacaaaattatggaccagcaacgtcttgaaccagagttcttcagagttggattttatggaaaaaaatttccatttttcttaagaaataaggagtttgtgtgtcgagggcatgactacgagaggctggaagccttccaacagagaatgctgaacgagttcccccatgccatcgccatgcagcacgccaaccagcccgatgagaccatcttccaggcagaagctcagtatttgcagatatatgctgtgactcccattccagagagccaggaggtcctgcagagagagggtgttccggacaacatcaaaagcttctataaagtgaatcacatctggaaattccgctatgaccgaccatttcacaaaggcacaaaagataaagagaatgaattcaagagtctctgggtggagagaacgtcattatacttggtgcagagtttgcctggcatctctcgctggtttgaagtggaaaagcgtgaagtggtagaaatgagtcctctggaaaatgcaattgaagtgctagaaaataagaatcagcagctgaagactctgattagtcagtgtcagacaagacagatgcagaatattaatcccctgactatgtgcctgaatggagttatagatgctgcagttaatggtggcgtttccaggtatcaagaggcattctttgtcaaagaatatatcttaagtcaccctgaagatggggagaaaattgcacgattaagagagctgatgcttgagcaggcacagattctggaatttggtttggccgtgcatgagaagtttgtacctcaagatatgagaccccttcacaaaaagctggttgaccaattctttgtgatgaagtcgagcttagggatacaggagttctctgcttgtatgcaagccagtcctgtccattttcctaatggaagccctcgtgtgtgtagaaactcagcacctgcttctgtgagcccagatggtaccagggtaattcctagacgcagcccgttaagttacccagctgtcaaccgatattcttcctcctcactgtcctcacaagcttctgctgaagtaagcaatattacagggcaatcagaaagctctgatgaagtctttaacatgcagccaagtccatctacctcaagcttgagttctactcactcggcttcacctaatgtgacaagttctgctccatcgagtgccagagcttctcctttgttgtctgacaaacacaaacattcccgagaaaactcttgcctgtcaccaagagagagaccatgcagtgccatctatccaacacctgtggagccttcgcagaggatgctgtttaatcatattggagacggggccttgccacgcagtgacccaaatctctctgcacctgaaaaagctgtgaaccccacccctagcagctggagcctggacagtgggaaggaagccaagaacatgtcggatagtgggaaacttatctctccccctgtccctccaagacccacacagactgcttcaccagcaagacacacgacatcagtatccccctcgcctgccgggcgatctccattgaagggctctgtgcagtctttcaccccctctccagtggagtaccactcgccaggactcatctccaactcccctgtcttgtcgggcagctacagcagtgggatttcttctctcagccggtgcagcacgtcggaaacctcaggctttgaaaatcaggtgaatgaacagtcggcccccctgccggtgccagtgccggtgcccgtgccgagctacggcggggaggagccagtgcgcaaggagagcaagactccgcccccgtacagcgtctacgagcggactctgcggcgccccgtcccgctacctcacagcctctccatccccgtcacgtcggagccgcccgcgctgccccccaagcctctggcagcgcgatccagccacctggagaatggggcccggaggactgaccccggcccgcggcccaggcccctgccccgcaaggtctctcagttataagtcacttttctatgtacctgcgatgcattctttgcccgtttacaaaataagaagtatgatgagaagacatttagtgtaggcactttaataacttactcagctccttcgatgaatggaattaaaacttgcttattaaatatcatgttgcacaatattaaaagttgctgatctaaaacgccagatgttaaatgaagtatggctgaatttcattaaaacgtttctcatttgga

SEQ ID NO: 8011 - DNA, 3318 bp, Homo sapiens
tggattccaagtgagaagcaaacattttttacagttattgccagtttccgaggaaccgttccatatggcctgtcattggaaattggagatacagttcagatcctggagaagtgtgatggctggtacagaggatttgccttaaaaaacccaaatatcaagggtatatttccttccagctacgttcacttgaaaaatgcctgtgtaaagaacaaaggacaatttgaaatggttattcccactgaagactctgttatcacagaaatgacatcaacattaagagactggggaaccatgtggaaacaactctatgtgcgtaatgaaggcgatctcttccaccggctgtggcacatcatgaatgaaatcctggacctgaggcggcaggtgctggtgggccacctcacccacgaccggatgaaggacgtgaagcgccacattactgcccggcttgactggggcaatgaacaactgggactggacctggtgcctaggaaagagtacgcaatggtggatccggaagacatcagcattactgagctctaccgattgatggaacatcgacatcggaagaaagacaccccggtgcaggccagcagtcaccacctctttgtccagatgaagagcctcatgtgttccaacctgggagaggagctggaggtcatcttctcactctttgacagtaaagagaaccggccaatcagtgagagatttttcttgaggctgaatagaaacgggcttcccaaagcccctgataaaccggaacgacattgctccctctttgtggatttgggcagcagtgagctaagaaaggacatttatatcaccgtgcacattatccgaatcggtcgaatgggagcaggagaaaaaaagaatgcctgtagtgtccagtaccgacgaccctttggctgtgcagttcttagcatcgctgacctgctaacaggagagacaaaggatgacctcattctgaaagtatacatgtgtaacacagagagtgagtggtaccaaatccatgagaacatcatcaaaaagctgaatgcacgttataacttgactggctccaatgcaggtttagcagtttccttacagctattgcacggagacattgaacaaatcagaagggaatattcatcagtattttctcatggagtatccataacaaggaagctgggattttcaaatattattatgcctggtgaaatgaggaatgatttatatatcactattgaaaggggagaatttgagaaaggagggaagagcgtggccagaaatgtggaagttacgatgttcattgtagacagtagtggccaaaccctgaaggattttatctccttcggctctggggagccaccagccagtgagtaccactcctttgtgctttaccataacaacagtcccaggtggtctgaactgctgaaacttcccattcctgtggataaattccggggtgcacacatccgcttcgagtttcggcattgttccacaaaggagaaaggagagaagaagttgtttgggttttcttttgtccctctgatgcaagaagatggtaggactcttccagatggcactcatgagctcatcgtgcataagtgtgaagaaaacacaaatcttcaggatactacccgctacctcaaacttcccttttccaagggcattttccttgggaataataatcaagccatgaaggccacaaaggagtccttttgtattacatcttttctctgttccacaaaactcacacaaaatggtgatatgcttgatcttttgaaatggagaacccacccagacaagatcactggctgtctctctaaattaaaagaaattgatggctcagagatagtaaagtttctgcaggatacactggataccttatttggaattttagatgaaaattcccaaaaatatgggtctaaagtgtttgattctttggttcacataataaatttgctgcaagatagcaaatttcatcattttaaacctgtaatggacacttacattgagagtcattttgctggggcacttgcatacagagatctcatcaaagtgctcaaatggtacgtggaccggatcacagaagcagagcggcaagagcatatccaggaggtgctgaaggcacaagaatacatttttaagtatatagttcaatctcgaaggctgttttcccttgccactggtgggcaaaacgaagaggagttccgctgctgcattcaggagcttctcatgtcagtccgtttctttctttcgcaagagagcaaagggtctggagcattatctcagtcacaggctgtgtttctgagctctttccctgccgtgtactcagaactgttgaagctctttgatgtccgggaagtagccaacttggtccaggacaccctgggcagtctgccgaccatcctgcatgtggatgattccctgcaggccatcaaactgcagtgcattggcaaaaccgtggaaagccagctttataccaacccagattcccgatacattcttctgcctgtcgtgttacatcacctccacattcacttgcaagaacagaaggacctgatcatgtgtgcacgtatccttagcaacgtattttgtcttatcaagaaaaatagctcagaaaaatctgtgctggaggaaatagatgtgatagtggccagcttgctggatattctgctgaggaccatattggagatcaccagccgacctcagccatccagctcagcaatgcggttccagttccaggatgtcactggggagtttgttgcttgtctcctgtccctattacgacaaatgacagatagacattatcaacagcttcttgatagttttaatacaaaggaagaactaagggatttcctgctgcagatatttactgtgttccgaatattgatacgcccggagatgtttccaaaggactggactgttatgcgcttggttgctaacaatgttattattacaacagttctatacctctcagatgcacttcgtaagaacttcttaaatgaaaactttgattataagatctgggattcctacttttacctcgcagtcatttttataaaccagttgtgtctgcagttggagatgttcacaccttccaagaagaaaaaggtgttagaaaagtatggtgacatgcgggtaacaatgggttgtgaaattttcagcatgtggcaaaacctaggagagcacaagcttcattttatccctgcgctgaggcaggagaatcgcttgaacctgggaggaggaggttgcagtgagccgagagcatgtcactgcactccagcctgggcaacaaagcgagactgtgtctcaaagaaaaaagaaaaaaagacatga

SEQ ID NO: 8012 - DNA, 6385 bp, Homo sapiens
ggggccggggcccggggcggcggcggcgggacgcgaggaccatggctgcctccgagcgccgcgccttcgcgcacaagatcaacaggacggtggccgcagaggtgcggaagcaggtgtcccgggaacgcagtggctccccccactccagcaggcgctgcagcagctccctgggggtcccactgactgaagttgtcgagcccctggactttgaggatgtacttctgagccggccaccagatgctgagcccgggcccctcagggacctggtagaattcccagctgatgacttggagctgctgctgcagccccgggaatgccggaccacggagcccgggatccccaaggatgaaaaactggatgcccaggtgagggccgcggtggagatgtatattgaggactgggtcattgtccacagaaggtatcagtacctgagtgcagcatacagccccgtcaccacagacacacagcgggagcgacagaagggcctcccccgccaggtctttgagcaggatgcttctggagacgagaggtccggccctgaggactcgaatgactcccggcgtggctcgggctccccggaagacacccctcgaagcagtggtgcctctagcatcttcgacctgaggaacctggcagctgactcattgctgccctctctgctagagcgggcggccccagaagatgtggaccggcgcaatgaaacccttcgacggcagcaccggcccccggccctgctcaccctctacccggcacctgacgaggatgaagccgtggaacgctgtagccgcccagagccaccccgcgagcactttggacaaaggatcttggtcaagtgtctgtcgctcaagttcgagattgaaattgagcccatctttgggatcttggctctgtatgatgtgcgggagaaaaagaagatctcggagaacttctacttcgacctgaactcggactccatgaaggggctgcttcgggctcatggcacccaccctgccatctccaccctggcccgctctgccatcttctctgtgacctacccctcacctgacatcttcctggtcatcaagttggagaaggtgcttcagcaaggggacatcagtgagtgctgtgagccttacatggtgttgaaagaagtggacacagccaagaacaaagagaagctagagaagctgcgcctggcggccgagcagttctgcacccgcctgggccgctaccgcatgcccttcgcctggacggccgtgcacttggccaacatcgtgagcagcgctgggcagctggaccgggactctgactcggagggcgagcgccggccagcctggacagaccgccgccgtcgggggccccaggaccgggcgagtagtggggacgacgcctgcagcttctctggcttccgtccagccacgctaactgtcacaaacttctttaagcaggaggctgagcgactcagtgacgaggacctcttcaagttcctggctgacatgaggcgcccgtcgtccctgctgcggcgactacgtcctgtgactgcccagctcaagatcgacatttctccggctcctgaaaatccccacttctgcctctcccctgagctgcttcatatcaagccctacccggaccccaggggccggcccaccaaggagattctggagttccccgcccgcgaagtctatgccccccataccagctacaggaacctgctgtacgtgtacccgcacagcctcaacttcagcagccgccagggctccgtgcgcaaccttgctgtgcgagtgcagtacatgacaggcgaggaccccagccaggctctgccggtcatctttggcaagtccagctgcagtgaatttacccgcgaggccttcacaccggtggtctaccataacaagtcccccgagttctacgaggagttcaagctgcatcttccagcctgcgtgacagagaaccatcacctgctgttcaccttctaccatgtcagctgccagccccggccgggcactgccctggagacacccgtgggctttacttggatcccactgctgcagcacgggcgcctgaggaccggccccttctgtctcccagtgtctgtggaccagccgccgcccagctattccgtgctcacacccgatgtggcgcttccgggcatgcgctgggtggacggtcacaagggcgtgttcagtgtggagctcacagccgtgtcctctgtgcacccccaggacccctacctggacaaattcttcaccctggtgcacgtcctggaggagggagccttcccattccggctcaaggacactgtgctgagcgagggcaacgtggagcaggagctgcgggccagtcttgcagcactgcgcctggccagccccgaaccccttgtggccttctcccaccacgtgctggacaagctcgtgcgtctggtcatcaggcccccgatcatcagtggccagattgtgaacctgggccgtggagcctttgaagcaatggcccatgtagtcagccttgttcaccggagcctggaggcagcccaggatgcccgcggtcactgcccacagctggctgcctacgtccactacgcctttcgccttcctggcactgagcccagcctcccggatggggcccctccagtgacagtgcaggctgccacactggcccgtggctctggtcgccccgcaagcctctacctggcgcgttccaagagcatcagcagcagcaaccctgacctcgccgtggcccctggctctgtggatgacgaggtttcccgcatcctggccagcaagctgcttcacgaggagctggctctgcagtgggtggtcagcagcagtgccgtacgcgaggccatcctccagcacgcctggttcttcttccagctcatggtgaagagtatggcgctgcacctgctgcttggccagcgactagacacaccccgcaagctgcgcttccccggacgcttcctggacgacatcactgccttggtgggctctgtgggcctggaggtcatcacccgtgtccacaaggatgtggagctggccgagcacctcaacgccagcctggctttcttcctcagtgaccttctgtccctggtggaccggggctttgtcttcagcctggtccgggcccactacaagcaggtggccacgcggctccagtcgtcccctaatccagcagccctgctgaccctgcgcatggaattcacccgcatcctgtgcagccacgagcactacgtgaccctcaacctcccctgctgccccctgtcacctccagcctcgccctccccctctgtgtcctccaccacctcccagagctccaccttctccagccaagccccggaccccaaggtgaccagcatgttcgaactgagtggaccattccggcagcagcacttcctagctgggctcctgctgacggagctggcactggccctcgaacctgaggctgaaggggcattcctgttgcacaagaaggccatcagtgctgtgcacagcctgctatgtggccatgacactgacccccgctacgccgaggccactgtgaaggctcgtgtggccgagctgtacctgccactgctatcgattgcacgggataccttgccacggctgcatgactttgctgagggcccaggtcagcggtcaagactggcctcaatgcttgactcagacacagaaggcgaaggggacattgcgggtaccatcaacccctctgtggccatggccattgctggtggccccctagcccctggctcccgggccagcatctcccaggggccaccaacggcttctcgcgcaggctgtgccctctctgctgagtcaagccggaccttgctggcgtgtgtgctgtgggtgctgaaaaacaccgagccggcgctcctgcagcgctgggccactgacctgacactcccccagctgggacgtctgttggatttgctgtacctttgcctagctgcctttgagtacaaggggaaaaaggcctttgaacgcatcaacagcctcacattcaaaaaatctctggatatgaaggcgcggctagaggaagccattctgggtaccatcggagctcgacaagaaatggttcggcgaagtcgtgagaggagcccgtttgggaatccggagaatgtgcgctggcggaagagcgtcacacactggaagcaaacctcagaccgcgtggacaagaccaaggatgaaatggaacacgaggccttggtggaagggaacctggcaaccgaggcaagcctagtggttctggacacactggagatcatcgtgcagacggtgatgctttcagaagcccgggagagcgtcttgggggcagtgctgaaggttgtgctgtacagcctgggcagtgcccagagtgccctcttcttgcagcatggcctggccacccagagggcccttgtgtccaagttcccggagctgctgttcgaggaggacacggagctgtgtgccgacctgtgcctgaggctcctacgacactgtggcagccgcatcagcaccatccgcacgcacgccagcgcctcgctgtacctgctcatgcgacagaacttcgagatcggccacaactttgcccgtgtgaagatgcaggtcaccatgtctctctcgtccctggtggggacgacgcagaacttcagtgaagagcacctgcgacgttcactcaaaaccatcctcacctatgctgaggaggacatggggctgcgggacagcaccttcgcagagcaggtccaggacctgatgttcaacctgcacatgatcctgacggacacggtgaagatgaaggaacaccaggaggaccctgagatgctcatcgacctcatgtacagaattgcccggggctaccagggctcaccggaccttcggctgacctggttgcagaacatggccgggaagcacgcggagctgggcaaccacgccgaggccgcccagtgcatggtgcacgcggccgccctcgtggctgagtacctcgccctgctcgaggaccaccgccacctgcccgtgggctgcgtttccttccagaacatctcatccaacgtgctagaggagtccgccatctccgacgacatcctgtcgcccgacgaggagggcttctgctccgggaagcacttcactgagctggggctggtagggttgctggaacaggcagccggctacttcaccatgggcgggctctacgaggcggtgaatgaggtctacaagaacctcatccccatcctggaagcccaccgtgactacaagaagctggccgcggtgcacggcaaactgcaggaggccttcaccaagatcatgcaccagagttccggctgggagcgcgtgttcgggacgtatttccgcgtgggcttctacggcgcccacttcggtgacctggatgagcaggagtttgtgtacaaggagccatcgatcacgaagctggcagagatctcacaccggctggaggagttctacacggagagatttggcgacgacgtcgttgagattatcaaagactctaaccctgtggacaagtccaagcttgactcacaaaaggcctacatccagatcacgtatgtggaaccgtactttgatacctacgagctcaaggaccgggtgacctactttgaccgcaactatgggcttcgcacattcctgttctgcacgccgttcacgccggatgggcgcgcacacggggagctgcccgagcaacacaagcgtaagacgctgctcagcaccgaccacgccttcccctacatcaagactcgcatccgtgtgtgccaccgggaggagacggtgctgacgccagtggaggtggccatcgaggacatgcagaagaagacacgggagctggcctttgccaccgagcaggacccaccagatgctaagatgctacagatggtgcttcagggctctgtagggcccaccgtgaaccagggtcccctggaggtggcccaggtgtttttagcagagatcccggaagaccccaagctcttccggcatcacaacaaattgcggctctgcttcaaggacttctgcaagaaatgtgaggatgcgctgcggaaaaataaggccctgattgggccggaccagaaggagtaccaccgtgagctggagcgcaactactgccgcctgcgggaggctctgcagcccctgcttacccagcgcctgccccagctgatggcacccaccccacccggcctcaggaactccttgaacagagcaagtttccgaaaggcagacctctgagcccacaaggaccaaagctgtacctagaggaaccagcacccgggcctcagctgtctgtgctgcgaggggagtctgccctggtgcccactgggctgtggggtgaccacactgtacttggggctgggccctctgcccctgtgtccccatctgtgtgcactgatgcttcctcccttttttaatttaaaatggtttttataagc

SEQ ID NO: 8013 - DNA, 4660 bp, Homo sapiens
aatttacccgcgaggccttcacaccggtggtctaccataacaagtcccccgagttctacgaggagttcaagctgcatcttccagcctgcgtgacagagaaccatcacctgctgttcaccttctaccatgtcagctgccagccccggccgggcactgccctggagacacccgtgggctttacttggatcccactgctgcagcacgggcgcctgaggaccggccccttctgtctcccagtgtctgtggaccagccgccgcccagctattccgtgctcacacccgatgtggcgcttccgggcatgcgctgggtggacggtcacaagggcgtgttcagtgtggagctcacagccgtgtcctctgtgcacccccaggacccctacctggacaaattcttcaccctggtgcacgtcctggaggagggagccttcccattccggctcaaggacactgtgctgagcgagggcaacgtggagcaggagctgcgggccagtcttgcagcactgcgcctggccagccccgaaccccttgtggccttctcccaccacgtgctggacaagctcgtgcgtctggtcatcaggcccccgatcatcagtggccagattgtgaacctgggccgtggagcctttgaagcaatggcccatgtagtcagccttgttcaccggagcctggaggcagcccaggatgcccgcggtcactgcccacagctggctgcctacgtccactacgcctttcgccttcctggcactgagcccagcctcccggatggggcccctccagtgacagtgcaggctgccacactggcccgtggctctggtcgccccgcaagcctctacctggcgcgttccaagagcatcagcagcagcaaccctgacctcgccgtggcccctggctctgtggatgacgaggtttcccgcatcctggccagcaagggcatcgatcgctcacactcctgggtgaattccgcttatgctccaggaggcagtaaggctgtgctgcggcgggcgcccccttattgtggggccgaccccagacagctgcttcacgaggagctggctctgcagtgggtggtcagcagcagtgccgtacgcgaggccatcctccagcacgcctggttcttcttccagctcatggtgaagagtatggcgctgcacctgctgcttggccagcgactagacacaccccgcaagctgcgcttccccggacgcttcctggacgacatcactgccttggtgggctctgtgggcctggaggtcatcacccgtgtccacaaggatgtggagctggccgagcacctcaacgccagcctggctttcttcctcagtgaccttctgtccctggtggaccggggctttgtcttcagcctggtccgggcccactacaagcaggtggccacgcggctccagtcgtcccctaatccagcagccctgctgaccctgcgcatggaattcacccgcatcctgtgcagccacgagcactacgtgaccctcaacctcccctgctgccccctgtcacctccagcctcgccctccccctctgtgtcctccaccacctcccagagctccaccttctccagccaagccccggaccccaaggtgaccagcatgttcgaactgagtggaccattccggcagcagcacttcctagctgggctcctgctgacggagctggcactggccctcgaacctgaggctgaaggggcattcctgttgcacaagaaggccatcagtgctgtgcacagcctgctatgtggccatgacactgacccccgctacgccgaggccactgtgaaggctcgtgtggccgagctgtacctgccactgctatcgattgcacgggataccttgccacggctgcatgactttgctgagggcccaggtcagcggtcaagactggcctcaatgcttgactcagacacagaaggcgaaggggacattgcgggtaccatcaacccctctgtggccatggccattgctggtggccccctagcccctggctcccgggccagcatctcccaggggccaccaacggcttctcgcgcaggctgtgccctctctgctgagtcaagccggaccttgctggcgtgtgtgctgtgggtgctgaaaaacaccgagccggcgctcctgcagcgctgggccactgacctgacactcccccagctgggacgtctgttggatttgctgtacctttgcctagctgcctttgagtacaaggggaaaaaggcctttgaacgcatcaacagcctcacattcaaaaaatctctggatatgaaggcgcggctagaggaagccattctgggtaccatcggagctcgacaagaaatggttcggcgaagtcgtgagaggagcccgtttgggaatccggagaatgtgcgctggcggaagagcgtcacacactggaagcaaacctcagaccgcgtggacaagaccaaggatgaaatggaacacgaggccttggtggaagggaacctggcaaccgaggcaagcctagtggttctggacacactggagatcatcgtgcagacggtgatgctttcagaagcccgggagagcgtcttgggggcagtgctgaaggttgtgctgtacagcctgggcagtgcccagagtgccctcttcttgcagcatggcctggccacccagagggcccttgtgtccaagttcccggagctgctgttcgaggaggacacggagctgtgtgccgacctgtgcctgaggctcctacgacactgtggcagccgcatcagcaccatccgcacgcacgccagcgcctcgctgtacctgctcatgcgacagaacttcgagatcggccacaactttgcccgtgtgaagatgcaggtcaccatgtctctctcgtccctggtggggacgacgcagaacttcagtgaagagcacctgcgacgttcactcaaaaccatcctcacctatgctgaggaggacatggggctgcgggacagcaccttcgcagagcaggtccaggacctgatgttcaacctgcacatgatcctgacggacacggtgaagatgaaggaacaccaggaggaccctgagatgctcatcgacctcatgtacagaattgcccggggctaccagggctcaccggaccttcggctgacctggttgcagaacatggccgggaagcacgcggagctgggcaaccacgccgaggccgcccagtgcatggtgcacgcggccgccctcgtggctgagtacctcgccctgctcgaggaccaccgccacctgcccgtgggctgcgtttccttccagaacatctcatccaacgtgctagaggagtccgccatctccgacgacatcctgtcgcccgacgaggagggcttctgctccgggaagcacttcactgagctggggctggtagggttgctggaacaggcagccggctacttcaccatgggcgggctctacgaggcggtgaatgaggtctacaagaacctcatccccatcctggaagcccaccgtgactacaagaagctggccgcggtgcacggcaaactgcaggaggccttcaccaagatcatgcaccagagttccggctgggagcgcgtgttcgggacgtatttccgcgtgggcttctacggcgcccacttcggtgacctggatgagcaggagtttgtgtacaaggagccatcgatcacgaagctggcagagatctcacaccggctggaggagttctacacggagagatttggcgacgacgtcgttgagattatcaaagactctaaccctgtggacaagtccaagcttgactcacaaaaggcctacatccagatcacgtatgtggaaccgtactttgatacctacgagctcaaggaccgggtgacctactttgaccgcaactatgggcttcgcacattcctgttctgcacgccgttcacgccggatgggcgcgcacacggggagctgcccgagcaacacaagcgtaagacgctgctcagcaccgaccacgccttcccctacatcaagactcgcatccgtgtgtgccaccgggaggagacggtgctgacgccagtggaggtggccatcgaggacatgcagaagaagacacgggagctggcctttgccaccgagcaggacccaccagatgctaagatgctacagatggtgcttcagggctctgtagggcccaccgtgaaccagggtcccctggaggtggcccaggtgtttttagcagagatcccggaagaccccaagctcttccggcatcacaacaaattgcggctctgcttcaaggacttctgcaagaaatgtgaggatgcgctgcggaaaaataaggccctgattgggccggaccagaaggagtaccaccgtgagctggagcgcaactactgccgcctgcgggaggctctgcagcccctgcttacccagcgcctgccccagctgatggcacccaccccacccggcctcaggaactccttgaacagagcaagtttccgaaaggcagacctctgagcccacaaggaccaaagctgtacctagaggaaccagcacccgggcctcagctgtctgtgctgcgaggggagtctgccctggtgcccactgggctgtggggtgaccacactgtacttggggctgggccctctgcccctgtgtccccatctgtgtgcactgatgcttcctcccttttttaatttaaaatggtttttataagc

SEQ ID NO: 8014 - DNA, 7356 bp, Homo sapiens
gacagacgaggtttgcgcttggctgggcatgttccgcggctactctgcggcgcgccaggcccccgctttccgcaccccgcgaccctagaagccaccgaaccgccggcgggccatggccactctgccgagcgcagagcgccgcgcgttcgcgctcaagatcaacaggtattcttcagcggaaataaggaaacagtttactctcccaccaaaccttggccagtaccatcgacagagcataagtacctctggcttcccctctcttcaactacctcagttttatgaccctgtggagccagtggactttgaaggacttctgatgacacacctgaacagcctggatgtgcagcttgcccaggagctcggggacttcactgatgacgacttggacgtggtgttcacgccaaaggaatgtaggactttgcagccctctttgccggaggaaggggttgaactggaccctcatgtcagggactgtgttcagacctacatccgtgagtggctaatcgtgaaccggaaaaaccaaggaagtccagaaatctgtggctttaaaaagactggatctcgaaaagattttcacaagacgcttccgaaacagacgtttgagtcggaaaccttggagtgcagtgaacccgctgctcaggcaggcccccgccacttaaacgtgctgtgcgacgtgtctgggaaaggccccgtcactgcctgtgactttgacctccgcagcctgcagcctgacaagcggctagaaaacctcctgcagcaagtgagtgccgaggactttgagaagcagaacgaggaggcccggaggaccaataggcaggccgagctctttgccctttacccatcagtggacgaggaggatgctgtggaaatacgtccagtaccagaatgtcccaaggaacacctgggcaacagaatattggtcaagttgctgaccttgaagttcgagattgaaattgagcccctgtttgccagcattgccctctacgatgttaaagaaaggaaaaagatctcagaaaattttcactgtgacctgaactctgaccagttcaaaggatttctgcgagctcacacgccttcagtggccgcatcaagtcaggcgagatctgcagtcttctcagtcacctacccgtcctcagacatctacctggtagtcaagattgaaaaagtcctgcagcagggagagattggagactgtgcagagccctacacggttatcaaagaaagtgatggtggaaagagtaaagaaaagattgaaaaactaaaactccaagctgaatccttctgccagcgtttggggaaataccggatgccctttgcctgggcacccataagcttatcaagcttcttcaatgtctccacccttgagagggaggtaactgatgtggactctgtggttgggagaagctcagtgggtgaacggaggacattggcccaatctagaaggctttctgaaagagccctctccttggaggaaaatggggttggatccaacttcaaaacctccactctgagcgttagcagctttttcaagcaggaaggagatcgccttagcgatgaagacttattcaagtttttagctgactacaaaagatcatcatccttacagagacgagtcaagtcaattccaggcttgctaagactggagatttctacagctccagagatcatcaattgctgtctgactcctgaaatgctgcccgtgaaaccctttcctgaaaaccggacacgcccgcacaaagagattttggaatttccaacacgagaagtatatgtccctcacactgtgtacagaaaccttctctatgtctacccacagaggctgaactttgtaaacaaactagcatcagcccggaacattacaataaagatccagtttatgtgtggagaagatgctagcaatgcgatgccggtcatctttggaaaatccagcgggcctgaatttctgcaggaagtgtacacagctgttacataccataataagtctcctgacttttatgaagaagtgaaaattaagctccccgctaagctcacagtaaatcaccacctcctgttcaccttctaccatatcagctgtcagcagaagcaaggagcctccgtggaaactctcctgggatattcatggctgccaattctcttaaatgaacgtcttcaaactggatcctactgtctcccagttgccttggaaaaattgccacccaactactccatgcattctgctgagaaagtcccattacagaatcctcccattaagtgggctgaaggacataagggagtatttaatattgaagtgcaagctgtttcttctgtacacacccaggacaaccacctggagaagttcttcaccctctgccactccctggagagccaggtgaccttccccatccgcgtgctggatcagaaaatcagcgagatggcgctggagcatgagctgaagctcagcatcatctgcctgaactcctcccgcctggagccgctcgtgctcttcctgcacctggtgctggacaagctcttccagctgtccgtgcagcccatggtcatcgctggccagacagccaacttctcccagtttgccttcgagtccgtggtggccatcgccaacagtctgcacaacagcaaggacctgagcaaggaccagcatgggaggaactgcctgctggcttcctacgtgcactacgtcttccgcctgccagaggtgcaaagggatgtgcccaagtcaggcgctcccactgccctcctagaccctcggagctaccacacgtatggccgcacatcagctgctgctgtgagttcaaagctgctgcaggcccgggtgatgagcagcagtaacccagacctcgcggggacacactccgcagcagacgaggaagtgaagaacatcatgtcttcaaagcatttccatgaggagcttgcccttcagatggtggtcagcaccggaatggtgagagaaacagtcttcaagtatgcctggttcttctttgagcttctggtgaaaagcatggcccagcacgtacataacatggacaaacgggacagttttcggaggactcgtttttctgaccgtttcatggatgacataactactattgttaatgtggtcacctcggaaattgcagcccttttagtaaaaccacagaaggaaaatgaacaggcggaaaagatgaacatcagcctggctttcttcttgtatgaccttctctccctcatggatcggggctttgtgtttaacctcatcagacattattgcagccagctgtcagccaagctcagtaaccttccaacgctcatttccatgaggctagagttcctgagaatcctctgtagccatgagcattacctcaatctgaaccttttttttatgaatgctgatactgctccaacatctccttgtccttccatatcttcccagaactcaagctcctgctccagcttccaggaccagaagatcgccagcatgttcgatctgacttccgagtaccgccagcagcacttcctcaccgggctcctcttcacagaactggctgctgccctggatgccgaaggggaaggaatcagcaaagtacaaaggaaagctgtcagtgcaattcacagcctgctaagttctcacgacctggacccacgctgtgtcaaaccagaggtgaaggtcaaaatcgccgccctttacctacctttagttggcatcattttggatgctttgccacagctctgtgactttacagttgcagatactcgcagataccgcaccagtggctcggatgaagaacaagaaggagccggtgccattaaccagaatgtggctctggccatagcagggaataatttcaatttgaaaacaagtggaatagtgctgtcttccttgccctataagcagtacaacatgctgaacgcggacactactcgcaacctcatgatctgcttcctctggatcatgaaaaatgctgatcagagcctcattaggaagtggattgctgacctgccatcaacgcagctcaacaggattttagatctacttttcatctgtgtgttatgttttgagtataagggaaaacagagttctgacaaagtcagtacccaagtcctgcagaagtcaagggatgtcaaggcccggctggaagaggctttgctccgtggggaaggggccagaggggagatgatgcgccgccgggctccagggaacgaccgatttccaggcctaaatgaaaatttgagatggaagaaagagcagacacattggcggcaagctaatgagaagctagataaaacaaaggccgagttagatcaagaagccttgatcagtggcaatctggctacagaagcacatttaatcatcctggatatgcaggaaaacattatccaggcgagctcggctctggactgtaaagacagcctgctgggaggtgttctgagggtgctggtgaattctctgaactgtgatcagagtaccacctacctgactcactgctttgcaacactccgtgctctcatcgccaagtttggagacttactctttgaagaggaggtggaacagtgtttcgacctatgtcaccaagtcctgcaccactgcagcagcagcatggatgtcacccggagccaagcctgtgccaccctttacctcctcatgaggttcagttttggagccaccagtaattttgcaagagtaaagatgcaagtaaccatgtccctggcatctttggtgggaagagcaccagactttaatgaagagcacctgagaagatccttgaggacaattttggcctattcagaagaggacacagccatgcagatgactccttttcccacccaggtggaggaacttctctgtaatctgaatagcatcttatatgacacagtgaaaatgagggaatttcaggaagatcctgagatgcttatggatctcatgtacagaattgccaagagttaccaggcatctcctgatctgcggctgacctggctccagaacatggcagagaaacacaccaagaagaagtgctacacggaggctgccatgtgcctggtgcacgccgctgcgttagtggctgagtatctgagcatgctggaggaccacagctacctgcccgtgggcagtgtcagcttccagaatatttcttccaatgtgctggaggagtctgtggtctctgaggacaccctgtcacctgacgaggatggggtgtgcgcaggccagtacttcaccgagagtggcctggtaggcctcctggagcaggccgcggagctcttcagcacgggaggcttatatgagacagttaatgaggtctacaagctggtcatccccatcctagaagcgcatcgagaattccggaagctgacactcactcacagcaagctgcagagagccttcgacagcatcgttaacaaggatcataagagaatgtttggaacctacttccgagttggtttctttggatccaaatttggggatttggatgaacaggagtttgtctacaaagagcctgcaattaccaagcttcctgagatctcacatagactagaggcattttatggtcaatgttttggtgcagaatttgtggaagtgattaaagactccactcctgtggacaaaaccaagttggatcctaacaaggcctacatacagatcacttttgtggagccctactttgatgagtatgagatgaaagacagggtcacatactttgagaagaatttcaacctccggaggttcatgtacaccaccccgttcaccctggaggggcggcctcggggagagctgcatgagcagtacagaaggaacacagtcctgaccactatgcacgccttcccctacatcaagaccaggatcagcgtcatccagaaggaggagtttgttttgacaccgattgaagttgccattgaagacatgaagaagaagaccctgcagttagcagttgccattaaccaggagccgcctgatgcaaagatgcttcagatggtgctgcaaggctctgtgggagctactgtaaatcagggaccactggaagtagcccaagtgtttttggctgaaattcctgctgatccaaaactctatcgacatcacaacaagttgaggttatgctttaaggaattcatcatgagatgtggtgaagctgtagagaaaaacaagcgtctcatcacggcagaccagagggaatatcagcaggaactcaaaaagaactataacaagctaaaagagaacctcaggccaatgatcgagcggaaaattccagaactgtacaagccaatattcagagttgagagtcaaaagagggactccttccacagatctagtttcaggaaatgtgaaacccagttgtcacagggcagctaagaaaagccatcttcattcgtggagactgtggccctgcaaccctggagaaggacttgctggtacttaaaaaatgggacatttgccacccaggactgactgtacactccctgatcagccagcactctggaagctttgggatcccaggaaccatggaattattcccaaatggactctgaccagatttttgccatactggggggtggcgggatggaggatgggtactcaggcatgactgcgtatttattaaagtgtgtttttccacaatgtaccaaacaaggcataagcagcttctcctgctgactggccaatcactgcccatctgagagatgatttcctctggcccatatttgaatttattggagtaactcaaattgcctgaggaaaaatggaaaaattatccaccagtcgattcaaactgaatttcactctttataggaaggcagggcaaacttgtaggagtacgaaacattttcaataaatctacaaagggaagccttactacaattccaaaaatcatcatggttggaaatttgggaggagattatttgtgaacttgttacccttttggtaatggtggactaattgctgtatagttatttttgttttattattactgttacattaatttaacatgcatttatagaagaatacattcaaagcactgatgtaggagatacacggtacttggagcagtcagccagaaatcacagatactgctttcacttaaatggaaacaattctccgataatgctttgctttttttcttatgtcactcttgtgtactatctatttttctcctctctgggaccaagtttctttttataaagcaataatatctctgttttcatttcagaacattgtgctgtctgtcagcatatgtatatcagctacaaaatatattcaactttgacttcttttgacaaaggactttaggaaaaagaggaacaaagacattatttgagaattaaattatatatttttaatatgactgtgaccttgactgataataaagatgtaataagaattgcaagctaaatgtt

SEQ ID NO: 8015 - DNA, 7452 bp, Homo sapiens
gacagacgaggtttgcgcttggctgggcatgttccgcggctactctgcggcgcgccaggcccccgctttccgcaccccgcgaccctagaagccaccgaaccgccggcgggccatggccactctgccgagcgcagagcgccgcgcgttcgcgctcaagatcaacaggtattcttcagcggaaataaggaaacagtttactctcccaccaaaccttggccagtaccatcgacagagcataagtacctctggcttcccctctcttcaactacctcagttttatgaccctgtggagccagtggactttgaaggacttctgatgacacacctgaacagcctggatgtgcagcttgcccaggagctcggggacttcactgatgacgacttggacgtggtgttcacgccaaaggaatgtaggactttgcagccctctttgccggaggaaggggttgaactggaccctcatgtcagggactgtgttcagacctacatccgtgagtggctaatcgtgaaccggaaaaaccaaggaagtccagaaatctgtggctttaaaaagactggatctcgaaaagattttcacaagacgcttccgaaacagacgtttgagtcggaaaccttggagtgcagtgaacccgctgctcaggcaggcccccgccacttaaacgtgctgtgcgacgtgtctgggaaaggccccgtcactgcctgtgactttgacctccgcagcctgcagcctgacaagcggctagaaaacctcctgcagcaagtgagtgccgaggactttgagaagcagaacgaggaggcccggaggaccaataggcaggccgagctctttgccctttacccatcagtggacgaggaggatgctgtggaaatacgtccagtaccagaatgtcccaaggaacacctgggcaacagaatattggtcaagttgctgaccttgaagttcgagattgaaattgagcccctgtttgccagcattgccctctacgatgttaaagaaaggaaaaagatctcagaaaattttcactgtgacctgaactctgaccagttcaaaggatttctgcgagctcacacgccttcagtggccgcatcaagtcaggcgagatctgcagtcttctcagtcacctacccgtcctcagacatctacctggtagtcaagattgaaaaagtcctgcagcagggagagattggagactgtgcagagccctacacggttatcaaagaaagtgatggtggaaagagtaaagaaaagattgaaaaactaaaactccaagctgaatccttctgccagcgtttggggaaataccggatgccctttgcctgggcacccataagcttatcaagcttcttcaatgtctccacccttgagagggaggtaactgatgtggactctgtggttgggagaagctcagtgggtgaacggaggacattggcccaatctagaaggctttctgaaagagccctctccttggaggaaaatggggttggatccaacttcaaaacctccactctgagcgttagcagctttttcaagcaggaaggagatcgccttagcgatgaagacttattcaagtttttagctgactacaaaagatcatcatccttacagagacgagtcaagtcaattccaggcttgctaagactggagatttctacagctccagagatcatcaattgctgtctgactcctgaaatgctgcccgtgaaaccctttcctgaaaaccggacacgcccgcacaaagagattttggaatttccaacacgagaagtatatgtccctcacactgtgtacagaaaccttctctatgtctacccacagaggctgaactttgtaaacaaactagcatcagcccggaacattacaataaagatccagtttatgtgtggagaagatgctagcaatgcgatgccggtcatctttggaaaatccagcgggcctgaatttctgcaggaagtgtacacagctgttacataccataataagtctcctgacttttatgaagaagtgaaaattaagctccccgctaagctcacagtaaatcaccacctcctgttcaccttctaccatatcagctgtcagcagaagcaaggagcctccgtggaaactctcctgggatattcatggctgccaattctcttaaatgaacgtcttcaaactggatcctactgtctcccagttgccttggaaaaattgccacccaactactccatgcattctgctgagaaagtcccattacagaatcctcccattaagtgggctgaaggacataagggagtatttaatattgaagtgcaagctgtttcttctgtacacacccaggacaaccacctggagaagttcttcaccctctgccactccctggagagccaggtgaccttccccatccgcgtgctggatcagaaaatcagcgagatggcgctggagcatgagctgaagctcagcatcatctgcctgaactcctcccgcctggagccgctcgtgctcttcctgcacctggtgctggacaagctcttccagctgtccgtgcagcccatggtcatcgctggccagacagccaacttctcccagtttgccttcgagtccgtggtggccatcgccaacagtctgcacaacagcaaggacctgagcaaggaccagcatgggaggaactgcctgctggcttcctacgtgcactacgtcttccgcctgccagaggtgcaaagggatgtgcccaagtcaggcgctcccactgccctcctagaccctcggagctaccacacgtatggccgcacatcagctgctgctgtgagttcaaagctgctgcaggcccgggtgatgagcagcagtaacccagacctcgcggggacacactccgcagcagacgaggaagtgaagaacatcatgtcttcaaagatcgccgatcgcaactgcagccgaatgtcttactattgctctggcagtagtgatgctccaagttcacctgcagccccaaggccagccagcaaaaagcatttccatgaggagcttgcccttcagatggtggtcagcaccggaatggtgagagaaacagtcttcaagtatgcctggttcttctttgagcttctggtgaaaagcatggcccagcacgtacataacatggacaaacgggacagttttcggaggactcgtttttctgaccgtttcatggatgacataactactattgttaatgtggtcacctcggaaattgcagcccttttagtaaaaccacagaaggaaaatgaacaggcggaaaagatgaacatcagcctggctttcttcttgtatgaccttctctccctcatggatcggggctttgtgtttaacctcatcagacattattgcagccagctgtcagccaagctcagtaaccttccaacgctcatttccatgaggctagagttcctgagaatcctctgtagccatgagcattacctcaatctgaaccttttttttatgaatgctgatactgctccaacatctccttgtccttccatatcttcccagaactcaagctcctgctccagcttccaggaccagaagatcgccagcatgttcgatctgacttccgagtaccgccagcagcacttcctcaccgggctcctcttcacagaactggctgctgccctggatgccgaaggggaaggaatcagcaaagtacaaaggaaagctgtcagtgcaattcacagcctgctaagttctcacgacctggacccacgctgtgtcaaaccagaggtgaaggtcaaaatcgccgccctttacctacctttagttggcatcattttggatgctttgccacagctctgtgactttacagttgcagatactcgcagataccgcaccagtggctcggatgaagaacaagaaggagccggtgccattaaccagaatgtggctctggccatagcagggaataatttcaatttgaaaacaagtggaatagtgctgtcttccttgccctataagcagtacaacatgctgaacgcggacactactcgcaacctcatgatctgcttcctctggatcatgaaaaatgctgatcagagcctcattaggaagtggattgctgacctgccatcaacgcagctcaacaggattttagatctacttttcatctgtgtgttatgttttgagtataagggaaaacagagttctgacaaagtcagtacccaagtcctgcagaagtcaagggatgtcaaggcccggctggaagaggctttgctccgtggggaaggggccagaggggagatgatgcgccgccgggctccagggaacgaccgatttccaggcctaaatgaaaatttgagatggaagaaagagcagacacattggcggcaagctaatgagaagctagataaaacaaaggccgagttagatcaagaagccttgatcagtggcaatctggctacagaagcacatttaatcatcctggatatgcaggaaaacattatccaggcgagctcggctctggactgtaaagacagcctgctgggaggtgttctgagggtgctggtgaattctctgaactgtgatcagagtaccacctacctgactcactgctttgcaacactccgtgctctcatcgccaagtttggagacttactctttgaagaggaggtggaacagtgtttcgacctatgtcaccaagtcctgcaccactgcagcagcagcatggatgtcacccggagccaagcctgtgccaccctttacctcctcatgaggttcagttttggagccaccagtaattttgcaagagtaaagatgcaagtaaccatgtccctggcatctttggtgggaagagcaccagactttaatgaagagcacctgagaagatccttgaggacaattttggcctattcagaagaggacacagccatgcagatgactccttttcccacccaggtggaggaacttctctgtaatctgaatagcatcttatatgacacagtgaaaatgagggaatttcaggaagatcctgagatgcttatggatctcatgtacagaattgccaagagttaccaggcatctcctgatctgcggctgacctggctccagaacatggcagagaaacacaccaagaagaagtgctacacggaggctgccatgtgcctggtgcacgccgctgcgttagtggctgagtatctgagcatgctggaggaccacagctacctgcccgtgggcagtgtcagcttccagaatatttcttccaatgtgctggaggagtctgtggtctctgaggacaccctgtcacctgacgaggatggggtgtgcgcaggccagtacttcaccgagagtggcctggtaggcctcctggagcaggccgcggagctcttcagcacgggaggcttatatgagacagttaatgaggtctacaagctggtcatccccatcctagaagcgcatcgagaattccggaagctgacactcactcacagcaagctgcagagagccttcgacagcatcgttaacaaggatcataagagaatgtttggaacctacttccgagttggtttctttggatccaaatttggggatttggatgaacaggagtttgtctacaaagagcctgcaattaccaagcttcctgagatctcacatagactagaggcattttatggtcaatgttttggtgcagaatttgtggaagtgattaaagactccactcctgtggacaaaaccaagttggatcctaacaaggcctacatacagatcacttttgtggagccctactttgatgagtatgagatgaaagacagggtcacatactttgagaagaatttcaacctccggaggttcatgtacaccaccccgttcaccctggaggggcggcctcggggagagctgcatgagcagtacagaaggaacacagtcctgaccactatgcacgccttcccctacatcaagaccaggatcagcgtcatccagaaggaggagtttgttttgacaccgattgaagttgccattgaagacatgaagaagaagaccctgcagttagcagttgccattaaccaggagccgcctgatgcaaagatgcttcagatggtgctgcaaggctctgtgggagctactgtaaatcagggaccactggaagtagcccaagtgtttttggctgaaattcctgctgatccaaaactctatcgacatcacaacaagttgaggttatgctttaaggaattcatcatgagatgtggtgaagctgtagagaaaaacaagcgtctcatcacggcagaccagagggaatatcagcaggaactcaaaaagaactataacaagctaaaagagaacctcaggccaatgatcgagcggaaaattccagaactgtacaagccaatattcagagttgagagtcaaaagagggactccttccacagatctagtttcaggaaatgtgaaacccagttgtcacagggcagctaagaaaagccatcttcattcgtggagactgtggccctgcaaccctggagaaggacttgctggtacttaaaaaatgggacatttgccacccaggactgactgtacactccctgatcagccagcactctggaagctttgggatcccaggaaccatggaattattcccaaatggactctgaccagatttttgccatactggggggtggcgggatggaggatgggtactcaggcatgactgcgtatttattaaagtgtgtttttccacaatgtaccaaacaaggcataagcagcttctcctgctgactggccaatcactgcccatctgagagatgatttcctctggcccatatttgaatttattggagtaactcaaattgcctgaggaaaaatggaaaaattatccaccagtcgattcaaactgaatttcactctttataggaaggcagggcaaacttgtaggagtacgaaacattttcaataaatctacaaagggaagccttactacaattccaaaaatcatcatggttggaaatttgggaggagattatttgtgaacttgttacccttttggtaatggtggactaattgctgtatagttatttttgttttattattactgttacattaatttaacatgcatttatagaagaatacattcaaagcactgatgtaggagatacacggtacttggagcagtcagccagaaatcacagatactgctttcacttaaatggaaacaattctccgataatgctttgctttttttcttatgtcactcttgtgtactatctatttttctcctctctgggaccaagtttctttttataaagcaataatatctctgttttcatttcagaacattgtgctgtctgtcagcatatgtatatcagctacaaaatatattcaactttgacttcttttgacaaaggactttaggaaaaagaggaacaaagacattatttgagaattaaattatatatttttaatatgactgtgaccttgactgataataaagatgtaataagaattgcaagctaaatgtt

SEQ ID NO: 8016 - DNA, 7448 bp, Homo sapiens
gacagacgaggtttgcgcttggctgggcatgttccgcggctactctgcggcgcgccaggcccccgctttccgcaccccgcgaccctagaagccaccgaaccgccggcgggccatggccactctgccgagcgcagagcgccgcgcgttcgcgctcaagatcaacaggtattcttcagcggaaataaggaaacagtttactctcccaccaaaccttggccagtaccatcgacagagcataagtacctctggcttcccctctcttcaactacctcagttttatgaccctgtggagccagtggactttgaaggacttctgatgacacacctgaacagcctggatgtgcagcttgcccaggagctcggggacttcactgatgacgacttggacgtggtgttcacgccaaaggaatgtaggactttgcagccctctttgccggaggaaggggttgaactggaccctcatgtcagggactgtgttcagacctacatccgtgagtggctaatcgtgaaccggaaaaaccaaggaagtccagaaatctgtggctttaaaaagactggatctcgaaaagattttcacaagacgcttccgaaacagacgtttgagtcggaaaccttggagtgcagtgaacccgctgctcaggcaggcccccgccacttaaacgtgctgtgcgacgtgtctgggaaaggccccgtcactgcctgtgactttgacctccgcagcctgcagcctgacaagcggctagaaaacctcctgcagcaagtgagtgccgaggactttgagaagcagaacgaggaggcccggaggaccaataggcaggccgagctctttgccctttacccatcagtggacgaggaggatgctgtggaaatacgtccagtaccagaatgtcccaaggaacacctgggcaacagaatattggtcaagttgctgaccttgaagttcgagattgaaattgagcccctgtttgccagcattgccctctacgatgttaaagaaaggaaaaagatctcagaaaattttcactgtgacctgaactctgaccagttcaaaggatttctgcgagctcacacgccttcagtggccgcatcaagtcaggcgagatctgcagtcttctcagtcacctacccgtcctcagacatctacctggtagtcaagattgaaaaagtcctgcagcagggagagattggagactgtgcagagccctacacggttatcaaagaaagtgatggtggaaagagtaaagaaaagattgaaaaactaaaactccaagctgaatccttctgccagcgtttggggaaataccggatgccctttgcctgggcacccataagcttatcaagcttcttcaatgtctccacccttgagagggaggtaactgatgtggactctgtggttgggagaagctcagtgggtgaacggaggacattggcccaatctagaaggctttctgaaagagccctctccttggaggaaaatggggttggatccaacttcaaaacctccactctgagcgttagcagctttttcaagcaggaaggagatcgccttagcgatgaagacttattcaagtttttagctgactacaaaagatcatcatccttacagagacgagtcaagtcaattccaggcttgctaagactggagatttctacagctccagagatcatcaattgctgtctgactcctgaaatgctgcccgtgaaaccctttcctgaaaaccggacacgcccgcacaaagagattttggaatttccaacacgagaagtatatgtccctcacactgtgtacagaaaccttctctatgtctacccacagaggctgaactttgtaaacaaactagcatcagcccggaacattacaataaagatccagtttatgtgtggagaagatgctagcaatgcgatgccggtcatctttggaaaatccagcgggcctgaatttctgcaggaagtgtacacagctgttacataccataataagtctcctgacttttatgaagaagtgaaaattaagctccccgctaagctcacagtaaatcaccacctcctgttcaccttctaccatatcagctgtcagcagaagcaaggagcctccgtggaaactctcctgggatattcatggctgccaattctcttaaatgaacgtcttcaaactggatcctactgtctcccagttgccttggaaaaattgccacccaactactccatgcattctgctgagaaagtcccattacagaatcctcccattaagtgggctgaaggacataagggagtatttaatattgaagtgcaagctgtttcttctgtacacacccaggacaaccacctggagaagttcttcaccctctgccactccctggagagccaggtgaccttccccatccgcgtgctggatcagaaaatcagcgagatggcgctggagcatgagctgaagctcagcatcatctgcctgaactcctcccgcctggagccgctcgtgctcttcctgcacctggtgctggacaagctcttccagctgtccgtgcagcccatggtcatcgctggccagacagccaacttctcccagtttgccttcgagtccgtggtggccatcgccaacagtctgcacaacagcaaggacctgagcaaggaccagcatgggaggaactgcctgctggcttcctacgtgcactacgtcttccgcctgccagaggtgcaaagggatgtgcccaagtcaggcgctcccactgccctcctagaccctcggagctaccacacgtatggccgcacatcagctgctgctgtgagttcaaagctgctgcaggcccgggtgatgagcagcagtaacccagacctcgcggggacacactccgcagcagacgaggaagtgaagaacatcatgtcttcaaagatcgccgatcgcaactgcagccgaatgtcttactattgctctggcagtagtgatgctccaagttcacctgcagccccaaggccagccagcaaaaagcatttccatgaggagcttgcccttcagatggtggtcagcaccggaatggtgagagaaacagtcttcaagtatgcctggttcttctttgagcttctggtgaaaagcatggcccagcacgtacataacatggacaaacgggacagttttcggaggactcgtttttctgaccgtttcatggatgacataactactattgttaatgtggtcacctcggaaattgcagcccttttagtaaaaccacagaaggaaaatgaacaggcggaaaagatgaacatcagcctggctttcttcttgtatgaccttctctccctcatggatcggggctttgtgtttaacctcatcagacattattgcagccagctgtcagccaagctcagtaaccttccaacgctcatttccatgaggctagagttcctgagaatcctctgtagccatgagcattacctcaatctgaaccttttttttatgaatgctgatactgctccaacatctccttgtccttccatatcttcccagaactcaagctcctgctccagcttccaggaccagaagatcgccagcatgttcgatctgacttccgagtaccgccagcagcacttcctcaccgggctcctcttcacagaactggctgctgccctggatgccgaaggggaaggaatcagcaaagtacaaaggaaagctgtcagtgcaattcacagcctgctaagttctcacgacctggacccacgctgtgtcaaaccagaggtgaaggtcaaaatcgccgccctttacctacctttagttggcatcattttggatgctttgccacagctctgtgactttacagttgcagatactcgcagataccgcaccagtggctcggatgaagaacaagaaggagccggtgccattaaccagaatgtggctctggccatagcagggaataatttcaatttgaaaacaagtggaatagtgctgtcttccttgccctataagcagtacaacatgctgaacgcggacactactcgcaacctcatgatctgcttcctctggatcatgaaaaatgctgatcagagcctcattaggaagtggattgctgacctgccatcaacgcagctcaacaggattttagatctacttttcatctgtgtgttatgttttgagtataagggaaaacagagttctgacaaagtcagtacccaagtcctgcagaagtcaagggatgtcaaggcccggctggaagaggctttgctccgtggggaaggggccagaggggagatgatgcgccgccgggctccagggaacgaccgatttccaggcctaaatgaaaatttgagatggaagaaagagcagacacattggcggcaagctaatgagaagctagataaaacaaaggccgagttagatcaagaagccttgatcagtggcaatctggctacagaagcacatttaatcatcctggatatgcaggaaaacattatccaggcgagctcggctctggactgtaaagacagcctgctgggaggtgttctgagggtgctggtgaattctctgaactgtgatcagagtaccacctacctgactcactgctttgcaacactccgtgctctcatcgccaagtttggagacttactctttgaagaggaggtggaacagtgtttcgacctatgtcaccaagtcctgcaccactgcagcagcagcatggatgtcacccggagccaagcctgtgccaccctttacctcctcatgaggttcagttttggagccaccagtaattttgcaagagtaaagatgcaagtaaccatgtccctggcatctttggtgggaagagcaccagactttaatgaagagcacctgagaagatccttgaggacaattttggcctattcagaagaggacacagccatgcagatgactccttttcccacccaggtggaggaacttctctgtaatctgaatagcatcttatatgacacagtgaaaatgagggaatttcaggaagatcctgagatgcttatggatctcatgtacagaattgccaagagttaccaggcatctcctgatctgcggctgacctggctccagaacatggcagagaaacacaccaagaagaagtgctacacggaggctgccatgtgcctggtgcacgccgctgcgttagtggctgagtatctgagcatgctggaggaccacagctacctgcccgtgggcagtgtcagcttccagaatatttcttccaatgtgctggaggagtctgtggtctctgaggacaccctgtcacctgacgaggatggggtgtgcgcaggccagtacttcaccgagagtggcctggtaggcctcctggagcaggccgcggagctcttcagcacgggaggcttatatgagacagttaatgaggtctacaagctggtcatccccatcctagaagcgcatcgagaattccggaagctgacactcactcacagcaagctgcagagagccttcgacagcatcgttaacaaggatcataagagaatgtttggaacctacttccgagttggtttctttggatccaaatttggggatttggatgaacaggagtttgtctacaaagagcctgcaattaccaagcttcctgagatctcacatagactagaggcattttatggtcaatgttttggtgcagaatttgtggaagtgattaaagactccactcctgtggacaaaaccaagttggatcctaacaaggcctacatacagatcacttttgtggagccctactttgatgagtatgagatgaaagacagggtcacatactttgagaagaatttcaacctccggaggttcatgtacaccaccccgttcaccctggaggggcggcctcggggagagctgcatgagcagtacagaaggaacacagtcctgaccactatgcacgccttcccctacatcaagaccaggatcagcgtcatccagaaggaggagtttgttttgacaccgattgaagttgccattgaagacatgaagaagaagaccctgcagttagcagttgccattaaccaggagccgcctgatgcaaagatgcttcagatggtgctgcaaggctctgtgggagctactgtaaatcagggaccactggaagtagcccaagtgtttttggctgaaattcctgctgatccaaaactctatcgacatcacaacaagttgaggttatgctttaaggaattcatcatgagatgtggtgaagctgtagagaaaaacaagcgtctcatcacggcagaccagagggaatatcagcaggaactcaaaaagaactataacaagctaaaagagaacctcaggccaatgatcgagcggaaaattccagaactgtacaagccaatattcagagttgagagtcaaaagagggactccttccacagatctagtttcaggaaatgtgaaacccagttgtcacagggcagctaagaaaagccatcttcattcgtggagactgtggccctgcaaccctggagaaggacttgctggtacttaaaaaatgggacatttgccacccaggactgactgtacactccctgatcagccagcactctggaagctttgggatcccaggaaccatggaattattcccaaatggactctgaccagatttttgccatactggggggtggcgggatggaggatgggtactcaggcatgactgcgtatttattaaagtgtgtttttccacaatgtaccaaacaaggcataagcagcttctcctgctgactggccaatcactgcccatctgagagatgatttcctctggcccatatttgaatttattggagtaactcaaattgcctgaggaaaaatggaaaaattatccaccagtcgattcaaactgaatttcactctttataggaaggcagggcaaacttgtaggagtacgaaacattttcaataaatctacaaagggaagccttactacaattccaaaaatcatcatggttggaaatttgggaggagattatttgtgaacttgttacccttttggtaatggtggactaattgctgtatagttatttttgttttattattactgttacattaatttaacatgcatttatagaagaatacattcaaagcactgatgtaggagatacacggtacttggagcagtcagccagaaatcacagatactgctttcacttaaatggaaacaattctccgataatgctttgctttttttcttatgtcactcttgtgtactatctatttttctcctctctgggaccaagtttctttttataaagcaataatatctctgttttcatttcagaacattgtgctgtctgtcagcatatgtatatcagctacaaaatatattcaactttgacttcttttgacaaaggactttaggaaaaagaggaacaaagacattatttgagaattaaattatatatttttaatatgactgtgaccttgactgataataaagatgtaataagaattgcaagctaaa

SEQ ID NO: 8017 - DNA, 6386 bp, Homo sapiens
tacgcgccgtgtaactgtgaatctttcaaagcctcagttttatgaccctgtggagccagtggactttgaaggacttctgatgacacacctgaacagcctggatgtgcagcttgcccaggagctcggggacttcactgatgacgacttggacgtggtgttcacgccaaaggaatgtaggactttgcagccctctttgccggaggaaggggttgaactggaccctcatgtcagggactgtgttcagacctacatccgtgagtggctaatcgtgaaccggaaaaaccaaggaagtccagaaatctgtggctttaaaaagactggatctcgaaaagattttcacaagacgcttccgaaacagacgtttgagtcggaaaccttggagtgcagtgaacccgctgctcaggcaggcccccgccacttaaacgtgctgtgcgacgtgtctgggaaaggccccgtcactgcctgtgactttgacctccgcagcctgcagcctgacaagcggctagaaaacctcctgcagcaagtgagtgccgaggactttgagaagcagaacgaggaggcccggaggaccaataggcaggccgagctctttgccctttacccatcagtggacgaggaggatgctgtggaaatacgtccagtaccagaatgtcccaaggaacacctgggcaacagaatattggtcaagttgctgaccttgaagttcgagattgaaattgagcccctgtttgccagcattgccctctacgatgttaaagaaaggaaaaagatctcagaaaattttcactgtgacctgaactctgaccagttcaaaggatttctgcgagctcacacgccttcagtggccgcatcaagtcaggcgagatctgcagtcttctcagtcacctacccgtcctcagacatctacctggtagtcaagattgaaaaagtcctgcagcagggagagattggagactgtgcagagccctacacggttatcaaagaaagtgatggtggaaagagtaaagaaaagattgaaaaactaaaactccaagctgaatccttctgccagcgtttggggaaataccggatgccctttgcctgggcacccataagcttatcaagcttcttcaatgtctccacccttgagagggaggtaactgatgtggactctgtggttgggagaagctcagtgggtgaacggaggacattggcccaatctagaaggctttctgaaagagccctctccttggaggaaaatggggttggatccaacttcaaaacctccactctgagcgttagcagctttttcaagcaggaaggagatcgccttagcgatgaagacttattcaagtttttagctgactacaaaagatcatcatccttacagagacgagtcaagtcaattccaggcttgctaagactggagatttctacagctccagagatcatcaattgctgtctgactcctgaaatgctgcccgtgaaaccctttcctgaaaaccggacacgcccgcacaaagagattttggaatttccaacacgagaagtatatgtccctcacactgtgtacagaaaccttctctatgtctacccacagaggctgaactttgtaaacaaactagcatcagcccggaacattacaataaagatccagtttatgtgtggagaagatgctagcaatgcgatgccggtcatctttggaaaatccagcgggcctgaatttctgcaggaagtgtacacagctgttacataccataataagtctcctgacttttatgaagaagtgaaaattaagctccccgctaagctcacagtaaatcaccacctcctgttcaccttctaccatatcagctgtcagcagaagcaaggagcctccgtggaaactctcctgggatattcatggctgccaattctcttaaatgaacgtcttcaaactggatcctactgtctcccagttgccttggaaaaattgccacccaactactccatgcattctgctgagaaagtcccattacagaatcctcccattaagtgggctgaaggacataagggagtatttaatattgaagtgcaagctgtttcttctgtacacacccaggacaaccacctggagaagttcttcaccctctgccactccctggagagccaggtgaccttccccatccgcgtgctggatcagaaaatcagcgagatggcgctggagcatgagctgaagctcagcatcatctgcctgaactcctcccgcctggagccgctcgtgctcttcctgcacctggtgctggacaagctcttccagctgtccgtgcagcccatggtcatcgctggccagacagccaacttctcccagtttgccttcgagtccgtggtggccatcgccaacagtctgcacaacagcaaggacctgagcaaggaccagcatgggaggaactgcctgctggcttcctacgtgcactacgtcttccgcctgccagaggtgcaaagggatgtgcccaagtcaggcgctcccactgccctcctagaccctcggagctaccacacgtatggccgcacatcagctgctgctgtgagttcaaagctgctgcaggcccgggtgatgagcagcagtaacccagacctcgcggggacacactccgcagcagacgaggaagtgaagaacatcatgtcttcaaagcatttccatgaggagcttgcccttcagatggtggtcagcaccggaatggtgagagaaacagtcttcaagtatgcctggttcttctttgagcttctggtgaaaagcatggcccagcacgtacataacatggacaaacgggacagttttcggaggactcgtttttctgaccgtttcatggatgacataactactattgttaatgtggtcacctcggaaattgcagcccttttagtaaaaccacagaaggaaaatgaacaggcggaaaagatgaacatcagcctggctttcttcttgtatgaccttctctccctcatggatcggggctttgtgtttaacctcatcagacattattgcagccagctgtcagccaagctcagtaaccttccaacgctcatttccatgaggctagagttcctgagaatcctctgtagccatgagcattacctcaatctgaaccttttttttatgaatgctgatactgctccaacatctccttgtccttccatatcttcccagaactcaagctcctgctccagcttccaggaccagaagatcgccagcatgttcgatctgacttccgagtaccgccagcagcacttcctcaccgggctcctcttcacagaactggctgctgccctggatgccgaaggggaaggaatcagcaaagtacaaaggaaagctgtcagtgcaattcacagcctgctaagttctcacgacctggacccacgctgtgtcaaaccagaggtgaaggtcaaaatcgccgccctttacctacctttagttggcatcattttggatgctttgccacagctctgtgactttacagttgcagatactcgcagataccgcaccagtggctcggatgaagaacaagaaggagccggtgccattaaccagaatgtggctctggccatagcagggaataatttcaatttgaaaacaagtggaatagtgctgtcttccttgccctataagcagtacaacatgctgaacgcggacactactcgcaacctcatgatctgcttcctctggatcatgaaaaatgctgatcagagcctcattaggaagtggattgctgacctgccatcaacgcagctcaacaggattttagatctacttttcatctgtgtgttatgttttgagtataagggaaaacagagttctgacaaagtcagtacccaagtcctgcagaagtcaagggatgtcaaggcccggctggaagaggctttgctccgtggggaaggggccagaggggagatgatgcgccgccgggctccagggaacgaccgatttccaggcctaaatgaaaatttgagatggaagaaagagcagacacattggcggcaagctaatgagaagctagataaaacaaaggccgagttagatcaagaagccttgatcagtggcaatctggctacagaagcacatttaatcatcctggatatgcaggaaaacattatccaggcgagctcggctctggactgtaaagacagcctgctgggaggtgttctgagggtgctggtgaattctctgaactgtgatcagagtaccacctacctgactcactgctttgcaacactccgtgctctcatcgccaagtttggagacttactctttgaagaggaggtggaacagtgtttcgacctatgtcaccaagtcctgcaccactgcagcagcagcatggatgtcacccggagccaagcctgtgccaccctttacctcctcatgaggttcagttttggagccaccagtaattttgcaagagtaaagatgcaagtaaccatgtccctggcatctttggtgggaagagcaccagactttaatgaagagcacctgagaagatccttgaggacaattttggcctattcagaagaggacacagccatgcagatgactccttttcccacccaggtggaggaacttctctgtaatctgaatagcatcttatatgacacagtgaaaatgagggaatttcaggaagatcctgagatgcttatggatctcatgtacagaattgccaagagttaccaggcatctcctgatctgcggctgacctggctccagaacatggcagagaaacacaccaagaagaagtgctacacggaggctgccatgtgcctggtgcacgccgctgcgttagtggctgagtatctgagcatgctggaggaccacagctacctgcccgtgggcagtgtcagcttccagaatatttcttccaatgtgctggaggagtctgtggtctctgaggacaccctgtcacctgacgaggatggggtgtgcgcaggccagtacttcaccgagagtggcctggtaggcctcctggagcaggccgcggagctcttcagcacgggaggcttatatgagacagttaatgaggtctacaagctggtcatccccatcctagaagcgcatcgagaattccggaagctgacactcactcacagcaagctgcagagagccttcgacagcatcgttaacaaggatcataagagaatgtttggaacctacttccgagttggtttctttggatccaaatttggggatttggatgaacaggagtttgtctacaaagagcctgcaattaccaagcttcctgagatctcacatagactagaggcattttatggtcaatgttttggtgcagaatttgtggaagtgattaaagactccactcctgtggacaaaaccaagttggatcctaacaaggcctacatacagatcacttttgtggagccctactttgatgagtatgagatgaaagacagggtcacatactttgagaagaatttcaacctccggaggttcatgtacaccaccccgttcaccctggaggggcggcctcggggagagctgcatgagcagtacagaaggaacacagtcctgaccactatgcacgccttcccctacatcaagaccaggatcagcgtcatccagaaggaggagtttgttttgacaccgattgaagttgccattgaagacatgaagaagaagaccctgcagttagcagttgccattaaccaggagccgcctgatgcaaagatgcttcagatggtgctgcaaggctctgtgggagctactgtaaatcagggaccactggaagtagcccaagtgtttttggctgaaattcctgctgatccaaaactctatcgacatcacaacaagttgaggttatgctttaaggaattcatcatgagatgtggtgaagctgtagagaaaaacaagcgtctcatcacggcagaccagagggaatatcagcaggaactcaaaaagaactataacaagctaaaagagaacctcaggccaatgatcgagcggaaaattccagaactgtacaagccaatattcagagttgagagtcaaaagagggactccttccacagatctagtttcaggaaatgtgaaacccagttgtcacagggcagctaagaaaagccatcttcattcgtggagactgtggccctgcaaccctggagaaggacttgctggtacttaaaaaatgggacatttgccacccaggactgactgtacactccctgatcagccagcactctggaagctttgggatcccaggaaccatggaattattcccaaatggactctgaccagatttttgccatactggggggtggcgggatggaggatgggtactcaggcatgactgcgtatttattaaagtgtgtttttccacaatgtaccaaacaaggcataagcagcttctcctgctgactggcca

SEQ ID NO: 8018 - DNA, 2314 bp, Homo sapiens
gcgtggggcacggaggggctcgcgctcccagaagccggcaggccttcccgcgggcgggcccgcagcgcgctccgccccggaaacacgcccatggccgccttggcgcgctttcaaacgctcaggtttcctaccttccggctgcttgggaacttctttcttgcccgccaagcccgcagccacccgggcgcggcgggactcctagacccggcgctgcgatgaagaggacccgcgacgaggtggatgcgacgctgcagatcgccaagctgaatgcggccgagctgctgccggcggtgcactgcctgggcttcggccctggggccagcggcgctgcagccggcgacttctgcctgctggagctggagcccacgctgtgccagcagctggaggatggacacagtcttgtgattcgtggtgataaagacgagcaagctgtgctgtgcagtaaagacaaaacatacgacttgaagatagcagacacttccaatatgttgcttttcattcctggttgtaaaactccggaccagttgaagaaggaagattcacactgtaacattattcacactgagatctttggtttttctaataattattgggaattaagaagacgtagacccaagttaaagaagctaaagaaacttttgatggaaaatccatatgaaggacctgacagtcaaaaagagaaggattcaaatagctcaaaatatacaactgaagatttgcttgatcaaattcaggcaagtgaggaagaaataatgacccaattacaagttctaaatgcctgtaagattggaggttattggaggattcttgaatttgattatgagatgaaacttctgaatcatgtaactcagcttgtggattctgaatcatggtcttttggtaaagttcctttgaacacatgccttcaggaactcggaccattggagccagaggaaatgatagaacactgtcttaaatgttatgggaagaaatatgtagatgaaggcgaagtttattttgagttggatgctgataaaatatgtagagcagcagcacgaatgctacttcagaatgcggtgaaattcaatctcgctgagtttcaagaagtgtggcagcagagtgttcctgaaggaatggtaactagtcttgatcagcttaagggtttagcgctggtggatagacactcgagaccagaaatcatatttttgctgaaagtagatgatttacctgaggataatcaggaacgttttaatagccttttctctctaagggagaagtggacagaagaagatattgctccatatattcaagatttgtgtggagagaagcaaaccataggtgcattactcactaaatattctcattcttcgatgcaaaatggtgttaaagtttataattcgagaagacccatttcttaaaagaacaacggtcttttcttcaggactcaagttgctttataaagttgctggatagaagaaaaataacttgtacttttatttctgacttttagaaacctagtcttctaaggcatttttctcctcatcttaagcattttgaaactactgttatttcttaaatgttataggatgtagctttaaaattatatttgtactatgtacacagtgtaaacaaggacaaaagaattctttcctatattatgtctgaggtctctatgatttatttaaagtttggctttttatatttaaaatgtcatttctttacttaggatttgatgttctaatcattaatacacttaagttttccagagaactaaatagtaatagtttcatagaagagaactatttattcacttaaatatcatttctcaagtgagtgagttcccctctacttttagccttccacccaaactggaagcctctaggtgctatcaattatttatatccatcgtttacatccatgaaattggctgaataattactcctctgcctggcgtagacatgcgctttgggaaaaaaacgagtttataatcctataatgaagaatactggcacaggcaatgctcactcgaaaacttcaagtaatttctagttggttttggaatgcttgataaagttcctttacagctttattttcctgatttgttttggtttagatcaaagttcaaattaattttaacttagctaatgaactcatcaccaggacagttggagggggtaggccgaggttaaatggtccacgtttcaaaaatgttaatggctaatccataattaaagaaggtttaactgttactgaagtttacaagttttattgtcatgaacatgaaatacaaacacgatggcttcgaaatgtctttcaataaatgtttctgcattta

SEQ ID NO: 8019 - DNA, 731 bp, Homo sapiens
ggggagggcggagttaggtcacgagggtgcgcatgcgcaaacagcacatccggtgtggtcgacgggtcctccaagagtttggggcgcggactggagtaccttgcgtgcagttatgtcggcgtcggtagtgtctgtcatttcgcggttcttagaagagtacttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcggtttgcctgagaatacagatcaacccacagaacaaagcggatttccaaggcatctccccagagcgagcctttgctgattttctctttgccagcaccatcctgcaccttgttgtcatgaactttgttggctgactcattctcatttacttaattgaggagtaggagactaaaagaatgttcactctttgaatttcctggataagagttctggagatggcagcttattggacacatggattttcttcagatttgcacttactgctagctctgctttttatgcaggagaaaagcccagagttcactgtgtgtcagaacaactttctaacaaacatttattaatccagcctctgcctttcattaaatgtaaccttttgccttccaaattaaagaactccatgccactcctcca

SEQ ID NO: 8020 - DNA, 406 bp, Homo sapiens
atgaggaccctcgccatccttgctgccattctcctggtggccctgcaggcccaggctgagccactccaggcaagagctgatgaggttgctgcagccccggagcagattgcagcggacatcccagaagtggttgtttcccttgcatgggacgaaagcttggctccaaagcatccaggctcaaggaaaaacatggcctgctattgcagaataccagcgtgcattgcaggagaacgtcgctatggaacctgcatctaccagggaagactctgggcattctgctgctgagcttgcagaaaaagaaaaatgagctcaaaatttgctttgagagctacagggaattgctattactcctgtaccttctgctcaatttcctttcctcatcccaaataaatgccttgttacaaga

SEQ ID NO: 8021 - DNA, 485 bp, Homo sapiens
ctatagaagacctgggacagaggactgctgtctgccctctctggtcaccctgcctagctagaggatctgtgaccccagccatgaggaccctcgccatccttgctgccattctcctggtggccctgcaggcccaggctgagccactccaggcaagagctgatgaggttgctgcagccccggagcagattgcagcggacatcccagaagtggttgtttcccttgcatgggacgaaagcttggctccaaagcatccaggctcaaggaaaaacatggcctgctattgcagaataccagcgtgcattgcaggagaacgtcgctatggaacctgcatctaccagggaagactctgggcattctgctgctgagcttgcagaaaaagaaaaatgagctcaaaatttgctttgagagctacagggaattgctattactcctgtaccttctgctcaatttcctttcctcatcccaaataaatgccttgttacaag

SEQ ID NO: 8022 - DNA, 617 bp, Homo sapiens
ccttaaataaggaagtcctctcctctgtgtgcatggctgctcttgctacataagacctggaacacaggactgctgtctgccctctctgctcgccctgcctagcttgaggatctgtcaccccagccatgaggattatcgccctcctcgctgctattctcttggtagccctccaggtccgggcaggcccactccaggcaagaggtgatgaggctccaggccaggagcagcgtgggccagaagaccaggacatatctatttcctttgcatgggataaaagctctgctcttcaggtttcaggctcaacaaggggcatggtctgctcttgcagattagtattctgccggcgaacagaacttcgtgttgggaactgcctcattggtggtgtgagtttcacatactgctgcacgcgtgtcgattaacgttctgctgtccaagagaatgtcatgctgggaacgccatcatcggtggtgttagcttcacatgcttctgcagctgagcttgcagaatagagaaaaatgagctcataatttgctttgagagctacaggaaatggttgtttctcctatactttgtccttaacatctttcttgatcctaaatatatatctcgtaacaaga

SEQ ID NO: 8023 - DNA, 444 bp, Homo sapiens
tccactcctgctctccctcctgcaggtgaccccagccatgaggaccatcgccatccttgctgccattctcctggtggccctgcaggcccaggctgagtcactccaggaaagagctgatgaggctacaacccagaagcagtctggggaagacaaccaggaccttgctatctcctttgcaggaaatggactctctgctcttagaacctcaggttctcaggcaagagccacctgctattgccgaaccggccgttgtgctacccgtgagtccctctccggggtgtgtgaaatcagtggccgcctctacagactctgctgtcgctgagcttcctagatagaaaccaaagcagtgcaagattcagttcaaggtcctgaaaaaagaaaaacattttactctgtgtaccttgtgtctttctaaatttctctctccaaaataaagttcaagca

SEQ ID NO: 8024 - DNA, 469 bp, Homo sapiens
acacatctgctcctgctctctctcctccagcgaccctagccatgagaaccctcaccatcctcactgctgttctcctcgtggccctccaggccaaggctgagccactccaagctgaggatgatccactgcaggcaaaagcttatgaggctgatgcccaggagcagcgtggggcaaatgaccaggactttgccgtctcctttgcagaggatgcaagctcaagtcttagagctttgggctcaacaagggctttcacttgccattgcagaaggtcctgttattcaacagaatattcctatgggacctgcactgtcatgggtattaaccacagattctgctgcctctgagggatgagaacagagagaaatatattcataatttactttatgacctagaaggaaactgtcgtgtgtcctatacattgccatcaactttgtttcctcatctcaaataaagtcctttcagcaagttc

SEQ ID NO: 8025 - DNA, 478 bp, Homo sapiens
cttgactgtggcacctcccttcagttccgtcgacgaggttgtgcaatccaccagtcttataaatacagtgacgctccagcctctggaagcctctgtcagctcagcctccaaaggagccagcgtctccccagttcctgaaatcctgggtgttgcctgccagtcgccatgagaacttcctaccttctgctgtttactctctgcttacttttgtctgagatggcctcaggtggtaactttctcacaggccttggccacagatctgatcattacaattgcgtcagcagtggagggcaatgtctctattctgcctgcccgatctttaccaaaattcaaggcacctgttacagagggaaggccaagtgctgcaagtgagctgggagtgaccagaagaaatgacgcagaagtgaaatgaactttttataagcattcttttaataaaggaaaattgcttttgaagtatacctcctttgggccaaaa

SEQ ID NO: 8026 - DNA, 1158 bp, Homo sapiens
cctggatctaccacctcctgcttcccaaggaccatgaaactcctgctgctggctcttcctatgcttgtgctcctaccccaagtgatcccagcctatagtggtgaaaaaaaatgctggaacagatcagggcactgcaggaaacaatgcaaagatggagaagcagtgaaagatacatgcaaaaatcttcgagcttgctgcattccatccaatgaagaccacaggcgagttcctgcgacatctcccacacccttgagtgactcaacaccaggaattattgatgatattttaacagtaaggttcacgacagactactttgaagtaagcagcaagaaagatatggttgaagagtctgaggcgggaaggggaactgagacctctcttccaaatgttcaccatagctcatgacttcctctcggctatcactcacccctgtcctcagagtgataaactaagtcacatacagataaagcactgaaaacaccacagtgaccctcccaccccccaccaatatgtaattctattaatagaaacagctgtgtaaagaagtctaaaattttcactatttccaatgataaactcttcagtgctcttcttgaaatgtcacattatttccacaacaagttataacctatttttagtatttcttgtttgctagtgacctatgcacaacttcaatagcttagttagctattccaacaacaatttcttcatgtatcgttctgtcttctcaacagctgtcttcatggcagcataagtggtcatgatcaaaattctaaatctttgcatctgtgagagtagctactatgacactaaaagctttttttctagaacaggagacacttcaggtgaaagcattcattctcctactaactatggccttggagccaggttttatctctcactgtaggaaattggccgccccaggtgtgagctatgaagactcctttttgccccagtggctttggggttgaaatgctgtcgaaaagcttttatggctctgtagacccatctttttgaccaagccttgatcacacatggacatccaagggtaatcatggacccccaattgtgggtgaaaggatggatcatttatctacctgattactgagagctttatttgtctccctctgatagcaaaaaaaaaaaaaaaaaaaaaaa

SEQ ID NO: 8027 - DNA, 1403 bp, Homo sapiens
actgaagccgtggggacgcgcccagcggagctaatcagattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggatctccaggagctgattgcacaagctgtacaggccacgaagaactacaacaagtgtttcctgaatgtctgttttgcatacacatcccgtcatgagatcagcaatgctgtgagagagatggcctggggggtggagcaaggcctgttggatcccagtgatatctctgagtctctgcttgataagtgcctctataccaaccgctctcctcatcctgacatcttgatacggacttctggagaagtgcggctgagtgacttcttgctatggcagacctctcactcctgcctggtgttccaacccgttctgtggccagagtatacattttggaacctcttcgaggccatcctgcagttccagatgaaccatagcgtgcttcagaaggcccgagacatgtatgcagaggagcggaagaggcagcagctggagagggaccaggctacagtgacagagcagctgctgcgagaggggctccaagccagtggggacgcccagctccgaaggacacgcttgcacaaactctcggccagacgggaagagcgagtccaaggcttcctgcaggccttggaactcaagcgagctgactggctggcccgtctgggcactgcatcagcctgaatgaggctggccacctgccactttgccctgccctctgcctccagggctccactccccttccttttcttggtgaaaggcacctcctttcctgataatgaatggtgttccctttgcttggctggggagccccccaggccaggtttgctggccatagatacctttgggctgcctgggacaggctcctgaggaggattgagggtgaaagtctcccacgagtacactaaacctaggtctggtcaccaatagggtttggagagcaaagggccacaactcatcagctgcctgtctcttagatgcactttcttttt

SEQ ID NO: 8028 - DNA, 3245 bp, Homo sapiens
cgcgcccagcggagctaatcagattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggatctccaggagctgattgcacaagctgtacaggccacgaagaactacaacaagtgtttcctgaatgtctgttttgcatacacatcccgtcatgagatcagcaatgctgtgagagagatggcctggggggtggagcaaggcctgttggatcccagtgatatctctgagtctctgcttgataagtgcctctataccaaccgctctcctcatcctgacatcttgatacggacttctggagaagtgcggctgagtgacttcttgctatggcagacctctcactcctgcctggtgttccaacccgttctgtggccagagtatacattttggaacctcttcgaggccatcctgcagttccagatgaaccatagcgtgcttcagcagaaggcccgagacatgtatgcagaggagcggaagaggcagcagctggagagggaccaggctacagtgacagagcagctgctgcgagaggggctccaagccagtggggacgcccagctccgaaggacacgcttgcacaaactctcggccagacgggaagagcgagtccaaggcttcctgcaggccttggaactcaagcgagctgactggctggcccgtctgggcactgcatcagcctgaatgaggctggccacctgccactttgccctgccctctgcctccagggctccactccccttccttttcttggtgaaaggcacctcctttcctgataatgaatggtgttccctttgcttggctggggagccccccaggccaggtttgctggccatagatacctttgggctgcctgggacaggctcctgaggaggattgagggtgaaagtctcccacgagtacactaaacctaggtctggtcaccaatagggtttggagagcaaagggccacaactcatcagctgcctgtctcttagatgcactttctttttccaccagcacatccttcaacacacagaatttcagggaagagttctccccaaaaccctagctctttacccttccattttagccttccacccagcttccacaaaagatttggctctaccttggatctgctagtaaataactaataggcaggcagttatttgggtaaggaaaaaaggggtgggagagacagaaaatttgcccatctgctgctcctcccccttggctctccacctgggatttgctattgaatctctaccctctcccaccacacagtactgattgctcactgaaagactcagcacccccaatggtgcgcggaagccaggcgggcgattacaatccaattacctattgtcgactcagcccacacaagcttttctcctcctcttgcagggcatggggccaggctccactcccaaatgagactggccccctccatggttcagggtaacagaagggcctgtaggccctggtgaactgaatccagcacaggcctcccctgtaacacaacaggactgagcagaaccaaacacttcttccaactgactctgctccctgccctcaccatctcaaactctgattcccactccactcttcgaggtttctctcagctttttgacctggctccctaagtaggccctagatgatttattcttggcatggcaaagcttgttctaggtcctctgcttgtgagggtcaaagctgtgtcctttcccttacctccctctgccaggacttgctgcagagctgctgagaggattagtgcctttgaagagctgtctgcctgagcaactctatttcaggtgccccacaccggcaagtaccagccagcaacaccaaccaaatgctactctctttaaagtccattttccttcttctttttttttttttttttggagacagcatctcaccctgtcctggctggtctcgaactcctgacctcaggtgatccgccggcctcaccctcccaaagtgctgggattacaggcatgagccaccatgccagacttcccattttactttctgcaagctgtttccctagcagctccctctaggggagaggtgaaatcttgcaagttgtagcaagagcacacaggaaacccctaactttcctataccccacccgcctcttcccctttctgtcccgggatacctggcggcaagagacttcttggctattgtccatgctcccagaatcaagcataaatgccagacacggcgattgagaagccaatcagtgaaccctttggcaaagcccccatccacacctggcactcccctctaccaatccctggcacagggttcctggagagcaggtgctgtacattttacagctttacaatggggctgttgacagccataattagggaggcatgaattatgcggctataatgcagagccctacaattaaggcgggaatgaggggctggaggcagcaaacggaatctgccctatgagcgtggctgttgagtcctgtctcctgggtctgactttccgtaatatgattggggtacagtagaggtgattaatggggctggcatctctctttggcctgaggttctgtattctgggaaaggtacacagggtggagtagggagaagctgccccaggaggcgatgtagtggtggaaagaagaggcagagaggtcgtcgtcgtcgcccagcagcaagggctgcaaaatagtagaactcgtggttgctttggacaggtgtgatttgtgcaagccaggttcaacccttgcctcaagaaatcagatgggaccaatttagtgtccttccacctgtgagccaagcccccatttgaggacatctatcgtattcttgtgtgctgggtctcaaatagaatttttaaagattc

SEQ ID NO: 8029 - DNA, 916 bp, Homo sapiens
gcgccacgtcatgaggaagtgccggcccactgaagccgtggggacgcgcccagcggagctaatcagattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggatctccaggagctgattgcacaagctgtacaggccacgaagaactacaacaatgatatctctgagtctctgcttgataagtgcctctataccaaccgctctcctcatcctgacatcttgatacggacttctggagaagtgcggctgagtgacttcttgctatggcagcagaaggcccgagacatgtatgcagaggagcggaagaggcagcagctggagagggaccaggctacagtgacagagcagctgctgcgagaggggctccaagccagtggggacgcccagctccgaaggacacgcttgcacaaactctcggccagacgggaagagcgagtccaaggcttcctgcaggccttggaactcaagcgagctgactggctggcccgtctgggcactgcatcagcctga

SEQ ID NO: 8030 - DNA, 718 bp, Homo sapiens
gcgccacgtcatgaggaagtgccggcccactgaagccgtggggacgcgcccagcggagctaatcagattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggatctccaggagctgattgcacaagctgtacaggccacgaagaactacaacaagtgtttcctgaatgtctgttttgcatacacatcccgtcatgagatcagcaatgctgtgagagagatggcctggggggtggagcaaggcctgttggatcccagtcgagacaggtttcaccatattggccaggctagtctcgaactcctgacgtcgtga

SEQ ID NO: 8031 - DNA, 979 bp, Homo sapiens
gcgccacgtcatgaggaagtgccggcccactgaagccgtggggacgcgcccagcggagctaatcagattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggatctccaggagctgattgcacaagctgtacaggccacgaagaactacaacaagtgtttcctgaatgtctgttttgcatacacatcccgtcatgagatcagcaatgctgtgagagagatggcctggggggtggagcaaggcctgttggatcccagtgatatctctgagtctctgcttgataagtgcctctataccaaccgctctcctcatcctgacatcttgatacggacttctggagaagtgcggctgagtgacttcttgctatggcagacctctcactcctgcctggtgttccaacccgttctgtggccagagtatacattttggaacctcttcgaggccatcctgcagttccagatgaaccatagcgtgcttcagcacccagggagcctcctgaccaaggcctggaagaagcccttccagcaagacggagagctctacggcaactgttcaagcccgaagtcctcatag

SEQ ID NO: 8032 - DNA, 850 bp, Homo sapiens
gaaggggtgaactagaggagaagagggtgactgggcggggagcagctgcgggagaagcaaagggacgactgagggaataatcaggagaccactgaggcgtgaagtactaggcgtgcgataactgaaggaattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggatctccaggagctgattgcacaagctgtacaggccacgaagaactacaacaagtgtttcctgaatgtctgttttgcatacacatcccgtcatgagatcagcaatgctgtgagagagatggcctggggggtggagcaaggcctgttggatcccaggtatcccgatgatatctctgagtctctgcttgataagtgcctctataccaaccgctctcctcatcctgacatcttgatacggacttctggagaagtgcggctgagtgacttcttgctatggcag

SEQ ID NO: 8033 - DNA, 573 bp, Homo sapiens
gctaatcaggtgccactgaactgaaggggtgaactagaggagaagagggtgactgggcggggagcagctgcgggagaagcaaagggacgactgagggaataatcaggagaccactgaggcgtgaagtactaggcgtgcgataactgaaggaattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcg

SEQ ID NO: 8034 - DNA, 492 bp, Homo sapiens
aatcaggtgccactgaactgaaggggtgaactagaggagaagagggtgactgggcggggagcagctgcgggagaagcaaagggacgactgagggaataatcaggagaccactgaggcgtgaagtactaggcgtgcgataactgaaggagttagtaactgggagcacagagttggaaacagcttaggggaagatggagaaggaagaaacggggaatgatcaagatattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatccta

SEQ ID NO: 8035 - DNA, 581 bp, Homo sapiens
aatcaggtgccactgaactgaaggggtgaactagaggagaagagggtgactgggcggggagcagctgcgggagaagcaaagggacgactgagggaataatcaggagaccactgaggcgtgaagtactaggcgtgcgataactgaaggagttagtaactgggagcacagagttggaaacagcttaggggaagatggagaaggaagaaacggggaatgatcaagatgtgggcaccatgatgtggcaggaaaccgacttagatgttcagaagaaattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgc

SEQ ID NO: 8036 - DNA, 1072 bp, Homo sapiens
ctgaagccgtggggacgcgcccagcggagctaatcagattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaagtgtttcctgaatgtctgttttgcatacacatcccgtcatgagatcagcaatgctgtgagagagatggcctggggggtggagcaaggcctgttggatcccagtgatatctctgagtctctgcttgataagtgcctctataccaaccgctctcctcatcctgacatcttgatacggacttctggagaagtgcggctgagtgacttcttgctatggcagacctctcactcctgcctggtgttccaacccgttctgtggccagagtatacattttggaacctcttcgaggccatcctgcagttccagatgaaccatagcgtgcttcagaaggcccgagacatgtatgcagaggagcggaagaggcagcagctggagagggaccaggctacagtgacagagcagctgctgcgagaggggctccaagccagtggggacgcccagctccgaaggacacgcttgcacaaactctcggccagacgggaagagcgagtccaaggcttcctgcaggccttggaactcaagcgagctgactggctggcccgtctgggcactgcatcagcctgaatgaggctggccacctgccactttgccctgccctctgcctccagggctccactccccttccttttcttggtgaaaggcacctcctttcctgataa

SEQ ID NO: 8037 - DNA, 556 bp, Homo sapiens
agaggagaagagggtgactgggcggggagcagctgcgggagaagcaaagggacgactgagggaataatcaggagaccactgaggcgtgaagtactaggcgtgcgataactgaaggagttagtaactgggagcacagagttggaaacagcttaggggaagatggagaaggaagaaacggggaatgatcaagatgtgggcaccatgatgtggcaggaaaccgacttagatgttcagaagaagtcagtgcagatacggaggaaatgggaatgggaagaagtctgcaaagccaggagaaccgaggaaaggcttttgcctccagagattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgag

SEQ ID NO: 8038 - DNA, 496 bp, Homo sapiens
agctaatcaggtgccactgaactgaaggggtgaactagaggagaagaggattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggatct

SEQ ID NO: 8039 - DNA, 582 bp, Homo sapiens
gagctaatcaggtgccactgaactgaagggattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggatctccaggagctgattgcacaagctgtacaggccacgaagaactacaacaagtgtttcctgaatgtctgttttgcatacacatcccgtcatgagatcagcaatgctgt

SEQ ID NO: 8040 - DNA, 1723 bp, Homo sapiens
tttttttttttttcttcccctccctaaactcctctgtcagtctgtaaacattacctgagaattccccagccgaaacggctgctggggcaagaaacttcttgttagaactttccacctccggcttccccctccacctcttttaccgtcccaaccttaggagacgctttttctcccccagaggagaatttatctttttttttttttttttttttctttttctcacccggtgctttgcatttgggaagaggtgatttcaagagtggccaggtgggacgcctctctcctccttattcggtttactatttattgttcggggtgttttttaattcctgtattgctcggcccggggagtttcgccccctgcccggctccgcggcgcggaggatggtgtggaaacggctgggcgcgctggtgatgttccctctacagatgatctatctggtggtgaaagcagccgtcggactggtgctgcccgccaagctgcgggacctgtcgcgggagaacgtcctcatcaccggcggcgggagaggcatcgggcgtcagctcgcccgcgagttcgcggagcgcggcgccagaaagattgttctctggggccggactgagaaatgcctgaaggagacgacggaggagatccggcagatgggcactgagtgccattacttcatctgtgatgtgggcaaccgggaggaggtgtaccagacggccaaggccgtccgggagaaggtgggtgacatcaccatcctggtgaacaatgccgccgtggtccatgggaagagcctaatggacagtgatgatgatgccctcctcaagtcccaacacatcaacaccctgggccagttctggaccaccaaggccttcctgccacgtatgctggagctgcagaatggccacatcgtgtgcctcaactccgtgctggcactgtctgccatccccggtgccatcgactactgcacatccaaagcgtcagccttcgccttcatggagagcctgaccctggggctgctggactgtccgggagtcagcgccaccacagtgctgcccttccacaccagcaccgagatgttccagggcatgagagtcaggtttcccaacctctttcccccactgaagccggagacggtggcccggaggacagtggaagctgtgcagctcaaccaggccctcctcctcctcccatggacaatgcatgccctcgttatcttgaaaagcatacttccacaggctgcactcgaggagatccacaaattctcaggaacctacacctgcatgaacactttcaaagggcggacatagagacaggatgaagacatgcttgaggagccacggagtttgggggccacagcacctgggcacacacccgagcacctgtccattggcatgcttctgctgggtgagcaggacagctcctgtccccagcgaagaatccggctgcccctgggccagtcccaggacctttgcacaggactgatgggtataactgacccccacagggaggcaggaaaacagccagaagccaccttgacacttttgaacatttccagttctgtagagtttattgtcaattgcttctcaagtctaaccagcctcagcagtgtgcatagaccatttccaggagggtctgtccccagatgctctgcctcccgttccaaaacccactcatcctcagcttgcacaaactggttgaacggcaggaatgaaaaataaagagagatggcttttgtga

SEQ ID NO: 8041 - DNA, 826 bp, Homo sapiens
ggaagcggagacagagaccctagaggagaggctgcccccggaggggtgggagctgccagcccccaggggtgctcgaggggagcgaggccgctccagggaggtgggtgcccgccagaggggcggcgagggctgccgggacggttcacgcagcggccagcagactggctgcgtgttgcaatgtctggtggcgtttgcagcatcctgtccgtgtgtgcagctggggtaacctcgggccggcggaggagcgcgtgtggctcgtaggccctgcggccggaggctgctggcaccttgcatctcatttacagctccgggttcagccacagattgttctctggggccggactgagaaatgcctgaaggagacgacggaggagatccggcagatgggcactgagtgccattacttcatctgtgatgtgggcaaccgggaggaggtgtaccagacggccaaggccgtccgggagaaggtgggtgacatcaccatcctggtgaacaatgccgccgtggtccatgggaagagcctaatggacagtgatgatgatgccctcctcaagtcccaacacatcaacaccctgggccagttctggaccaccaaggccttcctgccacgtatgctggagctgcagaatggccacatcgtgtgcctcaactccgtgctggcactgtctgccatccccggtgccatcgactactgcacatccaaagcgtcagccttcgccttcatggagagcctgaccctggggctgctggactgtccgggagtcagcgccaccacagtgctgcccttccacaccagcaccgagatgttccagggcatgagagtcag

SEQ ID NO: 8042 - DNA, 496 bp, Homo sapiens
atacttgctggtctgatccatgcacaaggcggggctgctaggcctctgtgcccgggcttggaattcggtgcggatggccagctccgggatgacccgccgggacccgctcgcaaataaggtggccctggtaacggcctccaccgacgggatcggcttcgccatcgcccggcgtttggcccaggacggggcccatgtggtcgtcagcagccggaagcagcagaatgtggaccaggcggtggccacgctgcagggggaggggctgagcgtgacgggcaccgtgtgccatgtggggaaggcggaggaccgggagcggctggtggccacgctctggatggacaaggaaaaagaggaaagcatgaaagaaaccctgcggataagaaggttaggcgagccagaggattgtgctggcatcgtgtctttcctgtgctctgaagatgccagctacatcactggggaaacagtggtggtgggtggaggaaccccgtcccgcctctga

SEQ ID NO: 8043 - DNA, 1443 bp, Homo sapiens
aaaggcaagccccagtcaggcggaaggtagatggtggaggggcgccgcggcggatggaggtgcccagggccacagaccgctcacagcggtaccggggcggggagcagggcgggcagggaatcggcccgcccttcgtcctgcccctcgccctactctgtcaccgcccctgggaagagtggaacccatacttgctggtctgatccatgcacaaggcggggctgctaggcctctgtgcccgggcttggaattcggtgcggatggccagctccgggatgacccgccgggacccgctcgcaaataaggtggccctggtaacggcctccaccgacgggatcggcttcgccatcgcccggcgtttggcccaggacggggcccatgtggtcgtcagcagccggaagcagcagaatgtggaccaggcggtggccacgctgcagggggaggggctgagcgtgacgggcaccgtgtgccatgtggggaaggcggaggaccgggagcggctggtggccacggctgtgaagcttcatggaggtatcgatatcctagtctccaatgctgctgtcaaccctttctttggaagcataatggatgtcactgaggaggtgtgggacaagactctggacattaatgtgaaggccccagccctgatgacaaaggcagtggtgccagaaatggagaaacgaggaggcggctcagtggtgatcgtgtcttccatagcagccttcagtccatctcctggcttcagtccttacaatgtcagtaaaacagccttgctgggcctgaccaagaccctggccatagagctggccccaaggaacattagggtgaactgcctagcacctggacttatcaagactagcttcagcaggatgctctggatggacaaggaaaaagaggaaagcatgaaagaaaccctgcggataagaaggttaggcgagccagaggattgtgctggcatcgtgtctttcctgtgctctgaagatgccagctacatcactggggaaacagtggtggtgggtggaggaaccccgtcccgcctctgaggaccgggagacagcccacaggccagagttgggctctagctcctggtgctgttcccgcattcacccactggcctttcccacctctgctcaccttactgttcacctcatcaaatcagttctgccctgtgaaaagatccagccttccctgccgtcaaggtggcgtcttactcgggatttctgctgttgttgtggccttgggtaaaggcctcccctgagaacacaggacaggcctgctgacaaggctgagtctaccttggcaaagaccaagatattttttcccgggccactggggaatctgaggggtgatgggagagaaggaacctggagtggaaggagcagagttgcaaattaacaacttgcaaatgaggtgcaaataaaatgcagatgattgcgcggctttgaa

SEQ ID NO: 8044 - DNA, 586 bp, Homo sapiens
atacttgctggtctgatccatgcacaaggcggggctgctaggcctctgtgcccgggcttggaattcggtgcggatggccagctccgggatgacccgccgggacccgctcgcaaataaggtggccctggtaacggcctccaccgacgggatcggcttcgccatcgcccggcgtttggcccaggacggggcccatgtggtcgtcagcagccggaagcagcagaatgtggaccaggcggtggccacgctgcagggggaggggctgagcgtgacgggcaccgtgtgccatgtggggaaggcggaggaccgggagcggctggtggccacggctgtgaagcttcatggaggtatcgatatcctagtctccaatgctgctgtcaaccctttctttggaagcataatggatgtcactgaggaggtgtgggacaagaggcggctcagtggtgatcgtgtcttccatagcagccttcagtccatctcctctctggatggacaaggaaaaagaggaaagcatgaaagaaaccctgcggataagaaggttaggcgagccagaggattgtgctggcatcgtgtctttcctgtgctctga

SEQ ID NO: 8045 - DNA, 619 bp, Homo sapiens
atacttgctggtctgatccatgcacaaggcggggctgctaggcctctgtgcccgggcttggaattcggtgcggatggccagctccgggatgacccgccgggacccgctcgcaaataaggtggccctggtaacggcctccaccgacgggatcggcttcgccatcgcccggcgtttggcccaggacggggcccatgtggtcgtcagcagccggaagcagcagaatgtggaccaggcggtggccacgctgcagggggaggggctgagcgtgacgggcaccgtgtgccatgtggggaaggcggaggaccgggagcggctggtggccacgactctggacattaatgtgaaggccccagccctgatgacaaaggcagtggtgccagaaatggagaaacgaggaggcggctcagtggtgatcgtgtcttccatagcagccttcagtccatctcctctctggatggacaaggaaaaagaggaaagcatgaaagaaaccctgcggataagaaggttaggcgagccagaggattgtgctggcatcgtgtctttcctgtgctctgaagatgccagctacatcactggggaaacagtggtggtgggtggaggaaccccgtcccgcctctga

SEQ ID NO: 8046 - DNA, 785 bp, Homo sapiens
tccatgcacaaggcggggctgctaggcctctgtgcccgggcttggaattcggtgcggatggccagctccgggatgacccgccgggacccgctcgcaaataaggtggccctggtaacggcctccaccgacgggatcggcttcgccatcgcccggcgtttggcccaggacggggcccatgtggtcgtcagcagccggaagcagcagaatgtggaccaggcggtggccacgctgcagggggaggggctgagcgtgacgggcaccgtgtgccatgtggggaaggcggaggaccgggagcggctggtggccacgctctggatggacaaggaaaaagaggaaagcatgaaagaaaccctgcggataagaaggttaggcgagccagaggattgtgctggcatcgtgtctttcctgtgctctgaagatgccagctacatcactggggaaacagtggtggtgggtggaggaaccccgtcccgcctctgaggaccgggagacagcccacaggccagagttgggctctagctcctggtgctgttcccgcattcacccactggcctttcccacctctgctcaccttactgttcacctcatcaaatcagttctgccctgtgaaaagatccagccttccctgccgtcaaggtggcgtcttactcgggatttctgctgttgttgtggccttgggtaaaggcctcccctgagaacacaggacaggcctgctgacaaggctgagtctaccttggcaaagaccaagatattttttcccgggccactggggaatctgaggggtg

SEQ ID NO: 8047 - DNA, 727 bp, Homo sapiens
ggtctgatccatgcacaaggcggggctgctaggcctctgtgcccgggcttggaattcggtgcggatggccagctccgggatgacccgccgggacccgctcgcaaataaggtggccctggtaacggcctccaccgacgggatcggcttcgccatcgcccggcgtttggcccaggacggggcccatgtggtcgtcagcagccggaagcagcagaatgtggaccaggcggtggccacgctgcagggggaggggctgagcgtgacgggcaccgtgtgccatgtggggaaggcggaggaccgggagcggctggtggccacggctgtgaagcttcatggaggtatcgatatcctagtctccaatgctgctgtcaaccctttctttggaagcataatggatgtcactgaggaggtgtgggacaagctctggatggacaaggaaaaagaggaaagcatgaaagaaaccctgcggataagaaggttaggcgagccagaggattgtgctggcatcgtgtctttcctgtgctctgaagatgccagctacatcactggggaaacagtggtggtgggtggaggaaccccgtcccgcctctgaggaccgggagacagcccacaggccagagttgggctctagctcctggtgctgttcccgcattcacccactggcctttcccacctctgctcaccttactgttcacctcatcaaatcagttctgccctgtgaaaagatcca

SEQ ID NO: 8048 - DNA, 754 bp, Homo sapiens
atacttgctggtctgatccatgcacaaggcggggctgctaggcctctgtgcccgggcttggaattcggtgcggatggccagctccgggatgacccgccgggacccgctcgcaaataaggtggccctggtaacggcctccaccgacgggatcggcttcgccatcgcccggcgtttggcccaggacggggcccatgtggtcgtcagcagccggaagcagcagaatgtggaccaggcggtggccacgctgcagggggaggggctgagcgtgacgggcaccgtgtgccatgtggggaaggcggaggaccgggagcggctggtggccacgactctggacattaatgtgaaggccccagccctgatgacaaaggcagtggtgccagaaatggagaaacgaggaggcggctcagtggtgatcgtgtcttccatagcagccttcagtccatctcctggcttcagtccttacaatgtcagtaaaacagccttgctgggcctgaccaagaccctggccatagagctggccccaaggaacattagggtgaactgcctagcacctggacttatcaagactagcttcagcaggatgctctggatggacaaggaaaaagaggaaagcatgaaagaaaccctgcggataagaaggttaggcgagccagaggattgtgctggcatcgtgtctttcctgtgctctgaagatgccagctacatcactggggaaacagtggtggtgggtggaggaaccccgtcccgcctctga

SEQ ID NO: 8049 - DNA, 1089 bp, Homo sapiens
cctactctgtcaccgcccctgggaagagtggaacccatacttgctggtctgatccatgcacaaggcggggctgctaggcctctgtgcccgggcttggaattcggtgcggatggccagctccgggatgacccgccgggacccgctcgcaaataaggtggccctggtaacggcctccaccgacgggatcggcttcgccatcgcccggcgtttggcccaggacggggcccatgtggtcgtcagcagccggaagcagcagaatgtggaccaggcggtggccacgctgcagggggaggggctgagcgtgacgggcaccgtgtgccatgtggggaaggcggaggaccgggagcggctggtggccacggctgtgaagcttcatggaggtatcgatatcctagtctccaatgctgctgtcaaccctttctttggaagcataatggatgtcactgaggaggtgtgggacaagaggcggctcagtggtgatcgtgtcttccatagcagccttcagtccatctcctctctggatggacaaggaaaaagaggaaagcatgaaagaaaccctgcggataagaaggttaggcgagccagaggattgtgctggcatcgtgtctttcctgtgctctgaagatgccagctacatcactggggaaacagtggtggtgggtggaggaaccccgtcccgcctctgaggaccgggagacagcccacaggccagagttgggctctagctcctggtgctgttcccgcattcacccactggcctttcccacctctgctcaccttactgttcacctcatcaaatcagttctgccctgtgaaaagatccagccttccctgccgtcaaggtggcgtcttactcgggatttctgctgttgttgtggccttgggtaaaggcctcccctgagaacacaggacaggcctgctgacaaggctgagtctaccttggcaaagaccaagatattttttcccgggccactggggaatctgaggggtgatgggagagaaggaacctggagtggaaggagcagagttgcaaattaacaacttgcaaatgaggtgcaaataaaatgcagatgattgcgcggctttgaa

SEQ ID NO: 8050 - DNA, 1003 bp, Homo sapiens
atgcacaaggcggggctgctaggcctctgtgcccgggcttggaattcggtgcggatggccagctccgggatgacccgccgggacccgctcgcaaataaggtggccctggtaacggcctccaccgacgggatcggcttcgccatcgcccggcgtttggcccaggacggggcccatgtggtcgtcagcagccggaagcagcagaatgtggaccaggcggtggccacgctgcagggggaggggctgagcgtgacgggcaccgtgtgccatgtggggaaggcggaggaccgggagcggctggtggccacgactctggacattaatgtgaaggccccagccctgatgacaaaggcagtggtgccagaaatggagaaacgaggaggcggctcagtggtgatcgtgtcttccatagcagccttcagtccatctcctctctggatggacaaggaaaaagaggaaagcatgaaagaaaccctgcggataagaaggttaggcgagccagaggattgtgctggcatcgtgtctttcctgtgctctgaagatgccagctacatcactggggaaacagtggtggtgggtggaggaaccccgtcccgcctctgaggaccgggagacagcccacaggccagagttgggctctagctcctggtgctgttcccgcattcacccactggcctttcccacctctgctcaccttactgttcacctcatcaaatcagttctgccctgtgaaaagatccagccttccctgccgtcaaggtggcgtcttactcgggatttctgctgttgttgtggccttgggtaaaggcctcccctgagaacacaggacaggcctgctgacaaggctgagtctaccttggcaaagaccaagatattttttcccgggccactggggaatctgaggggtgatgggagagaaggaacctggagtggaaggagcagagttgcaaattaacaacttgcaaatgaggtgcaaataaaatgcagatgattgcgcggctttgaa

SEQ ID NO: 8051 - DNA, 2322 bp, Homo sapiens
gcaatccaagactgcttagggttcggaattacaaaaccaaattccctgctaaggctaaagttgatctgaacaaaagtaagggcaaggcaaagagaatagacattagacagggacctgaaaggatccagaaatgggactttacatcccacagaggaaacagacacagggtttcctcatgttgcccaggctggtctcggacacttgaattcaagcaatctgccggccccgccgggtgtgccgcatgagggcgcgggccgcccaaggaccgcgagtggggccgcgagtgctgagcccggcgcgcccgagccgctcctcctcccggcctgctccctgggcggagccggggcagtgcggctctgggctggccgaaggggtggcgctgcgatcccgcagggcagcgacgcgactctggtgcgggccgtcttcttccccccgagctgggcgtgcgcggccgcaatgaactgggagctgctgctgtggctgctggtgctgtgcgcgctgctcctgctcttggtgcagctgctgcgcttcctgagggctgacggcgacctgacgctactatgggccgagtggcagggacgacgcccagaatgggagctgactgatatggtggtgtgggtgactggagcctcgagtggaattggtgaggagctggcttaccagttgtctaaactaggagtttctcttgtgctgtcagccagaagagtgcatgagctggaaagggtgaaaagaagatgcctagagaatggcaatttaaaagaaaaagatatacttgttttgccccttgacctgaccgacactggttcccatgaagcggctaccaaagctgttctccaggagtttggtagaatcgacattctggtcaacaatggtggaatgtcccagcgttctctgtgcatggataccagcttggatgtctacagaaagctaatagagcttaactacttagggacggtgtccttgacaaaatgtgttctgcctcacatgatcgagaggaagcaaggaaagattgttactgtgaatagcatcctgggtatcatatctgtacctctttccattggatactgtgctagcaagcatgctctccggggtttttttaatggccttcgaacagaacttgccacatacccaggtataatagtttctaacatttgcccaggacctgtgcaatcaaatattgtggagaattccctagctggagaagtcacaaagactataggcaataatggagaccagtcccacaagatgacaaccagtcgttgtgtgcggctgatgttaatcagcatggccaatgatttgaaagaagtttggatctcagaacaacctttcttgttagtaacatatttgtggcaatacatgccaacctgggcctggtggataaccaacaagatggggaagaaaaggattgagaactttaagagtggtgtggatgcagactcttcttattttaaaatctttaagacaaaacatgactgaaaagagcacctgtacttttcaagccactggagggagaaatggaaaacatgaaaacagcaatcttcttatgcttctgaataatcaaagactaatttgtgattttactttttaatagatatgactttgcttccaacatggaatgaaataaaaaataaataataaaagattgccatgaatcttgcaaaaaaggtattaactcatactatattcttggataaaataaccttttaaaatactttagcacatatgcttaaaatctaagttaacagatttgtcttagtccatttgtgctgctataacaaaataccacagatttggtaatttataaacaacagaaatctgtttttcctggctcttgaggctgggaattccaagaccaatgcaccagcagaattagtgtctggtgaaggctgatctctgcttccaagatggcacctcattgctgcatcctccacagtggaggaatgtatgtcctcacatggtggaagggacagaagggaaagaggagcaaaatgctttcaaaagagcatttaatctcattcattactcagtcacctcttaaaggccacatcctttaatactgttgctttggggattaagtttcgacatgaattttggaggggacaaaaacatccaaaccatagcaacataaatgtatagaatatttcacacaaagcagagtgctgggtaatgaccagatataaagaagtatttgaaatgaccttacctccaagatgcttatactcttagaaaagttgacaggtacagatggctgtaatttgaagcagcaggtaggattcattgcacctattattcattaaacacctgttgtatgtcttctactgt

SEQ ID NO: 8052 - DNA, 1318 bp, Homo sapiens
ggagccggggcagtgcggctctgggctggccgaaggggtggcgctgcgatcccgcagggcagcgacgcgactctggtgcgggccgtcttcttccccccgagctgggcgtgcgcggccgcaatgaactgggagctgctgctgtggctgctggtgctgtgcgcgctgctcctgctcttggtgcagctgctgcgcttcctgagggctgacggcgacctgacgctactatgggccgagtggcagggacgacgcccagaatgggagctgactgatatggtggtgtgggtgactggagcctcgagtggaattggtgaggagctggcttaccagttgtctaaactaggagtttctcttgtgctgtcagccagaagagtgcatgagctggaaagggtgaaaagaagatgcctagagaatggcaatttaaaagaaaaagatatacttgttttgccccttgacctgaccgacactggttcccatgaagcggctaccaaagctgttctccaggagtttggtagaatcgacattctggtcaacaatggtggaatgtcccagcgttctctgtgcatggataccagcttggatgtctacagaaagctaatagagcttaactacttagggacggtgtccttgacaaaatgtgttctgcctcacatgatcgagaggaagcaaggaaagattgttactgtgaatagcatcctgggtatcatatctgtacctctttccattggatactgtgctagcaagcatgctctccggggtttttttaatggccttcgaacagaacttgccacatacccaggtataatagtttctaacatttgcccaggacctgtgcaatcaaatattgtggagaattccctagctggagaagtcacaaagactataggcaataatggagaccagtcccacaagatgacaaccagtcgttgtgtgcggctgatgttaatcagcatggccaatgatttgaaagaagtttggatctcagaacaacctttcttgttagtaacatatttgtggcaatacatgccaacctgggcctggtggataaccagatggggaagaaaaggattgagaactttaagagtggtgtggatgcagactcttcttattttaaaatctttaagacaaaacatgactgaaaagagcacctgtacttttcaagccactggagggagaaatggaaaacatgaaaacagcaatcttcttatgcttctgaataatcaaagactaatttgtgattttactttttaatagatatgactttgcttccaacatggaatgaaataaaaaataaataataaaagattgccatgaatcttgc

SEQ ID NO: 8053 - DNA, 1194 bp, Homo sapiens
gcttagggttcggaattacaaaaccaaattccctgctaaggctaaagttgatctgaacaaaagtaagggcaaggcaaagagaatagacattagacagggacctgaaaggatccagaaatgggactttacatcccacagaggaaacagaatgggagctgactgatatggtggtgtgggtgactggagcctcgagtggaattggtgaggagctggcttaccagttgtctaaactaggagtttctcttgtgctgtcagccagaagagtgcatgagctggaaagggtgaaaagaagatgcctagagaatggcaatttaaaagaaaaagatatacttgttttgccccttgacctgaccgacactggttcccatgaagcggctaccaaagctgttctccaggagtttggtagaatcgacattctggtcaacaatggtggaatgtcccagcgttctctgtgcatggataccagcttggatgtctacagaaagctaatagagcttaactacttagggacggtgtccttgacaaaatgtgttctgcctcacatgatcgagaggaagcaaggaaagattgttactgtgaatagcatcctgggtatcatatctgtacctctttccattggatactgtgctagcaagcatgctctccggggtttttttaatggccttcgaacagaacttgccacatacccaggtataatagtttctaacatttgcccaggacctgtgcaatcaaatattgtggagaattccctagctggagaagtcacaaagactataggcaataatggagaccagtcccacaagatgacaaccagtcgttgtgtgcggctgatgttaatcagcatggccaatgatttgaaagaagtttggatctcagaacaacctttcttgttagtaacatatttgtggcaatacatgccaacctgggcctggtggataaccaacaagatggggaagaaaaggattgagaactttaagagtggtgtggatgcagactcttcttattttaaaatctttaagacaaaacatgactgaaaagagcacctgtacttttcaagccactggagggagaaatggaaaacatgaaaacagcaatcttcttatgcttctgaataatcaaagactaatttgtgattttactttttaatagatatgactttgcttccaacatggaatgaaataaaaaataaataat

SEQ ID NO: 8054 - DNA, 1386 bp, Homo sapiens
tggggccgcgagtgctgagcccggcgcgcccgagccgctcctcctcccggcctgctccctgggcggagccggggcagtgcggctctgggctggccgaaggggtggcgctgcgatcccgcagggcagcgacgcgactctggtgcgggccgtcttcttccccccgagctgggcgtgcgcggccgcaatgaactgggagctgctgctgtggctgctggtgctgtgcgcgctgctcctgctcttggtgcagctgctgcgcttcctgagggctgacggcgacctgacgctactatgggccgagtggcagggacgacgcccagaatgggagctgactgatatggtggtgtgggtgactggagcctcgagtggaattggtgaggagctggcttaccagttgtctaaactaggagtttctcttgtgctgtcagccagaagagtgcatgagctggaaagggtgaaaagaagatgcctagagaatggcaatttaaaagaaaaagatatacttgttttgccccttgacctgaccgacactggttcccatgaagcggctaccaaagctgttctccaggagtttggtagaatcgacattctggtcaacaatggtggaatgtcccagcgttctctgtgcatggataccagcttggatgtctacagaaagctaatagagcttaactacttagggacggtgtccttgacaaaatgtgttctgcctcacatgatcgagaggaagcaaggaaagattgttactgtgaatagcatcctgggtatcatatctgtacctctttccattggatactgtgctagcaagcatgctctccggggtttttttaatggccttcgaacagaacttgccacatacccaggtataatagtttctaacatttgcccaggacctgtgcaatcaaatattgtggagaattccctagctggagaagtcacaaagactataggcaataatggagaccagtcccacaagatgacaaccagtcgttgtgtgcggctgatgttaatcagcatggccaatgatttgaaagaagtttggatctcagaacaacctttcttgttagtaacatatttgtggcaatacatgccaacctgggcctggtggataaccaacaagatggggaagaaaaggattgagaactttaagagtggtgtggatgcagactcttcttattttaaaatctttaagacaaaacatgactgaaaagagcacctgtacttttcaagccactggagggagaaatggaaaacatgaaaacagcaatcttcttatgcttctgaataatcaaagactaatttgtgattttactttttaatagatatgactttgcttccaacatggaatgaaataaaaaataaataataaaagattgccatgaatcttgc

SEQ ID NO: 8055 - DNA, 582 bp, Homo sapiens
atgcactctaactgggtccctctgaggcttgtgaatggaaaaccctcttgctttcaaatgcttgaaaacaagaaagatgctactattgatgcctcaaatacatacacagggtttcctcatgttgcccaggctggtctcggacacttgaattcaagcaatctgccggccccgccgggtgtgccgcatgagggcgcgggccgcccaaggaccgcgagtggggccgcgagtgctgagcccggcgcgcccgagccgctcctcctcccggcctgctccctgggcggagccggggcagtgcggctctgggctggccgaaggggtggcgctgcgatcccgcagggcagcgacgcgactctggtgcgggccgtcttcttccccccgagctgggcgtgcgcggccgcaatgaactgggagctgctgctgtggctgctggtgctgtgcgcgctgctcctgctcttggtgcagctgctgcgcttcctgagggctgacggcgacctgacgctactatgggccgagtggcagggacgacgcccagaatgggagctgactgatatggtggtgtgggtgactggagcctcgagtgga

SEQ ID NO: 8056 - DNA, 2864 bp, Homo sapiens
atctgaaaaattaataattccttaattatcaaatatccattatttaaatttataattgtgtcataaatattgtcataaatagatttgctgttttaaagcttgttccttcattttctctgttttgttttagataaacattgtcataaatagatttgttgttttaaagcttgttccttcattttctctgattgttttgttttagattcagaggttacttatgcttgtttgttacatggatgttacatgtgtaatgggggatattggacttctagtgtactcatcacccatatactgaacactgtactcaaaagggattgaaagaaactaggaaacttggcaggaagatcattcttaagccaggaaaaaaatttttaatgctcacatgtgaacatgtgatggtcataccagaaggagcacccacctccctccctctgtgacagacacattttcttagccttcacctttccttctttcaagttgctgaaaatccacagtgtttctgttcatttgttactttcattctcacctatcttctctcttgctccatctaccagaacaataattccccatataatacttctcacttcacttttcaacgcaggacctcttgttgggtctgatctgtttgtctgtccgctttatcaatattatcagatgtaagtttacatgaatacacacacatattcactaaactgaggggaaaaaatgccttgtaggtcataaaaaagcagggaaattcccaacaattcatatttgatccctggatccaggggtggcagcaataagcctgctttagatatttactccccattttatgatccggtggtttggtttttcaaatgatgatatggctcctttcgcaatgacttgatgtttaggaggtgtgcttcaataaatacattttaaaatcaacaatcaagttagagttgtacaaatggctctgaaatgtcccactacactgttagaccaagggcacagattgtgcttctgtactatttatcctagtatccctcggcatatattaactgctctaaaaatctccttggctacacgctgcatcaaatcaaagttaaatgttataccacctttctattctatttttaatattcaaagagggtgctcagattttagaacaaatttcaatgtttaagtacacacaaaaaaatcattaactcatatatttcaagagtaggaaatgggaactggtgttaaaactcttataacaaatgtcactgtcttaagggacagtgtttaaaaacgcatacctggccgggcgcggtggctcatgcctgtaatcccagcactttgggaggccgaggccggcggatcacaaggaaaacaaactcaggaagaaaaagaaaagcagaagtgatcaaggagagcgctcgagttgcaatattttcctttggctgctgacaggcagttactataaagcattgtgcatggacaccatcttcttgtattatacaagaaaggagtgtacctatcacacacagggggaaaaatgctcttttgggtgctaggcctcctaatcctctgtggttttctgtggactcgtaaaggaaaactaaagattgaagacatcactgataagtacatttttatcactggatgtgactcgggctttggaaacttggcagccagaacttttgataaaaagggatttcatgtaatcgctgcctgtctgactgaatcaggatcaacagctttaaaggcagaaacctcagagagacttcgtactgtgcttctggatgtgaccgacccagagaatgtcaagaggactgcccagtgggtgaagaaccaagttggggagaaaggtctctggggtctgatcaataatgctggtgttcccggcgtgctggctcccactgactggctgacactagaggactacagagaacctattgaagtgaacctgtttggactcatcagtgtgacactaaatatgcttcctttggtcaagaaagctcaagggagagttattaatgtctccagtgttggaggtcgccttgcaatcgttggagggggctatactccatccaaatatgcagtggaaggtttcaatgacagcttaagacgggacatgaaagcttttggtgtgcacgtctcatgcattgaaccaggattgttcaaaacaaacttggcagatccagtaaaggtaattgaaaaaaaactcgccatttgggagcagctgtctccagacatcaaacaacaatatggagaaggttacattgaaaaaagtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtgactcagctaaccacaaatgtctcctccaggctatgaaattggccgatttcaagaacacatctccttttcaaccccattccttatctgctccaacctggactcatttagatcgtgcttatttggattgcaaaagggagtcccaccatcgctggtggtatcccagggtccctgctcaagttttctttgaaaaggagggctggaatggtacatcacataggcaagtcctgccctgtatttaggctttgcctgcttggtgtgatgtaagggaaattgaaagacttgcccattcaaaatgatctttaccgtggcctgccccatgcttatggtccccagcatttacagtaacttgtgaatgttaagtatcatctcttatctaaatattaaaagataagtcaaacatt

SEQ ID NO: 8057 - DNA, 1917 bp, Homo sapiens
aggaagaaaatataaagtacacttttaaaacatgaagtcttcatagcagcttatagtcgttcagagaaacatgttccactgagaatgacttgagagagaggattacatcattatgccagaaggaagaagccactgtgcatgctctatcaccagcctcaccctcctggtcagccttacaagagtgacactggatatactccagaagttggacccaccacagcctgcacactggacttcttggcttttatgagctattcaagagatatttagtcatcacgttgtgtcacaatgggagtgactcacagagcaaggagagaacctgaggattcctcacacatgtagtactcagagctctacggaaacccaggcacctcgacctcaagaggatcagcctggccagggtggcacaactcttccttccccgtgcacagcaggaaagctgccatcagctgagcaagtccaccaacagtttctgtgtcccacttcatctttaataaggacaccatcttcttgtattatacaagaaaggagtgtacctatcacacacagggggaaaaatgctcttttgggtgctaggcctcctaatcctctgtggttttctgtggactcgtaaaggaaaactaaagattgaagacatcactgataagtacatttttatcactggatgtgactcgggctttggaaacttggcagccagaacttttgataaaaagggatttcatgtaatcgctgcctgtctgactgaatcaggatcaacagctttaaaggcagaaacctcagagagacttcgtactgtgcttctggatgtgaccgacccagagaatgtcaagaggactgcccagtgggtgaagaaccaagttggggagaaaggtctctggggtctgatcaataatgctggtgttcccggcgtgctggctcccactgactggctgacactagaggactacagagaacctattgaagtgaacctgtttggactcatcagtgtgacactaaatatgcttcctttggtcaagaaagctcaagggagagttattaatgtctccagtgttggaggtcgccttgcaatcgttggagggggctatactccatccaaatatgcagtggaaggtttcaatgacagcttaagacgggacatgaaagcttttggtgtgcacgtctcatgcattgaaccaggattgttcaaaacaaacttggcagatccagtaaaggtaattgaaaaaaaactcgccatttgggagcagctgtctccagacatcaaacaacaatatggagaaggttacattgaaaaaagtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtgactcagctaaccacaaatgtctcctccaggctatgaaattggccgatttcaagaacacatctccttttcaaccccattccttatctgctccaacctggactcatttagatcgtgcttatttggattgcaaaagggagtcccaccatcgctggtggtatcccagggtccctgctcaagttttctttgaaaaggagggctggaatggtacatcacataggcaagtcctgccctgtatttaggctttgcctgcttggtgtgatgtaagggaaattgaaagacttgcccattcaaaatgatctttaccgtggcctgccccatgcttatggtccccagcatttacagtaacttgtgaatgttaagtatcatctcttatctaaatattaaaagataagtcaaacatt

SEQ ID NO: 8058 - DNA, 1465 bp, Homo sapiens
agattttaagcccattctgcagtggaatttcatgaactagcaagaggacaccatcttcttgtattatacaagaaaggagtgtacctatcacacacagggggaaaaatgctcttttgggtgctaggcctcctaatcctctgtggttttctgtggactcgtaaaggaaaactaaagattgaagacatcactgataagtacatttttatcactggatgtgactcgggctttggaaacttggcagccagaacttttgataaaaagggatttcatgtaatcgctgcctgtctgactgaatcaggatcaacagctttaaaggcagaaacctcagagagacttcgtactgtgcttctggatgtgaccgacccagagaatgtcaagaggactgcccagtgggtgaagaaccaagttggggagaaaggtctctggggtctgatcaataatgctggtgttcccggcgtgctggctcccactgactggctgacactagaggactacagagaacctattgaagtgaacctgtttggactcatcagtgtgacactaaatatgcttcctttggtcaagaaagctcaagggagagttattaatgtctccagtgttggaggtcgccttgcaatcgttggagggggctatactccatccaaatatgcagtggaaggtttcaatgacagcttaagacgggacatgaaagcttttggtgtgcacgtctcatgcattgaaccaggattgttcaaaacaaacttggcagatccagtaaaggtaattgaaaaaaaactcgccatttgggagcagctgtctccagacatcaaacaacaatatggagaaggttacattgaaaaaagtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtgactcagctaaccacaaatgtctcctccaggctatgaaattggccgatttcaagaacacatctccttttcaaccccattccttatctgctccaacctggactcatttagatcgtgcttatttggattgcaaaagggagtcccaccatcgctggtggtatcccagggtccctgctcaagttttctttgaaaaggagggctggaatggtacatcacataggcaagtcctgccctgtatttaggctttgcctgcttggtgtgatgtaagggaaattgaaagacttgcccattcaaaatgatctttaccgtggcctgccccatgcttatggtccccagcatttacagtaacttgtgaatgttaagtatcatctcttatctaaatattaaaagataagtcaaacatt

SEQ ID NO: 8059 - DNA, 1044 bp, Homo sapiens
cggaaacccaggcacctcgacctcaagaggatcagcctggccagggtggcacaactcttccttccccgtgcacagcaggaaagctgccatcagctgagcaagtccaccaacagtttctgtgtcccacttcatctttaataaggaaaactaaagattgaagacatcactgataagtacatttttatcactggatgtgactcgggctttggaaacttggcagccagaacttttgataaaaagggatttcatgtaatcgctgcctgtctgactgaatcaggatcaacagctttaaaggcagaaacctcagagagacttcgtactgtgcttctggatgtgaccgacccagagaatgtcaagaggactgcccagtgggtgaagaaccaagttggggagaaaggtctctggggtctgatcaataatgctggtgttcccggcgtgctggctcccactgactggctgacactagaggactacagagaacctattgaagtgaacctgtttggactcatcagtgtgacactaaatatgcttcctttggtcaagaaagctcaagggagagttattaatgtctccagtgttggaggtcgccttgcaatcgttggagggggctatactccatccaaatatgcagtggaaggtttcaatgacagcttaagacgggacatgaaagcttttggtgtgcacgtctcatgcattgaaccaggattgttcaaaacaaacttggcagatccagtaaaggtaattgaaaaaaaactcgccatttgggagcagctgtctccagacatcaaacaacaatatggagaaggttacattgaaaaaagtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtga

SEQ ID NO: 8060 - DNA, 1678 bp, Homo sapiens
atgtagtactcagagctctacggaaacccaggcacctcgacctcaagaggatcagcctggccagggtggcacaactcttccttccccgtgcacagcaggaaagctgccatcagctgagcaagtccaccaacagtttctgtgtcccacttcatctttaataagtttgaagataattgggagtctgacagaacaattaaaattgaattattgtttctaatagattttaagcccattctgcagtggaatttcatgaactagcaagaggacaccatcttcttgtattatacaagaaaggagtgtacctatcacacacagggggaaaaatgctcttttgggtgctaggcctcctaatcctctgtggttttctgtggactcgtaaaggaaaactaaagattgaagacatcactgataagtacatttttatcactggatgtgactcgggctttggaaacttggcagccagaacttttgataaaaagggatttcatgtaatcgctgcctgtctgactgaatcaggatcaacagctttaaaggcagaaacctcagagagacttcgtactgtgcttctggatgtgaccgacccagagaatgtcaagaggactgcccagtgggtgaagaaccaagttggggagaaaggtctctggggtctgatcaataatgctggtgttcccggcgtgctggctcccactgactggctgacactagaggactacagagaacctattgaagtgaacctgtttggactcatcagtgtgacactaaatatgcttcctttggtcaagaaagctcaagggagagttattaatgtctccagtgttggaggtcgccttgcaatcgttggagggggctatactccatccaaatatgcagtggaaggtttcaatgacagcttaagacgggacatgaaagcttttggtgtgcacgtctcatgcattgaaccaggattgttcaaaacaaacttggcagatccagtaaaggtaattgaaaaaaaactcgccatttgggagcagctgtctccagacatcaaacaacaatatggagaaggttacattgaaaaaagtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtgactcagctaaccacaaatgtctcctccaggctatgaaattggccgatttcaagaacacatctccttttcaaccccattccttatctgctccaacctggactcatttagatcgtgcttatttggattgcaaaagggagtcccaccatcgctggtggtatcccagggtccctgctcaagttttctttgaaaaggagggctggaatggtacatcacataggcaagtcctgccctgtatttaggctttgcctgcttggtgtgatgtaagggaaattgaaagacttgcccattcaaaatgatctttaccgtggcctgccccatgcttatggtccccagcatttacagtaacttgtgaatgttaagtatcatctcttatctaaatattaaaagataagtcaa

SEQ ID NO: 8061 - DNA, 1402 bp, Homo sapiens
atagcagcttatagtcgttcagagaaacatgttccactgagaatgacttgagagagaggattacatcattatgccagaaggaagaagccactgtgcatgctctatcaccagcctcaccctcctggtcagccttacaagagtgacactggatatactccagaagttggacccaccacagcctgcacactggagacaccatcttcttgtattatacaagaaaggagtgtacctatcacacacagggggaaaaatgctcttttgggtgctaggcctcctaatcctctgtggttttctgtggactcgtaaaggaaaactaaagattgaagacatcactgataagtacatttttatcactggatgtgactcgggctttggaaacttggcagccagaacttttgataaaaagggatttcatgtaatcgctgcctgtctgactgaatcaggatcaacagctttaaaggcagaaacctcagagagacttcgtactgtgcttctggatgtgaccgacccagagaatgtcaagaggactgcccagtgggtgaagaaccaagttggggagaaaggtctctggggtctgatcaataatgctggtgttcccggcgtgctggctcccactgactggctgacactagaggactacagagaacctattgaagtgaacctgtttggactcatcagtgtgacactaaatatgcttcctttggtcaagaaagctcaagggagagttattaatgtctccagtgttggaggtcgccttgcaatcgttggagggggctatactccatccaaatatgcagtggaaggtttcaatgacagcttaagacgggacatgaaagcttttggtgtgcacgtctcatgcattgaaccaggattgttcaaaacaaacttggcagatccagtaaaggtaattgaaaaaaaactcgccatttgggagcagctgtctccagacatcaaacaacaatatggagaaggttacattgaaaaaagtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtgactcagctaaccacaaatgtctcctccaggctatgaaattggccgatttcaagaacacatctccttttcaaccccattccttatctgctccaacctggactcatttagatcgtgcttatttggattgcaaaagggagtcccaccatcgctggtggtatcccagggtccctgctcaagttttctttgaaaagga

SEQ ID NO: 8062 - DNA, 1817 bp, Homo sapiens
atttatttttaagaaacagaggaaggtgaataagagaagtgaaattaaataatcctattttaacttttttactaggaaaacaaactcaggaagaaaaagaaaagcagaagtgatcaaggagagcgctcgagttgcaatattttcctttggctgctgacaggcagttactataaagcattgtgcatggtaggaaaatggaggctaagaaaagttaatttgtccgagggccctctgatgatagtgaaactgggatggaacctctgcctgcttgcttctgaggtctgggctcctaactactgctctactgcctcgagccaagagatttacgccctattaagcaatttgttgtgcgataaattggaagacacagcagataagcaaacaactcaagcaaccaggacaccatcttcttgtattatacaagaaaggagtgtacctatcacacacagggggaaaaatgctcttttgggtgctaggcctcctaatcctctgtggttttctgtggactcgtaaaggaaaactaaagattgaagacatcactgataagtacatttttatcactggatgtgactcgggctttggaaacttggcagccagaacttttgataaaaagggatttcatgtaatcgctgcctgtctgactgaatcaggatcaacagctttaaaggcagaaacctcagagagacttcgtactgtgcttctggatgtgaccgacccagagaatgtcaagaggactgcccagtgggtgaagaaccaagttggggagaaaggtctctggggtctgatcaataatgctggtgttcccggcgtgctggctcccactgactggctgacactagaggactacagagaacctattgaagtgaacctgtttggactcatcagtgtgacactaaatatgcttcctttggtcaagaaagctcaagggagagttattaatgtctccagtgttggaggtcgccttgcaatcgttggagggggctatactccatccaaatatgcagtggaaggtttcaatgacagcttaagacgggacatgaaagcttttggtgtgcacgtctcatgcattgaaccaggattgttcaaaacaaacttggcagatccagtaaaggtaattgaaaaaaaactcgccatttgggagcagctgtctccagacatcaaacaacaatatggagaaggttacattgaaaaaagtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtgactcagctaaccacaaatgtctcctccaggctatgaaattggccgatttcaagaacacatctccttttcaaccccattccttatctgctccaacctggactcatttagatcgtgcttatttggattgcaaaagggagtcccaccatcgctggtggtatcccagggtccctgctcaagttttctttgaaaaggagggctggaatggtacatcacataggcaagtcctgccctgtatttaggctttgcctgcttggtgtgatgtaagggaaattgaaagacttgcccattcaaaatgatctttaccgtggcctgccccatgcttatggtccccagcatttacagtaacttgtgaatgttaagtatcatctcttatctaaatattaaaagataagtcaaacatt

SEQ ID NO: 8063 - DNA, 524 bp, Homo sapiens
tactcagagctctacggaaacccaggcacctcgacctcaagaggatcagcctggccagggtggcacaactcttccttccccgtgcacagcaggaaagctgccatcagctgagcaagtccaccaacagtttctgtgtcccacttcatctttaataaggaaaacaaactcaggaagaaaaagaaaagcagaagtgatcaaggagagcgctcgagttgcaatattttcctttggctgctgacaggcagttactataaagcattgtgcatggacaccatcttcttgtattatacaagaaaggagtgtacctatcacacacagggggaaaaatgctcttttgggtgctaggcctcctaatcctctgtggttttctgtggactcgtaaaggaaaactaaagattgaagacatcactgataagtacatttttatcactggatgtgactcgggctttggaaacttggcagccagaacttttgataaaaagggatttcatgtaatcgctgcctgtctgactgaatcaggatca

SEQ ID NO: 8064 - DNA, 1658 bp, Homo sapiens
gagcttactctggctttgccgagatggggctgccccagccagggctgtggctgaagaggctctgggtgctcttggaggtggctgtgcatgtggtcgtgggtaaagtgcttctgatattgtttccagacagagtcaagcggaacatcctggccatgggcgagaagacgggtatgaccaggaacccccatttcagccacgacaactggataccaacctttttcagcacccagtatttctggttcgtcttgaaggtccgttggcagcgactagaggacacgactgagctagggggtctggccccaaactgcccggtggtccgcctctcaggacagaggtgcaacatttgggagtttatgcaaggtaataggccactggtgctgaattttggaagttgtacctgaccttcatttatgttcaaatttgaccagttcaagaggcttattgaagactttagttccatagcagattttcttgtcatttacattgaagaagcacatgcatcagggtaaatctggcccttggaactacaacccagaggaagttcgtgctgttctggaaaagctccacagttaatctggacagatacctcaattctaggtgaccaacgggagggcttctcaaggcttagctctccctgagacccagctggcttttacccttgacctgtgtccctagctgaatcactagctcagatttttctgatctaagcaaacaactcccagctgaggaatgcaggccacagcacccaatcaagacaaattgttattatcagaaaatgaagcaacacttgagctgttcaggccagttccctgttgaagaaacagttccctgttgaagaaagtagagcctgacactgctcccactttggagaccacattccctgcacacggtctttgagagagcagttgcactctacaggcacacttctgaggtacggtatctctctccagccactctgataccaagtaattcaagctggcattccttctattagggaaattcattttacccaatttgcatttatggaattgatcatttaagacactaaattagtttttagaaccaattatgggaagaattccagttgttaggaagagatgaggagttggaagaggagggattagaaacaggaggaggcagtcatcctctccttgccaaaagatttaaacctgtccacattggtggtgatgatgggtgagtttccatggtaacacatccctaattttaccagggaagaggagagtactcactttaccatctttgaatatatttcatagaaatctagctctctgtaccctgaaatcttccactagcctcacttttcaacagagtcatctagaagggagggttggcttcccaaaagcataaccttgaccaaaccaaacaataggcaccagcaatgctgtcattcagttatgcagaagctcatttgtgaaattctgtttctctgatttcttcgcaagtctcttaatggtcatttgtgttagattacatcaaactgatggatagccattggtattcatctattttaactctgtgtctttacatatttgtttatgatggccacagcctaaagtacacacggctgtgacttgattcaaaagaaaatgttataagatgcagtaaactaataacagaattattaaaatatatcaggc

SEQ ID NO: 8065 - DNA, 1861 bp, Homo sapiens
agagcttactctggctttgccgagatggggctgccccagccagggctgtggctgaagaggctctgggtgctcttggaggtggctgtgcatgtggtcgtgggtaaagtgcttctgatattgtttccagacagagtcaagcggaacatcctggccatgggcgagaagacgggtatgaccaggaacccccatttcagccacgacaactggataccaacctttttcagcacccagtatttctggttcgtcttgaaggtccgttggcagcgactagaggacacgactgagctagggggtctggccccaaactgcccggtggtccgcctctcaggacagaggtgcaacatttgggagtttatgcaaggtaataggccactggtgctgaattttggaagttgtacctgaccttcatttatgttcaaatttgaccagttcaagaggcttattgaagactttagttccatagcagattttcttgtcatttacattgaagaagcacatgcatcagatggctgggcttttaagaacaacatggacatcagaaatcaccagaaccttcaggatcgcctgcaggcagcccatctactgctggccaggagcccccagtgccctgtggtggtggacaccatgcagaaccagagcagccagctctacgcagcactgcctgagaggctctacataatccaggagggcaggatcctctacaagggtaaatctggcccttggaactacaacccagaggaagttcgtgctgttctggaaaagctccacagttaatctggacagatacctcaattctaggtgaccaacgggagggcttctcaaggcttagctctccctgagacccagctggcttttacccttgacctgtgtccctagctgaatcactagctcagatttttctgatctaagcaaacaactcccagctgaggaatgcaggccacagcacccaatcaagacaaattgttattatcagaaaatgaagcaacacttgagctgttcaggccagttccctgttgaagaaacagttccctgttgaagaaagtagagcctgacactgctcccactttggagaccacattccctgcacacggtctttgagagagcagttgcactctacaggcacacttctgaggtacggtatctctctccagccactctgataccaagtaattcaagctggcattccttctattagggaaattcattttacccaatttgcatttatggaattgatcatttaagacactaaattagtttttagaaccaattatgggaagaattccagttgttaggaagagatgaggagttggaagaggagggattagaaacaggaggaggcagtcatcctctccttgccaaaagatttaaacctgtccacattggtggtgatgatgggtgagtttccatggtaacacatccctaattttaccagggaagaggagagtactcactttaccatctttgaatatatttcatagaaatctagctctctgtaccctgaaatcttccactagcctcacttttcaacagagtcatctagaagggagggttggcttcccaaaagcataaccttgaccaaaccaaacaataggcaccagcaatgctgtcattcagttatgcagaagctcatttgtgaaattctgtttctctgatttcttcgcaagtctcttaatggtcatttgtgttagattacatcaaactgatggatagccattggtattcatctattttaactctgtgtctttacatatttgtttatgatggccacagcctaaagtacacacggctgtgacttgattcaaaagaaaatgttataagatgcagtaaactaataacagaattattaaaatatatcaggcta

SEQ ID NO: 8066 - DNA, 606 bp, Homo sapiens
atggggctgccccagccagggctgtggctgaagaggctctgggtgctcttggaggtggctgtgcatgtggtcgtgggtaaagtgcttctgatattgtttccagacagagtcaagcggaacatcctggccatgggcgagaagacgggtatgaccaggaacccccatttcagccacgacaactggataccaacctttttcagcacccagtatttctggttcgtcttgaaggtccgttggcagcgactagaggacacgactgagctagggggtctggccccaaactgcccggtggtccgcctctcaggacagaggtgcaacatttgggagtttatgcaagatggctgggcttttaagaacaacatggacatcagaaatcaccagaaccttcaggatcgcctgcaggcagcccatctactgctggccaggagcccccagtgccctgtggtggtggacaccatgcagaaccagagcagccagctctacgcagcactgcctgagaggctctacataatccaggagggcaggatcctctacaagggtaaatctggcccttggaactacaacccagaggaagttcgtgctgttctggaaaagctccacagttaa

SEQ ID NO: 8067 - DNA, 626 bp, Homo sapiens
atggggctgccccagccagggctgtggctgaagaggctctgggtgctcttggaggtggctgtgcatgtggtcgtggcacccagtatttctggttcgtcttgaaggtccgttggcagcgactagaggacacgactgagctagggggtctggccccaaactgcccggtggtccgcctctcaggacagaggtgcaacatttgggagtttatgcaaggtaataggccactggtgctgaattttggaagttgtacctgaccttcatttatgttcaaatttgaccagttcaagaggcttattgaagactttagttccatagcagattttcttgtcatttacattgaagaagcacatgcatcagatggctgggcttttaagaacaacatggacatcagaaatcaccagaaccttcaggatcgcctgcaggcagcccatctactgctggccaggagcccccagtgccctgtggtggtggacaccatgcagaaccagagcagccagctctacgcagcactgcctgagaggctctacataatccaggagggcaggatcctctacaagggtaaatctggcccttggaactacaacccagaggaagttcgtgctgttctggaaaagctccacagttaa

SEQ ID NO: 8068 - DNA, 558 bp, Homo sapiens
atggggctgccccagccagggctgtggctgaagaggctctgggtgctcttggaggtggctgtgcatgtggtcgtgggtaaagtgcttctgatattgtttccagacagagtcaagcggaacatcctggccatgggcgagaagacgggtaataggccactggtgctgaattttggaagttgtacctgaccttcatttatgttcaaatttgaccagttcaagaggcttattgaagactttagttccatagcagattttcttgtcatttacattgaagaagcacatgcatcagatggctgggcttttaagaacaacatggacatcagaaatcaccagaaccttcaggatcgcctgcaggcagcccatctactgctggccaggagcccccagtgccctgtggtggtggacaccatgcagaaccagagcagccagctctacgcagcactgcctgagaggctctacataatccaggagggcaggatcctctacaagggtaaatctggcccttggaactacaacccagaggaagttcgtgctgttctggaaaagctccacagttaa

SEQ ID NO: 8069 - DNA, 406 bp, Homo sapiens
atggggctgccccagccagggctgtggctgaagaggctctgggtgctcttggaggtggctgtgcatgtggtcgtgggtaaagtgcttctgatattgtttccagacagagtcaagcggaacatcctggccatgggcgagaagacgggtatgaccaggaacccccatttcagccacgacaactggataccaacctttttcagcacccagtatttctggttcgtcttgaaggtccgttggcagcgactagaggacacgactgagctagggggtctggccccaaactgcccggtggtccgcctctcaggacagaggtgcaacatttgggagtttatgcaagggtaaatctggcccttggaactacaacccagaggaagttcgtgctgttctggaaaagctccacagttaa

SEQ ID NO: 8070 - DNA, 1049 bp, Homo sapiens
aagggaactgactcaggaggcagagaagatgggcatcctcagcgtagacttgctgatcacactgcaaattctgccagtttttttctccaactgcctcttcctggctctctatgactcggtcattctgctcaagcacgtggtgctgctgttgagccgctccaagtccactcgcggagagtggcggcgcatgctgacctcagagggactgcgctgcgtctggaagagcttcctcctcgatgcctacaaacagctaaattgtcctccatcaggttttagcaaagatggacacattttatgactagtatatgaagcttataaaagcagactactggtctactcacatttggatttatggatggtgaaattgggtgaggatgcccccaattccagtgtggtgcatgtctccagtacagaaggaggtgacaacagtggcaatggtacccaggagaagatagctgagggagccacatgccaccttcttgactttgccagccctgagcgcccactagtggtcaactttggctcagccacttgacctcctttcacgagccagctgccagccttccgcaaactggtggaagagttctcctcagtggctgacttcctgctggtctacattgatgaggctcatccatcagatggctgggcgataccgggggactcctctttgtcttttgaggtgaagaagcaccagaaccaggaagatcgatgtgcagcagcccagcagcttctggagcgtttctccttgccgccccagtgccgagttgtggctgaccgcatggacaataacgccaacatagcttacggggtagcctttgaacgtgtgtgcattgtgcagagacagaaaattgcttatctgggaggaaagggccccttctcctacaaccttcaagaagtccggcattggctggagaagaatttcagcaagagatgaaagaaaactagattagctggttaaaggtatgattataagagagcttattgttttaaaaagttatataaaggcaaggaaattaagaactgaatccatatttcaacagagccctatt

SEQ ID NO: 8071 - DNA, 1462 bp, Homo sapiens
tcttaccagtaggtagcctggaaaaaaaagagaagcaacagttcctgagggaagaatgcattaacaactcggatgggtgctgtctgccagcactgcagaggaacctacggagagggctgctgggagagaatgctcatacctcccaaggcgtcagcctgccctcccgcccccaagttgctttgctcaagagggtgaaggggaaccagagcgcacaagggaactgactcaggaggcagagaagatgggcatcctcagcgtagacttgctgatcacactgcaaattctgccagtttttttctccaactgcctcttcctggctctctatgactcggtcattctgctcaagcacgtggtgctgctgttgagccgctccaagtccactcgcggagagtggcggcgcatgctgacctcagagggactgcgctgcgtctggaagagcttcctcctcgatgcctacaaacaggtgaaattgggtgaggatgcccccaattccagtgtggtgcatgtctccagtacagaaggaggtgacaacagtggcaatggtacccaggagaagatagctgagggagccacatgccaccttcttgactttgccagccctgagcgcccactagtggtcaactttggctcagccacttgacctcctttcacgagccagctgccagccttccgcaaactggtggaagagttctcctcagtggctgacttcctgctggtctacattgatgaggctcatccatcagatggctgggcgataccgggggactcctctttgtcttttgaggtgaagaagcaccagaaccaggaagatcgatgtgcagcagcccagcagcttctggagcgtttctccttgccgccccagtgccgagttgtggctgaccgcatggacaataacgccaacatagcttacggggtagcctttgaacgtgtgtgcattgtgcagagacagaaaattgcttatctgggaggaaagggccccttctcctacaaccttcaagaagtccggcattggctggagaagaatttcagcaagagatgaaagaaaactagattagctggttaaaggtatgattataagagagcttattgttttaaaaagttatataaaggcaaggaaattaagaactgaatccatatttcaacagagccctattggcttactgaaagacaggagtttatctatcggaagaacatgaatctctaacagctccatacttctttcactactcaaatggcattgggctgagtaagtaaccatatcacctctcttcttagtaaaaagccctatgtgaaaagatcccaagatggagaggaagaaacgctaattcagcatgtgttcattctgcattgagaaggaactgatacatctgatgcatgctttgagaccagaagaaaagacttacctgaataattactacattagggaagctactgtctacgttaagataaagggtattgcctt

SEQ ID NO: 8072 - DNA, 6136 bp, Homo sapiens
gggcttccttttaatttagttttttttccccttctcccccaacccccaaccttcccccttacctcccccaccccctttatcaccaccccccttttaaataagagggtgaaggggaaccagagcgcacaagggaactgactcaggaggcagagaagatgggcatcctcagcgtagacttgctgatcacactgcaaattctgccagtttttttctccaactgcctcttcctggctctctatgactcggtcattctgctcaagcacgtggtgctgctgttgagccgctccaagtccactcgcggagagtggcggcgcatgctgacctcagagggactgcgctgcgtctggaagagcttcctcctcgatgcctacaaacaggtgaaattgggtgaggatgcccccaattccagtgtggtgcatgtctccagtacagaaggaggtgacaacagtggcaatggtacccaggagaagatagctgagggagccacatgccaccttcttgactttgccagccctgagcgcccactagtggtcaactttggctcagccacttgacctcctttcacgagccagctgccagccttccgcaaactggtggaagagttctcctcagtggctgacttcctgctggtctacattgatgaggctcatccatcagatggctgggcgataccgggggactcctctttgtcttttgaggtgaagaagcaccagaaccaggaagatcgatgtgcagcagcccagcagcttctggagcgtttctccttgccgccccagtgccgagttgtggctgaccgcatggacaataacgccaacatagcttacggggtagcctttgaacgtgtgtgcattgtgcagagacagaaaattgcttatctgggaggaaagggccccttctcctacaaccttcaagaagtccggcattggctggagaagaatttcagcaagagatgaaagaaaactagattagctggttaaaggtatgattataagagagcttattgttttaaaaagttatataaaggcaaggaaattaagaactgaatccatatttcaacagagccctattggcttactgaaagacaggagtttatctatcggaagaacatgaatctctaacagctccatacttctttcactactcaaatggcattgggctgagtaagtaaccatatcacctctcttcttagtaaaaagccctatgtgaaaagatcccaagatggagaggaagaaacgctaattcagcatgtgttcattctgcattgagaaggaactgatacatctgatgcatgctttgagaccagaagaaaagacttacctgaataattactacattagggaagctactgtctacgttaagataaagggtattgccttggctctatttggcatggatggagcccagttggaaaattcccaaatattacaacaagtccttgaacccaggccatgtggttagacgttggtgttaaggttagaccttatgttagagtcatttctgatgttccagcttctagccatgtagtgctctcagtcttcataccccagaaattattggtatatttgtagataccgagaatgatccctcagtctgagaggttagaatgatcatctgtaatctgagggttaatttctaggcaggtggagagagtggtaaaaaagaaatgaaattgacaagctaggaaagaggaggcagaaagatttggaaaattcacagagtttcacccttaagctgtagagagtgggtcacatttgttagccacggaaacatagaaacatacacaaggccagaaaaagaagaaggagctcaactaaaagtggcatagagaatacacatataaaaacaatatatttgtcatatgctcctagagaggagaaaggggtgattgaaagaaaaaaaaatacttaaatatttgtaattgtgaggggtttcttttggaaataattacttttgaaccatgtatgtggtatgtatattttcagtgggttaattataccccatgatacctattaaaggaaaaccagtgggtctggtggtgctggtcttttcctccccattcctacaatttctatgtggcccaagtcattcctaatcttggtctctatagcagtgttctctctgaatgctgagctgaagaaattatacgtacatacacacatacatacatacatacaaatatatgtatatatattctcagctgctgcgggaggtaggtaccatggccattcagcacagccttgatttcctcccaaagtaggtgagctatagtgaagaataggtgcaaacaaacaagcttacttccattgcaaaatagaagaagaggaagttagagataattctgatcaatcattttggaggctttgttataaggcaacccccggtatatcatggaatttccattgacatttgaatttggacttggatcttcccttggtcccattagctgaggtttagtaatctaaagtccctatagtatatgattataatgctattttaaaaaatatatatataaaatatttttttctttttaaaatagacactatagttttacccataagtaatatttaaagattatagctcccaaaagaatggaccaaccactttcgtatcataatttctttttggtaaatatgagactattatgaaatcatagtatatgattgtatttaaaggtacaatcaaaggatcttttgtccattccattaataactgaataaaaaataaataaaatggatagaaaaaaactaaagttgaaaatacattcttaaactagttgtctgaattgagaaaagagtgagaactaggtgtgcaagaaccaaacgtattttattttattttttaaatgggagcaacatatcagtcgtgtcaccagctggtatattgtgtaaatattaaagctccattgggactgatttttcatggcaacatcagctttctaatgttctaaattctataaaaaccacccacaaagaaacaaagcaaatttcattatctaatgagttgctggaaaatcatattgagaataattatttcagattcctcagttgttaacttctacattcaaggcttatctctgcccccattgatttttaacctcaaaatggtgttgagatttacgtggaaccctaaagcagtaaaataaaaaacctggttgcagcacattcacactgttgtccttaaaattccccttttttctctatgtacgataaagtaacagtatgtcagataagccggtggggggatgagattaggctgaggcagtgctagtcaactggggaaaaggatgatggaaaaatcacccagttgtgctatatttttaaagaaggaggtcgtttatgtgtgcagacaattctccctgaggttagcccaatggagaaatgaagcagaggaaggaaacatagaaagacatgggctatcagggaggaagatgttcaatagaacatgcaagaatttctggaagaaaggctgtggaagggccaatggagaaaatgaatggacaaagctcaggaatcctacgctatgtagaatgtcttggtgttatcagggttaagcctgtaattatgtaacctatttatcgcaacatgaatttttatgatttcttgtgatgtattcttttatgaaattaacaagaactcattattttgaggtagaggaaaatcaatgctttatctgatatgctgagaaattattagattgccaatactcatgtgcgtttcatgtgttttataaggtttgttcctttgaagaattgtagttcttagtcccacagggaaatgtgtatctatttatatatcatagtataaatctatgatatatttatatcatatataaaagtctgagttctctttcttagtccctaatcatgtttctcccataggctgtgtttacatggagctatcggtttagccttttaagcttcattagcttgtctattattgaaatagtttccaagaaattttagatattatcataacatctgggtctactcaaacacttattgtttgaaagacttatgtcttggacctatcaaaaactgactttatttattgcttagtgaaaatactagtgggatcaacaatgattttcttgaatgggcatgaatggagatgcccgcacagtaatgtagaaatgtttcatacagctattaaaatgtaactgacctccttagaggcagattagtaactgttcctactttgtatagctaagtgacagtcacttaacttacatgactttcttttttcacattgggtctctggtcctgtgtcttcacctcatttatagcacgtctccttgatttttggtagtatcaacttcccagtgatctgttcagttaagttcttctcccgttaaccaggaagtgcttattctctcatcacagtgggaagaatagcctattgtctttcattttgcctgagtgtattttactatttgggctctgaaataaaaattatgaaatatggtgaggtcacatgttggtgctgccttgctgcataaaattctagagggcaggttagagacagtatgtatgccttcgggaaaattcaaaggtggattacaaggtgtcctcagcatgccctatggcctatgtgcgaagcaagaagaattgactgatttacaggacttctctttatgtcaatcttaagaggatggatgaatctggacatttgttccacccgacctctgactgatggtttggaaaataactttaattaggatcatatgaccattgaaaaaggaaaaatgtagactctgacttccgtcccactgaaggattaatgaaaacctttactagcatttagagcttttcagaacatccccactgtcatgtgtctcagcagtggagactgcaagtaaggcttttaattttaggaggtttttttttttttttttttttccctaaatggtatggccaaaagtcagagttaaaatatatatagttagattccaacttcctccttcactctaaaaatagaatccaaacccactcttcatatatgcttccagaatggggcttaagtaccaatctctgctttgcaatgggcacaatcttggtcatgtcctgaggctctctaagaaaagagaggatctaggatgggagagctagaaagttgctaactgggaagaacaaggccctgagggcttggtctaccaatctgggaagatttgaaaacaaacttctcgcaactgaaggaaggctgaaggctgctgcaagtcattgagtgactttaggatgagcaaaacattgggccacttcctaatgccctatgtgtatagtaccagaagcaaggtctcagacttaacagacccagctctgttccaaggtgagtctgaaccaatagaaagcaaacatgtgcagatatccaaacaagactgctcatgcaagtcggggctggctacccgtcttaggcagcaacagcagagctccagggagcttattcaatatttactgagacttcgaagacccagcagatgtttaatgaagtcactattttggctcaaaccctccacttctccccctcccctcaaaaagccaacaggtaaacacataaatgaaagaaacccacagaaggggatgggaaataaagaaaattctctcaagacttctccaggcccatgtcactggtcagcgtggtttttatgtgtattaggattgggggatgtgaagaaataagtatccagtactttataaccaaagcaattaaatgatattgggtagggaatgttggccagttttgtttagttttgcatcacattgtcaccagactcactagcccaagtaatcgggcgcccgaagagggagacagagatgtgcagagttgaccagtgtgcggatgataactactgacgaaagagtcatcgactcagttagtggttggatgtagtcacattagtttgcctctccccatctttgtctccctggcaaggagaatatgcgggacatgatgctaagagtcctgggtaaatgtggtgagaatgcacgcgtgcatatgctacacatatgtgcttctcagttgcagaaaatgaactgctttgggagattatcagtagaaagagtgttatcatattggtgctgagtgctatgtgtgcttatacaatttgttcttgtattttaataaactttgaataaaagaataaa

SEQ ID NO: 8073 - DNA, 491 bp, Homo sapiens
gaggagcagctggttgatccaggagagacagggaggcgctgagatgagatgagctctctcccttatgtggagaagtccttttaggaatctgccatgtttaaatgactttggacttgggccggaactacacatcagctctcctgggcctctagcttgccaactacggacactgtgacttttcagccatcacaattgttatttagggagaaagaagagattgagtcacagtttcagaaaagaaagggtagcctggaaaaaaaagagaagcaacagttcctgagggaagaatgcattaacaactcggatgggtgctgtctgccagcactgcagaggaacctacggagagggctgctgggagagaatgctcatacctcccaaggcgtcagcctgccctcccgcccccaagttgctttgctcaagagggtgaaggggaaccagagcgcacaagggaactgactcaggaggcagagaagatgggcatcctcagcgta

SEQ ID NO: 8074 - DNA, 417 bp, Homo sapiens
gcagagagaggcactttgcaccacagacagatagcaagaagggaaagacagagagtgagaaaaaagaggagtcagtcgctcctggggaagggagagagtgagactgggagaaagagaagcacagaaagtgtgtgtaaaacggagtaaagaaagaaaaaaaaaaaactacccttaaagcacatttaaaaaaaaaaaaaactctggcaattcaagaaagaaacaggctacgtttaaagagcatagagacaatgaaaggctaaagaaaattttaaaatctctgccacagtctcataggtgcttggaaatgaaagtagaactgcctgtctttaacggactctgacagagagggtgaaggggaaccagagcgcacaagggaactgactcaggaggcagagaagatgggcatcctcagcgtag

SEQ ID NO: 8075 - DNA, 569 bp, Homo sapiens
aaagtgcttgcaattgcatagagcaaagagcatgctgaacagtgatgttccagtttaaaaggacagagctgcaaacaaaggactttggacttgggccggaactacacatcagctctcctgggcctctagcttgccaactacggacactgtgacttttcagccatcacaattgttaggtagcctggaaaaaaaagagaagcaacagttcctgagggaagaatgcattaacaactcggatgggtgctgtctgccagcactgcagaggaacctacggagagggctgctgggagagaatgctcatacctcccaaggcgtcagcctgccctcccgcccccaagttgctttgctcaagagggtgaaggggaaccagagcgcacaagggaactgactcaggaggcagagaagatgggcatcctcagcgtagacttgctgatcacactgcaaattctgccagtttttttctccaactgcctcttcctggctctctatgactcggtcattctgctcaagcacgtggtgctgctgttgagccgctccaagtccactcgcggagagtggcggcgcatgct

SEQ ID NO: 8076 - DNA, 1049 bp, Homo sapiens; identical to SEQ ID NO: 8070

SEQ ID NO: 8077 - DNA, 6367 bp, Homo sapiens
agactggtctagcctcccagcctacatctttcttcagtgctggatgcttcctgccctcaaacatcggactccaagttcttcagttttgagactcagactgactgtccttgctcctcaagcttgcagacagcctattgtgggacgttgtgatcattaggtagcctggaaaaaaaagagaagcaacagttcctgagggaagaatgcattaacaactcggatgggtgctgtctgccagcactgcagaggaacctacggagagggctgctgggagagaatgctcatacctcccaaggcgtcagcctgccctcccgcccccaagttgctttgctcaagagggtgaaggggaaccagagcgcacaagggaactgactcaggaggcagagaagatgggcatcctcagcgtagacttgctgatcacactgcaaattctgccagtttttttctccaactgcctcttcctggctctctatgactcggtcattctgctcaagcacgtggtgctgctgttgagccgctccaagtccactcgcggagagtggcggcgcatgctgacctcagagggactgcgctgcgtctggaagagcttcctcctcgatgcctacaaacaggtgaaattgggtgaggatgcccccaattccagtgtggtgcatgtctccagtacagaaggaggtgacaacagtggcaatggtacccaggagaagatagctgagggagccacatgccaccttcttgactttgccagccctgagcgcccactagtggtcaactttggctcagccacttgacctcctttcacgagccagctgccagccttccgcaaactggtggaagagttctcctcagtggctgacttcctgctggtctacattgatgaggctcatccatcagatggctgggcgataccgggggactcctctttgtcttttgaggtgaagaagcaccagaaccaggaagatcgatgtgcagcagcccagcagcttctggagcgtttctccttgccgccccagtgccgagttgtggctgaccgcatggacaataacgccaacatagcttacggggtagcctttgaacgtgtgtgcattgtgcagagacagaaaattgcttatctgggaggaaagggccccttctcctacaaccttcaagaagtccggcattggctggagaagaatttcagcaagagatgaaagaaaactagattagctggttaaaggtatgattataagagagcttattgttttaaaaagttatataaaggcaaggaaattaagaactgaatccatatttcaacagagccctattggcttactgaaagacaggagtttatctatcggaagaacatgaatctctaacagctccatacttctttcactactcaaatggcattgggctgagtaagtaaccatatcacctctcttcttagtaaaaagccctatgtgaaaagatcccaagatggagaggaagaaacgctaattcagcatgtgttcattctgcattgagaaggaactgatacatctgatgcatgctttgagaccagaagaaaagacttacctgaataattactacattagggaagctactgtctacgttaagataaagggtattgccttggctctatttggcatggatggagcccagttggaaaattcccaaatattacaacaagtccttgaacccaggccatgtggttagacgttggtgttaaggttagaccttatgttagagtcatttctgatgttccagcttctagccatgtagtgctctcagtcttcataccccagaaattattggtatatttgtagataccgagaatgatccctcagtctgagaggttagaatgatcatctgtaatctgagggttaatttctaggcaggtggagagagtggtaaaaaagaaatgaaattgacaagctaggaaagaggaggcagaaagatttggaaaattcacagagtttcacccttaagctgtagagagtgggtcacatttgttagccacggaaacatagaaacatacacaaggccagaaaaagaagaaggagctcaactaaaagtggcatagagaatacacatataaaaacaatatatttgtcatatgctcctagagaggagaaaggggtgattgaaagaaaaaaaaatacttaaatatttgtaattgtgaggggtttcttttggaaataattacttttgaaccatgtatgtggtatgtatattttcagtgggttaattataccccatgatacctattaaaggaaaaccagtgggtctggtggtgctggtcttttcctccccattcctacaatttctatgtggcccaagtcattcctaatcttggtctctatagcagtgttctctctgaatgctgagctgaagaaattatacgtacatacacacatacatacatacatacaaatatatgtatatatattctcagctgctgcgggaggtaggtaccatggccattcagcacagccttgatttcctcccaaagtaggtgagctatagtgaagaataggtgcaaacaaacaagcttacttccattgcaaaatagaagaagaggaagttagagataattctgatcaatcattttggaggctttgttataaggcaacccccggtatatcatggaatttccattgacatttgaatttggacttggatcttcccttggtcccattagctgaggtttagtaatctaaagtccctatagtatatgattataatgctattttaaaaaatatatatataaaatatttttttctttttaaaatagacactatagttttacccataagtaatatttaaagattatagctcccaaaagaatggaccaaccactttcgtatcataatttctttttggtaaatatgagactattatgaaatcatagtatatgattgtatttaaaggtacaatcaaaggatcttttgtccattccattaataactgaataaaaaataaataaaatggatagaaaaaaactaaagttgaaaatacattcttaaactagttgtctgaattgagaaaagagtgagaactaggtgtgcaagaaccaaacgtattttattttattttttaaatgggagcaacatatcagtcgtgtcaccagctggtatattgtgtaaatattaaagctccattgggactgatttttcatggcaacatcagctttctaatgttctaaattctataaaaaccacccacaaagaaacaaagcaaatttcattatctaatgagttgctggaaaatcatattgagaataattatttcagattcctcagttgttaacttctacattcaaggcttatctctgcccccattgatttttaacctcaaaatggtgttgagatttacgtggaaccctaaagcagtaaaataaaaaacctggttgcagcacattcacactgttgtccttaaaattccccttttttctctatgtacgataaagtaacagtatgtcagataagccggtggggggatgagattaggctgaggcagtgctagtcaactggggaaaaggatgatggaaaaatcacccagttgtgctatatttttaaagaaggaggtcgtttatgtgtgcagacaattctccctgaggttagcccaatggagaaatgaagcagaggaaggaaacatagaaagacatgggctatcagggaggaagatgttcaatagaacatgcaagaatttctggaagaaaggctgtggaagggccaatggagaaaatgaatggacaaagctcaggaatcctacgctatgtagaatgtcttggtgttatcagggttaagcctgtaattatgtaacctatttatcgcaacatgaatttttatgatttcttgtgatgtattcttttatgaaattaacaagaactcattattttgaggtagaggaaaatcaatgctttatctgatatgctgagaaattattagattgccaatactcatgtgcgtttcatgtgttttataaggtttgttcctttgaagaattgtagttcttagtcccacagggaaatgtgtatctatttatatatcatagtataaatctatgatatatttatatcatatataaaagtctgagttctctttcttagtccctaatcatgtttctcccataggctgtgtttacatggagctatcggtttagccttttaagcttcattagcttgtctattattgaaatagtttccaagaaattttagatattatcataacatctgggtctactcaaacacttattgtttgaaagacttatgtcttggacctatcaaaaactgactttatttattgcttagtgaaaatactagtgggatcaacaatgattttcttgaatgggcatgaatggagatgcccgcacagtaatgtagaaatgtttcatacagctattaaaatgtaactgacctccttagaggcagattagtaactgttcctactttgtatagctaagtgacagtcacttaacttacatgactttcttttttcacattgggtctctggtcctgtgtcttcacctcatttatagcacgtctccttgatttttggtagtatcaacttcccagtgatctgttcagttaagttcttctcccgttaaccaggaagtgcttattctctcatcacagtgggaagaatagcctattgtctttcattttgcctgagtgtattttactatttgggctctgaaataaaaattatgaaatatggtgaggtcacatgttggtgctgccttgctgcataaaattctagagggcaggttagagacagtatgtatgccttcgggaaaattcaaaggtggattacaaggtgtcctcagcatgccctatggcctatgtgcgaagcaagaagaattgactgatttacaggacttctctttatgtcaatcttaagaggatggatgaatctggacatttgttccacccgacctctgactgatggtttggaaaataactttaattaggatcatatgaccattgaaaaaggaaaaatgtagactctgacttccgtcccactgaaggattaatgaaaacctttactagcatttagagcttttcagaacatccccactgtcatgtgtctcagcagtggagactgcaagtaaggcttttaattttaggaggtttttttttttttttttttttccctaaatggtatggccaaaagtcagagttaaaatatatatagttagattccaacttcctccttcactctaaaaatagaatccaaacccactcttcatatatgcttccagaatggggcttaagtaccaatctctgctttgcaatgggcacaatcttggtcatgtcctgaggctctctaagaaaagagaggatctaggatgggagagctagaaagttgctaactgggaagaacaaggccctgagggcttggtctaccaatctgggaagatttgaaaacaaacttctcgcaactgaaggaaggctgaaggctgctgcaagtcattgagtgactttaggatgagcaaaacattgggccacttcctaatgccctatgtgtatagtaccagaagcaaggtctcagacttaacagacccagctctgttccaaggtgagtctgaaccaatagaaagcaaacatgtgcagatatccaaacaagactgctcatgcaagtcggggctggctacccgtcttaggcagcaacagcagagctccagggagcttattcaatatttactgagacttcgaagacccagcagatgtttaatgaagtcactattttggctcaaaccctccacttctccccctcccctcaaaaagccaacaggtaaacacataaatgaaagaaacccacagaaggggatgggaaataaagaaaattctctcaagacttctccaggcccatgtcactggtcagcgtggtttttatgtgtattaggattgggggatgtgaagaaataagtatccagtactttataaccaaagcaattaaatgatattgggtagggaatgttggccagttttgtttagttttgcatcacattgtcaccagactcactagcccaagtaatcgggcgcccgaagagggagacagagatgtgcagagttgaccagtgtgcggatgataactactgacgaaagagtcatcgactcagttagtggttggatgtagtcacattagtttgcctctccccatctttgtctccctggcaaggagaatatgcgggacatgatgctaagagtcctgggtaaatgtggtgagaatgcacgcgtgcatatgctacacatatgtgcttctcagttgcagaaaatgaactgctttgggagattatcagtagaaagagtgttatcatattggtgctgagtgctatgtgtgcttatacaatttgttcttgtattttaataaactttgaataaaagaataaa

SEQ ID NO: 8078 - DNA, 915 bp, Homo sapiens
atgcctcgccaggccacgtcgcggttggtggtcggagagggcgaggggtcccagggggcttcggggcctgcagccaccatgctccgctccctgctgcttcactccttgaggctctgcgcccagaccgcctcgtgcctcgtgctcttcccgcgcttcctcggcacggccttcatgctctggcttctcgatttcttgtgtatccgcaagcatttcctgggccgccgccgccgggggcagcccgagcccgaagtggagctcaacagtgaaggcgaggaggtgcctcccgatgacccgcccatctgcgtgtccgacgacaaccgcctgtgcaccctggcgtcgctcaaggcggtgtggcatggccagaagttggatttcttcaagcaggcgcacgagggcggtccggcgcccaactccgaggtggttctgcccgacggcttccagagccagcacatcctcgactacgcgcaagggaaccgcccgctggttctcaatttcggcagctgcacctgaccaccgttcatggcgcgcatgagcgccttccagcgcctggtcactaagtaccagcgcgacgtcgacttcctcatcatctacatcgaggaagcgcacccctccgacggctgggtcaccacggactctccctacatcatcccacagcaccggagcctggaggaccgggtcagcgcagcgagggtactgcagcaaggtgcacccggctgcgctctggtcctcgacaccatggccaactccagcagctcggcctatggcgcctacttcgagcgtctctatgtcatccagagtggcactattatgtaccagggcggccgtggccccgacggctaccaggtctctgagctgcgcacttggttggaacgctatgatgagcaactgcacggcgctcggccccggagggtgtaa

SEQ ID NO: 8079 - DNA, 1441 bp, Homo sapiens
attttgaaaatcttgttgattctggggagccgagcgcgcggcgcgagcgtcacgccagacagcggcccgcgcgccttctcctcggcgtcggccgccgccgcctcccagaacctcctcgtgccctcgcgtgccaggcccgcggcggccgaaatccgcggttcacagcatgtccgcctcggcccctgctgcggagggggagggaacccccacccagcccgcgtccgagaaagaacccgaaatgcccggtcccagagaggagagcgaggaggaagaggacgaggacgacgaggaggaggaggaggaggaaaaaggaaaggggcagaaactttgtgaaattgagaggatacatttttttctaagtaagaagaaaaccgatgaacttagaaatctacacaaactgctttacaacaggccaggcactgtgtcctcattaaagaagaatgtgggtcagttcagtggctttccatttgaaaaaggaagtgtccaatataaaaagaaggaagaaatgttgaaaaaatttagaaatgccatgttaaagagcatctgtgaggttcttgatttggagagatcaggtgtaaatagtgaactagtgaagaggatcttgaatttcttaatgcatccaaagccttctggcaaaccattgccgaaatctaaaaaaacttgtagcaaaggcagtaaaaaggaacggaacagttctggaatggcaaggaaggctaagcgaaccaaatgtcctgaaattctgtcagatgaatctagtagtgatgaagatgaaaagaaaaacaaggaagagtcttcagatgatgaagataaagaaagtgaagaggagccaccaaaaaagacagccaaaagagaaaaacctaaacagaaagctacttctaaaagtaaaaaatctgtgaaaagtgccaatgttaagaaagcagatagcagcaccaccaagaagaatcaaaacagttccaaaaaagaaagtgagtctgaggatagttcagatgatgaacctttaattaaaaagttgaagaaaccccctacagatgaagagttaaaggaaacaataaagaaattactggccagtgctaacttggaagaagtcacaatgaaacagatttgcaaaaaggtctatgaaaattatcctacttatgatttaactgaaagaaaagatttcataaaaacaactgtaaaagagctaatttcttgagatagaggacagagaagatgactcgttcccatagatttgaagatctgatttataccattataccagcaaagagaatgtatttccttttctaaatccttgttaagcaacgttagtagaacttactgctgacctttttatcttgagtgttatgtgaatttgagtttgctgttttaaattgcatttctatgccatttttagtttaaaatcttgcatggcattaattgttccttgcttttatagttgtatttt

SEQ ID NO: 8080 - DNA, 3427 bp, Homo sapiens
tccgcgctgccaggccgcctcgcctcccgctcccgcccgccccgcgggacacagcccgcccgcactccggggcccgagcgccgaccacactccaggcgcagccggggagagccccgcgcgcgcatccctccgcccgcggccgaggcgacccctcgcggtcccgcccgcccgagcttcccgcggaggcacccggccgccccgcctcccccgccccgcgcccgccaactcccagctcgcggccctgattggtcgccgcattcccgctctccttcccgaaccgccattttgaaaatcttgttgattctggggagccgagcgcgcggcgcgagcgtcacgccagacagcggcccgcgcgccttctcctcggcgtcggccgccgccgcctcccagaacctcctcgtgccctcgcgtgccaggcccgcggcggccgaaatccgcggttcacagcatgtccgcctcggcccctgctgcggagggggagggaacccccacccagcccgcgtccgagaaagaacccgaaatgcccggtcccagagaggagagcgaggaggaagaggacgaggacgacgaggaggaggaggaggaggaaaaagaaaagagtctcatcgtggaaggcaagagggaaaagaaaaaagtagagaggttgacaatgcaagtctcttccttacagagagagccatttacaattgcacaaggaaaggggcagaaactttgtgaaattgagaggatacatttttttctaagtaagaagaaaaccgatgaacttagaaatctacacaaactgctttacaacaggccaggcactgtgtcctcattaaagaagaatgtgggtcagttcagtggctttccatttgaaaaaggaagtgtccaatataaaaagaaggaagaaatgttgaaaaaatttagaaatgccatgttaaagagcatctgtgaggttcttgatttggagagatcaggtgtaaatagtgaactagtgaagaggatcttgaatttcttaatgcatccaaagccttctggcaaaccattgccgaaatctaaaaaaacttgtagcaaaggcagtaaaaaggaacggaacagttctggaatggcaaggaaggctaagcgaaccaaatgtcctgaaattctgtcagatgaatctagtagtgatgaagatgaaaagaaaaacaaggaagagtcttcagatgatgaagataaagaaagtgaagaggagccaccaaaaaagacagccaaaagagaaaaacctaaacagaaagctacttctaaaagtaaaaaatctgtgaaaagtgccaatgttaagaaagcagatagcagcaccaccaagaagaatcaaaacagttccaaaaaagaaagtgagtctgaggatagttcagatgatgaacctttaattaaaaagttgaagaaaccccctacagatgaagagttaaaggaaacaataaagaaattactggccagtgctaacttggaagaagtcacaatgaaacagatttgcaaaaaggtctatgaaaattatcctacttatgatttaactgaaagaaaagatttcataaaaacaactgtaaaagagctaatttcttgagatagaggacagagaagatgactcgttcccatagatttgaagatctgatttataccattataccagcaaagagaatgtatttccttttctaaatccttgttaagcaacgttagtagaacttactgctgacctttttatcttgagtgttatgtgaatttgagtttgctgttttaaattgcatttctatgccatttttagtttaaaatcttgcatggcattaattgttccttgcttttatagttgtattttgtacattttggatttctttatataaggtcatagattcttgagctgttgtggtttttagtgcacttaatattagcttgcttaaggcatacttttaatcaagtagaacaaaaactattatcaccaggatttatacatacagagattgtagtatttagtatatgaaatattttgaatacacatctctgtcagtgtgaaaattcagcggcagtgtgtccatcatattaaaaatatacaagctacagttgtccagatcactgaattggaacttttctcctgcatgtgtatatatgtcaaattgtcagcatgacaaaagtgacagatgttatttttgtatttttaaaaaacaattggttgtatataaagtttttttatttcttttgtgcagatcactttttaaactcacataggtaggtatctttatagttgtagactatggaatgtcagtgttcagccaaacagtatgatggaacagtgaaagtcaattcagtgatggcaacactgaaggaacagttaccctgctttgcctcgaaagtgtcatcaatttgtaattttagtattaactctgtaaaagtgtctgtaggtacgttttatattatataaggacagaccaaaaatcaacctatcaaagcttcaaaaactttgggaaagggtgggattaagtacaagcacatttggcttacagtaaatgaactgatttttattaactgcttttgcccatataaaatgctgatatttactggaaacctagccagcttcacgattatgactaaagtaccagattataatgccagaatataatgtgcaggcaatcgtggatgtctctgacaaagtgtgtctcaaaaataatatacttttacattaaagaaatttaatgtttctctggagttggggctcttggctttcagagtttggttaatcagtgttgattctagatgatcaacataatggaccactcctgaatgagacttaattttgtctttcaaatttactgtcttaaatcagtttattaaatctgaattttaaaacatgctgtttatgacacaatgacacatttgttgcaccaattaagtgttgaaaaatatctttgcatcatagaacagaaatatataaaaatatatgttgaatgttaacaggtattttcacaggtttgtttcttgatagttactcagacactagggaaaggtaaatacaagtgaacaaaataagcaactaaatgagacctaataattggccttcgattttaaatatttgttcttataaaccttgtcaataaaaataaatctaaatcactggtgttttaagtcacttgcatttgatatcttataggtgtatatagcatttccttatggggaataattctgaaaagggatttttaaattgattcagccctataacctatacaatttggaatactcttttgtggtaatggaccattttcttggagtgacttcacaaaactgaataattaaggttaattttatgaccatttgctataaagaaggtaagtagtcatgcatagagtatttggaagtgaggaaatggagttgttctgtatgaaagttcttgatgagtacgcacacttattaaatggatgtatcacca

SEQ ID NO: 8081 - DNA, 3195 bp, Homo sapiens
agtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttattctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagttcaccatttcaggtcactgctggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttca

SEQ ID NO: 8082 - DNA, 3756 bp, Homo sapiens
cacgcgccccgatacccggcacaggagccacctcccagagccccgcagtccatgcctcagtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttattctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttc

SEQ ID NO: 8083 - DNA, 3914 bp, Homo sapiens
agtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttattctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcaccagttcaggtcaccactggatatcagttgcctgtatacaattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttc

SEQ ID NO: 8084 - DNA, 1891 bp, Homo sapiens
ctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttattctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactg

SEQ ID NO: 8085 - DNA, 2405 bp, Homo sapiens
ctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttattctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcaccagttcaggtcaccactggatatcagttgcctgtatacaattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgattta

SEQ ID NO: 8086 - DNA, 1352 bp, Homo sapiens
cacgcgccccgatacccggcacaggagccacctcccagagccccgcagtccatgcctcagtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttattctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcagatgccaccttag

SEQ ID NO: 8087 - DNA, 4119 bp, Homo sapiens
cacgcgccccgatacccggcacaggagccacctcccagagccccgcagtccatgcctcagtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttattctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttcaaa

SEQ ID NO: 8088 - DNA, 3791 bp, Homo sapiens
gctgccacccattggctcaggccgataccacgcgccccgatacccggcacaggagccacctcccagagccccgcagtccatgcctcagtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttattctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttcaaatgtg

SEQ ID NO: 8089 - DNA, 3390 bp, Homo sapiens
ctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttattctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccatttcaagtcgccactggatatcagttccctgtatacaattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttca

SEQ ID NO: 8090 - DNA, 3271 bp, Homo sapiens
tcagtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttattctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttcaaa

SEQ ID NO: 8091 - DNA, 3922 bp, Homo sapiens
attggctcaggccgataccacgcgccccgatacccggcacaggagccacctcccagagccccgcagtccatgcctcagtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttattctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttcaaatgtg

SEQ ID NO: 8092 - DNA, 1201 bp, Homo sapiens
ctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttactctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcagatgccaccttag

SEQ ID NO: 8093 - DNA, 3195 bp, Homo sapiens
agtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttactctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccagttcaggtcaccactggatatcagttgcctgtatacaattatcaggcatttcctgcttatccaaattcaccagttcaggtcaccactggatatcagttgcctgtatacaattatcaggcatttcctgcttatccaaattcaccagttcaggtcaccactggatatcagttgcctgtatacaattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttca

SEQ ID NO: 8094 - DNA, 3503 bp, Homo sapiens
gctgccacccattggctcaggccgataccacgcgccccgatacccggcacaggagccacctcccagagccccgcagtccatgcctcagtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttactctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttcaaatgtg

SEQ ID NO: 8095 - DNA, 1273 bp, Homo sapiens
ctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttactctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcaccagttcaggtcaccactggatatcagttgcctgtatacaattatcagatgccaccttag

SEQ ID NO: 8096 - DNA, 3271 bp, Homo sapiens
tcagtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttactctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttcaaa

SEQ ID NO: 8097 - DNA, 3104 bp, Homo sapiens
actcccacgcgcctccgccccgccagcctcatttctggcgcgctctccccgtggctccgcaagatggcggcgggcctgctgagggacttgccttcttaaacttcgagggccggagcttccttaggaagtggttccctcctggtccctgtacttggtggggtgggcggggttcgtgggggcctcagcgtggggtgtggggcgtcctgaaggcatggccctgtagctgagggggctgggccggaagtgcctctggtcccctcgcgcctgtcagctgcgggggacttgctgatggcggctccctcgtgtggcggcgacagaaaagctcgcctgacgccatctttgccgcacgagtctactgcaaatcctgaaactccaaactcaaccatctccagagaggccagcacccagtcctcatcagctgcaaccagccaaggctatattttaccagaaggcaaaatcatgccaaacactgtttttgttggaggaattgatgttaggatggatgaaactgagattagaagcttctttgctagatatggttcagtgaaagaagtgaagataatcactgatcgaactggtgtgtccaaaggctatggatttgtttcattttttaatgacgtggatgtgcagaagatagtagaatcacagataaatttccatggtaaaaagctgaagctgggccctgcaatcaggaaacaaaatttatgtgcttatcatgtgcagccacgtcctttggtttttaatcatcctcctccaccacagtttcagaatgtctggactaatccaaacactgaaacttatatgcagcccacaaccacgatgaatcctataactcagtatgttcaggcatatcctacttacccaaattcaccagttcaggtcatcactggatatcagttgcctgtatataattatcagatgccaccacagtggcctgttggggagcaaaggagctatgttgtacctccggcttattcagctgttaactaccactgtaatgaagttgatccaggagctgaagttgtgccaaatgaatgttcagttcatgaagctactccaccctctggaaatggcccacaaaagaaatctgtggaccgaagcatacaaacggtggtatcttgtctgtttaatccagagaacagactgagaaactctgttgttactcaagatgactacttcaaggataaaagagtgcatcactttagaagaagtcgggcaatgcttaaatctgtttgatcctcctggcttatctagttacatgggaagttgctggttttgaatattaagctaaaaggtttccactattatagaaattctgaattttggtaaatcacactcaaactttgtgtataagttgtattattagactctctagttttatcttaaactgttcttcattagatgtttatttagaaactggttctgtgttgaaatatagttgaaagtaaaaaaataattgagactgaaagaaactaagatttatctgcaaggattttttaaaaattggcattttaagtgtttaaaagcaaatactgattttcaaaaaaatgtttttaaaaacctattttgaaaggtcagaattttgttggtctgaatacaaacatttcacttctccaacaagtacctgtgaacagtacagtatttacagtattgagctttgcatttatgatttctccagaaatttaccacaaaagcaaaatttttaaaactgcatttttaatcagtggaactcaatatatagttagctttattgaagtcttcttatctaaacccagcaaaacagattcaaagcgaacagtccaatcagtgggtcatatgtttattcaaaatattttatcttttagctagaatccacacatatatatcctatttgattagggtagtaattaggataactaaaattctgggcctaattttttaaagaatccaagacaaactaaactttactaggtacataagcttctcaatgagtcaccattcttcttttttgtaaaaacttttttctttgaaatgctaaacttggctgtatgtcaaattgtgcaaaatattggtattaaagaatgctgcaacttttttatgtctcttagaggttaatcagagtatctgaagggaattgtttttataaaaacattgaaatattagttacttgctataaatagatttagtctgttatatttccttttgtaaagtaaaatatgtccagaagagtcaaagtagttagttttggttatttctaaaccacaaaagttgtttaataagtatatcttaagaatgtgctagagttaaaagttagcattgtttctagattagctggtgtcttcattttacattgtgacaaacagctagagcatcagagcccttttgctataccacagtctttcgtttccagcctttgtcactagtctttgaggaggtttgctcctagaactggtgatataaagaatgaaagtagctgtatgagcagagcagttcaagggccaaaccctggaacggtagcaatgggatataatacctttctaagggaaaaagttgtatcagtaccatttgatctgccatggacatgagtttaaagcggctttctggcccttctttcagtgacttcttccctaaaatgtagaaattctaacttaatgtagttactgtgagccatattactagtgccccctagggtctataattccttaaaattttcattctgaatctgaaggagagagtcttttaactttagaattcccaagagggctttattacacctcagaaattgaaagcactatgaatttgtccatttaaaaatgatctgtagtttttttggtgctataacattctgacacatatcattctgtgattaaatctccagcttactataaatgatatctatattctaaagagctacttctaattattccaatatgaccttaaggaaaagtaagggaataaatttttgtctttgttggagtgaagcatttaaaagagtaagggtaaaaaagataaagtcctgaacctttcaaaatggaaaattaattctaaacttagaaatatgcttctgcctattgctgatactgtctttgcatacatgaataaaaataaagtttttttcttcaaaa

SEQ ID NO: 8098 - DNA, 3050 bp, Homo sapiens
attggctgaggccgataccacgcgccccgatacccggcgcaggagccacctccctgagccccgcggaccacgcctcagtccgcctgcgctcctcagcctgacggtccgcctttcggggctcctcagccttgtcacccgctcttggttttccttttctcttcatctttggctcctttgaccactcgaagccgcgcagcgggttccagcggacctcacagcagccccagaagtggtgcgccaagcacagcctctgctcctcctggagccggtcgggaactgctgcctgccgccatcatgtctactgcaaatcctgaaactccaaactcaaccatctccagagaggccagcacccagtcctcatcagctgcaaccagccaaggctatattttaccagaaggcaaaatcatgccaaacactgtttttgttggaggaattgatgttaggatggatgaaactgagattagaagcttctttgctagatatggttcagtgaaagaagtgaagataatcactgatcgaactggtgtgtccaaaggctatggatttgtttcattttttaatgacgtggatgtgcagaagatagtagaatcacagataaatttccatggtaaaaagctgaagctgggccctgcaatcaggaaacaaaatttatgtgcttatcatgtgcagccacgtcctttggtttttaatcatcctcctccaccacagtttcagaatgtctggactaatccaaacactgaaacttatatgcagcccacaaccacgatgaatcctataactcagtatgttcaggcatatcctacttacccaaattcaccagttcaggtcatcactggatatcagttgcctgtatataattatcagatgccaccacagtggcctgttggggagcaaaggagctatgttgtacctccggcttattcagctgttaactaccactgtaatgaagttgatccaggagctgaagttgtgccaaatgaatgttcagttcatgaagctactccaccctctggaaatggcccacaaaagaaatctgtggaccgaagcatacaaacggtggtatcttgtctgtttaatccagagaacagactgagaaactctgttgttactcaagatgactacttcaaggataaaagagtgcatcactttagaagaagtcgggcaatgcttaaatctgtttgatcctcctggcttatctagttacatgggaagttgctggttttgaatattaagctaaaaggtttccactattatagaaattctgaattttggtaaatcacactcaaactttgtgtataagttgtattattagactctctagttttatcttaaactgttcttcattagatgtttatttagaaactggttctgtgttgaaatatagttgaaagtaaaaaaataattgagactgaaagaaactaagatttatctgcaaggattttttaaaaattggcattttaagtgtttaaaagcaaatactgattttcaaaaaaatgtttttaaaaacctattttgaaaggtcagaattttgttggtctgaatacaaacatttcacttctccaacaagtacctgtgaacagtacagtatttacagtattgagctttgcatttatgatttctccagaaatttaccacaaaagcaaaatttttaaaactgcatttttaatcagtggaactcaatatatagttagctttattgaagtcttcttatctaaacccagcaaaacagattcaaagcgaacagtccaatcagtgggtcatatgtttattcaaaatattttatcttttagctagaatccacacatatatatcctatttgattagggtagtaattaggataactaaaattctgggcctaattttttaaagaatccaagacaaactaaactttactaggtacataagcttctcaatgagtcaccattcttcttttttgtaaaaacttttttctttgaaatgctaaacttggctgtatgtcaaattgtgcaaaatattggtattaaagaatgctgcaacttttttatgtctcttagaggttaatcagagtatctgaagggaattgtttttataaaaacattgaaatattagttacttgctataaatagatttagtctgttatatttccttttgtaaagtaaaatatgtccagaagagtcaaagtagttagttttggttatttctaaaccacaaaagttgtttaataagtatatcttaagaatgtgctagagttaaaagttagcattgtttctagattagctggtgtcttcattttacattgtgacaaacagctagagcatcagagcccttttgctataccacagtctttcgtttccagcctttgtcactagtctttgaggaggtttgctcctagaactggtgatataaagaatgaaagtagctgtatgagcagagcagttcaagggccaaaccctggaacggtagcaatgggatataatacctttctaagggaaaaagttgtatcagtaccatttgatctgccatggacatgagtttaaagcggctttctggcccttctttcagtgacttcttccctaaaatgtagaaattctaacttaatgtagttactgtgagccatattactagtgccccctagggtctataattccttaaaattttcattctgaatctgaaggagagagtcttttaactttagaattcccaagagggctttattacacctcagaaattgaaagcactatgaatttgtccatttaaaaatgatctgtagtttttttggtgctataacattctgacacatatcattctgtgattaaatctccagcttactataaatgatatctatattctaaagagctacttctaattattccaatatgaccttaaggaaaagtaagggaataaatttttgtctttgttggagtgaagcatttaaaagagtaagggtaaaaaagataaagtcctgaacctttcaaaatggaaaattaattctaaacttagaaatatgcttctgcctattgctgatactgtctttgcatacatgaataaaaataaagtttttttcttcaaaa

SEQ ID NO: 8099 - DNA, 3196 bp, Homo sapiens
cgcggcgcacttggacttccctctccattcgccagccgcctcgctcccggaccccacggctgcaaactgatctggcgcgcggggaggaggagagcgcaggcgagcgaacccgcgagagagggagagagcgagcgagcaacagcgagagcgagagcgagagagccgggaggcagagggagtagtgaccgccttccggagccgggattcatgcctgtcctcgggaccagcgaaggggactttacggctgagtatgagccaggctgctaggagccaggtacccccacgcctgcagtccccgcgccgtgcccggaatgcgagctgcacgcagggctctcccaagttcccaccgagccgaataaaaagcgtcctcccgcagctctccgccaaagacggacattgactccaggactccacagaatggagcaagaatgagaggaaaaaggccggcagaaaagcatgaactggaggtttgttgagctcctctacttcctgtttatatggggccgtatctcagtgcagccctcccaccaggaaccagctgggacagaccaacatgtctccaaggaatttgattggctcatttcagacagggggcctttccaccactccaggagctacctatcctttgtggaaagacaccgtcaaggatttacaaccagatataaaatatacagggagtttgcccgttggaaggtgaggaacacagccatcgagaggagagatctggtccgccatccagtgcccctcatgccggagtttcaaaggagcatccgcctgcttggcaggagacctaccactcagcagttcatcgataccatcatcaaaaagtacggcacccacctgctcatctcagccacattgggaggggaggaggctttgaccatgtatatggacaaaagtcgcctcgacaggaagtcagggaatgccactcaaagtgttgaagctctgcaccagctcgcatcatcctactttgttgaccgtgatggtaccatgaggaggcttcatgagatccagatatcaactggagcaatcaaggtcacagagacacgcactgggcctctgggctgtaacagctatgacaatctggactctgtgagttccgtccttctgcaaagcacggagagcaaactgcaccttcaaggtcttcagataatctttcctcagtatctgcaagagaagtttgtccagtcggccttgagctatatcatgtgcaatggggagggggagtacctgtgccagaacagccagtgtcgctgccaatgtgccgaggagtttccgcagtgcaactgccccatcacggacatccagatcatggagtacacgctggccaacatggccaagtcttgggccgaagcttataaggacctggagaattcagatgagtttaaatcatttatgaagcgcctccccagcaaccacttcctgaccatcggaagcatccatcagcactggggcaatgactgggacctgcagaaccgctacaagctcctgcagagtgccacggaggcacagagacaaaagatccaacgcactgcccgcaagcttttcggcctcagtgtacgctgtcgccacaatcccaaccaccagctgcctagagagaggacaattcagcagtggcttgcaagggtccagtcactcctctactgtaatgagaatgggttttggggaaccttcctggagagccagcggagctgcgtgtgccacggcagcaccacgctgtgccagcgccccatcccctgcgtgataggcgggaacaacagctgcgccatgtgcagcctggccaacatctccctctgcggctcctgcaacaagggctacaagctgtatcgaggccgctgtgaaccacagaacgtggactcggagcggagcgagcagttcatcagctttgagactgacctggacttccaggacctggagctgaagtacctgctgcagaagatggactcacgcctctacgtccacaccaccttcatcagcaacgagatccgcctcgacaccttctttgaccctcggtggcgcaagcgcatgtccctcactctcaagagcaacaagaaccgcatggacttcatccacatggtgatcggcatgtccatgcgcatctgccagatgcgcaacagcagcctggaccccatgttctttgtctatgtcaacccctttagcgggagccattcggagggctggaacatgcccttcggggaatttggctacccacgctgggagaagatccgtctccaaaacagccagtgctacaactggactcttttgctgggcaatcggtggaaaacatttttcgagacggtccacatctacctacgtagtcggactcggctacctaccctactgcgaaatgagactggccagggccccgtggacctgtcggatccctccaagaggcagttctacatcaagatctcagacgtgcaggtgtttgggtatagcctgaggttcaacgccgacctcctgcgcagtgcagtgcagcaggtcaaccagtcctacacacagggcggccagttctattcctcttcgtcagtgatgctcctcttgttggatattcgggaccgaattaatcgcctggcccctcctgtggccccggggaaaccccagctggacttgttctcctgtatgctgaaacaccgcctgaaactgaccaacagcgagatcatcagggtgaaccacgccttggacctgtacaacacggagatcctcaaacagtcggaccagatgacagccaaactctgctaacccgggactccttgccatggacttttcctgttgttgtacacacacaacagaacaaaatgaagcaaaacaaaacaaaaaaacccacaaaaatttgtaaaatgtaattaatattcaaagaaaaggaggaaaatcttcatttgttggaaatgaaaacgttctagcaactgtataaaagcgttgggcatgtttgttatttctatactcactctgtcatgaagaagggtctcagccttttgtggagcattgagggagttgcttcttaggcctcaggtgctgtattgggggagaagggagaaagcatatgcaatgaattgtaaagatctctgctgtgcaggtgctaagattaaacactaaaaagaaagagagatatatgtaatgtacaactgacactgccatttttcctttttggaggaaatggacatagataaagaagatatttcttcggttaagattt

SEQ ID NO: 8100 - DNA, 1645 bp, Homo sapiens
cgcctcgctcccggaccccacggctgcaaactgatctggcgcgcggggaggaggagagcgcaggcgagcgaacccgcgagagagggagagagcgagcgagcaacagcgagagcgagagcgagagagccgggaggcagagggagtagtgaccgccttccggagccgggattcatgcctgtcctcgggaccagcgaaggggactttacggctgagtatgagccaggctgctaggagccaggtacccccacgcctgcagtccccgcgccgtgcccggaatgcgagctgcacgcagggctctcccaagttcccaccgagccgaataaaaagcgtcctcccgcagctctccgccaaagacggacattgactccaggtaaggcggcgccgaatggagcaagaatgagaggaaaaaggccggcagaaaagcatgaactggaggtttgttgagctcctctacttcctgtttatatggggccgtatctcagtgcagccctcccaccaggaaccagctgggacagaccaacatgtctccaaggaatttgattggctcatttcagacagggggcctttccaccactccaggagctacctatcctttgtggaaagacaccgtcaaggatttacaaccagatataaaatatacagggagtttgcccgttggaaggtgaggaacacagccatcgagaggagagatctggtccgccatccagtgcccctcatgccggagtttcaaaggagcatccgcctgcttggcaggagacctaccactcagcagttcatcgataccatcatcaaaaagtacggcacccacctgctcatctcagccacattgggaggggaggaggctttgaccatgtatatggacaaaagtcgcctcgacaggaagtcagggaatgccactcaaagtgttgaagctctgcaccagctcgcatcatcctactttgttgaccgtgatggtaccatgaggaggcttcatgagatccagatatcaactggagcaatcaaggtcacagagacacgcactgggcctctgggctgtaacagctatgacaatctggactctgtgagttccgtccttctgcaaagcacggagagcaaactgcaccttcaaggtcttcagataatctttcctcagtatctgcaagagaagtttgtccagtcggccttgagctatatcatgtgcaatggggagggggagtacctgtgccagaacagccagtgtcgctgccaatgtgccgaggagtttccgcagtgcaactgccccatcacggacatccagatcatggagtacacgctggccaacatggccaagtcttgggccgaagcttataaggacctggagaattcaggtagagagtctcactcagtgccactgcatgagtggccttgagccaagtctgaaagggagctaatctaactggaattaggactgctgcaagggaaagttcagtgaccctgaccctttcactttggagtgtccagatgcaagtataatagctgtcacagagcaggcactcaataaatctcaactgaataaaattaatgaatagcataatccagtttgtggtcatatgatgtattgtttctgtcgtacccagaagacagaaagaataaatctgcataggaagcctctggagagggaagagtc

SEQ ID NO: 8101 - DNA, 3207 bp, Homo sapiens
ggagaccgcggcgcacttggacttccctctccattcgccagccgcctcgctcccggaccccacggctgcaaactgatctggcgcgcggggaggaggagagcgcaggcgagcgaacccgcgagagagggagagagcgagcgagcaacagcgagagcgagagcgagagagccgggaggcagagggagtagtgaccgccttccggagccgggattcatgcctgtcctcgggaccagcgaaggggactttacggctgagtatgagccaggctgctaggagccaggtacccccacgcctgcagtccccgcgccgtgcccggaatgcgagctgcacgcagggctctcccaagttcccaccgagccgaataaaaagcgtcctcccgcagctctccgccaaagacggacattgactccaggtaaggcggcgccgaatggagcaagaatgagaggaaaaaggccggcagaaaagcatgaactggaggtttgttgagctcctctacttcctgtttatatggggccgtatctcagtgcagccctcccaccaggaaccagctgggacagaccaacatgtctccaaggaatttgattggctcatttcagacagggggcctttccaccactccaggagctacctatcctttgtggaaagacaccgtcaaggatttacaaccagatataaaatatacagggagtttgcccgttggaaggtgaggaacacagccatcgagaggagagatctggtccgccatccagtgcccctcatgccggagtttcaaaggagcatccgcctgcttggcaggagacctaccactcagcagttcatcgataccatcatcaaaaagtacggcacccacctgctcatctcagccacattgggaggggaggaggctttgaccatgtatatggacaaaagtcgcctcgacaggaagtcagggaatgccactcaaagtgttgaagctctgcaccagctcgcatcatcctactttgttgaccgtgatggtaccatgaggaggcttcatgagatccagatatcaactggagcaatcaaggtcacagagacacgcactgggcctctgggctgtaacagctatgacaatctggactctgtgagttccgtccttctgcaaagcacggagagcaaactgcaccttcaaggtcttcagataatctttcctcagtatctgcaagagaagtttgtccagtcggccttgagctatatcatgtgcaatggggagggggagtacctgtgccagaacagccagtgtcgctgccaatgtgccgaggagtttccgcagtgcaactgccccatcacggacatccagatcatggagtacacgctggccaacatggccaagtcttgggccgaagcttataaggacctggagaattcagatgagtttaaatcatttatgaagcgcctccccagcaaccacttcctgaccatcggaagcatccatcagcactggggcaatgactgggacctgcagaaccgctacaagctcctgcagagtgccacggaggcacagagacaaaagatccaacgcactgcccgcaagcttttcggcctcagtgtacgctgtcgccacaatcccaaccaccagctgcctagagagaggacaattcagcagtggcttgcaagggtccagtcactcctctactgtaatgagaatgggttttggggaaccttcctggagagccagcggagctgcgtgtgccacggcagcaccacgctgtgccagcgccccatcccctgcgtgataggcgggaacaacagctgcgccatgtgcagcctggccaacatctccctctgcggctcctgcaacaagggctacaagctgtatcgaggccgctgtgaaccacagaacgtggactcggagcggagcgagcagttcatcagctttgagactgacctggacttccaggacctggagctgaagtacctgctgcagaagatggactcacgcctctacgtccacaccaccttcatcagcaacgagatccgcctcgacaccttctttgaccctcggtggcgcaagcgcatgtccctcactctcaagagcaacaagaaccgcatggacttcatccacatggtgatcggcatgtccatgcgcatctgccagatgcgcaacagcagcctggaccccatgttctttgtctatgtcaacccctttagcgggagccattcggagggctggaacatgcccttcggggaatttggctacccacgctgggagaagatccgtctccaaaacagccagtgctacaactggactcttttgctgggcaatcggtggaaaacatttttcgagacggtccacatctacctacgtagtcggactcggctacctaccctactgcgaaatgagactggccagggccccgtggacctgtcggatccctccaagaggcagttctacatcaagatctcagacgtgcaggtgtttgggtatagcctgaggttcaacgccgacctcctgcgcagtgcagtgcagcaggtcaaccagtcctacacacagggcggccagttctattcctcttcgtcagtgatgctcctcttgttggatattcgggaccgaattaatcgcctggcccctcctgtggccccggggaaaccccagctggacttgttctcctgtatgctgaaacaccgcctgaaactgaccaacagcgagatcatcagggtgaaccacgccttggacctgtacaacacggagatcctcaaacagtcggaccagatgacagccaaactctgctaacccgggactccttgccatggacttttcctgttgttgtacacacacaacagaacaaaatgaagcaaaacaaaacaaaaaaacccacaaaaatttgtaaaatgtaattaatattcaaagaaaaggaggaaaatcttcatttgttggaaatgaaaacgttctagcaactgtataaaagcgttgggcatgtttgttatttctatactcactctgtcatgaagaagggtctcagccttttgtggagcattgagggagttgcttcttaggcctcaggtgctgtattgggggagaagggagaaagcatatgcaatgaattgtaaagatctctgctgtgcaggtgctaagattaaacactaaaaagaaagagagatatatgtaatgtacaactgacactgccatttttcctttttggaggaaatggacatagataaagaagatatttcttcggttaagattta

SEQ ID NO: 8102 - DNA, 2028 bp, Homo sapiens
gctgttgcatatagtgctggggtggacctggtttcaggacaccagggagcctggggtcggctcacaaaacccccattgttccttttccatcttcctttagaaacctaaagatgtaatgttctccgggtcatcagcagcagattttattttgacttcaggtcattcactgttgagctctggagttggctcccattgtgttaggctctcattgctgttttcccatcatgtgttatctgcgccttttaaccctaaatgctttcgatctcatcaagaactcagaagtgattcttacccttttttcaagacaaaagggaccttgtttttcacactctatcagatgcacctaattaggggccgtgcccaagttcatgaagaggatcaaggttccagactacaaggaccggagtgtgtttggggtcccactgacggtcaacgtgcagcgcacaggacaaccgttgcctcagagcatccagcaggccatgcgatacctccggaaccattgtttggatcaggttgggctcttcagaaaatcgggggtcaagtcccggattcaggctctgcgccagatgaatgaaggtgccatagactgtgtcaactacgaaggacagtctgcttatgacgtggcagacatgctgaagcagtattttcgagatcttcctgagccactaatgacgaacaaactctcggaaacctttctacagatctaccaatatgtgcccaaggaccagcgcctgcaggccatcaaggctgccatcatgctgctgcctgacgagaaccgggaggttctgcagaccctgctttatttcctgagcgatgtcacagcagccgtaaaagaaaaccagatgaccccaaccaacctggccgtgtgcttagcgccttccctcttccatctcaacaccctgaagagagagaattcctctcccagggtaatgcaaagaaaacaaagtttgggcaaaccagatcagaaagatttgaatgaaaacctagctgccactcaagggctggcccatatgatcgccgagtgcaagaagcttttccaggttcccgaggaaatgagccgatgtcgtaattcctataccgaacaagagctgaagcccctcactctggaagcactcgggcacctgggtaatgatgactcagctgactaccaacacttcctccaggactgtgtggatggcctgtttaaagaagtcaaagagaagtttaaaggctgggtcagctactccacttcggagcaggctgagctgtcctataagaaggtgagcgaaggaccccctctgaggctttggaggtcagtcattgaagtccctgctgtgccagaggaaatcttaaagcgcctacttaaagaacagcacctctgggatgtagacctgttggattcaaaagtgatcgaaattctggacagccaaactgaaatttaccagtatgtccaaaacagtatggcacctcatcctgctcgagactacgttgttttaagaacctggaggactaatttacccaaaggagcctgtgcccttttactaacctctgtggatcacgatcgcgcacctgtggtgggtgtgagggttaatgtgctcttgtccaggtatttgattgaaccctgtgggccaggaaaatccaaactcacctacatgtgcagagttgacttaaggggccacatgccagaatggtacacaaaatcttttggacatttgtgtgcagctgaagttgtaaagatccgggattccttcagtaaccagaacactgaaaccaaagacaccaaatctaggtgatcactgaagcaacgcaaccgcttccaccaccatggtgtttgtttctagaacttttgccagtccttgaagaatgggttctgtgtctaatcctgaaacaaagaaaactacaagctggagtgtaggaattgactatagcaatttgatacatttttaaagctgcttcctgtttgttgagggtctgtattcatagaccttgactggaatatgtaagactgtgcaaaaaaaaaaaaaaaatttatgtgtattcttattcaaa

SEQ ID NO: 8103 - DNA, 3758 bp, Homo sapiens
agttggcgcttcccggggccgcagtgccagccgcaatgccggcctcctgaaggcaggcgacagcctgcggccgggagcacagcgcggggcggagtaccgaggcatggtcgcggcgcccgggctgcgctgaaggcgtctgcgagcggatgggggaccccaaggcccacgtgatggcgcgccccctgcgagcccctctccggaggtcctttagcgatcacatcagggactccacggccagagccctggatgtcatttggaaaaacactagagacagacggctggcagaaattgaagccaaggaagcttgtgattggctacgggcaactggtttcccccagtatgcacagctttatgaagatttcctgttccccatcgatatttccttggtcaagagagagcatgattttttggacagagatgccattgaggctctatgcaggcgtctaaatactttaaacaaatgtgcggtgatgaagctagaaattagtcctcatcggaaacgaagtgacgattcagacgaggatgagccttgtgccatcagtggcaaatggactttccaaagggacagcaagaggtggtcccggcttgaagagtttgatgtcttttctccaaaacaagacctggtccctgggtccccagacgactcccacccgaaggacggccccagccccggaggcacgctgatggacctcagcgagcgccaggaggtgtcttccgtccgcagcctcagcagcactggcagcctccccagccacgcgccccccagcgaggatgctgccaccccccggactaactccgtcatcagcgtttgctcctccagcaacttggcaggcaatgacgactctttcggcagcctgccctctcccaaggaactgtccagcttcagcttcagcatgaaaggccacgaaaaaactgccaagtccaagacgcgcagtctgctgaaacggatggagagcctgaagctcaagagctcccatcacagcaagcacaaagcgccctcaaagctggggttgatcatcagcgggcccatcttgcaagaggggatggatgaggagaagctgaagcagctcaactgcgtggagatctccgccctcaatggcaaccgcatcaacgtccccatggtacgaaagaggagcgtttccaactccacgcagaccagcagcagcagcagccagtcggagaccagcagcgcggtcagcacgcccagccctgttacgaggacccggagcctcagtgcgtgcaacaagcgggtgggcatgtacttagagggcttcgatcctttcaatcagtcaacatttaacaacgtggtggagcagaactttaagaaccgcgagagctacccagaggacacggtgttctacatccctgaagatcacaagcctggcactttccccaaagctctcaccaatggcagtttctccccctcggggaataacggctctgtgaactggaggacgggaagcttccacggccctggccacatcagcctcaggagggaaaacagtagcgacagccccaaggaactgaagagacgcaattcttccagctccatgagcagccgcctgagcatctacgacaacgtgccgggctccatcctctactccagttcaggggacctggcggatctggagaacgaggacatcttccccgagctggacgacatcctctaccacgtgaaggggatgcagcggatagtcaatcagtggtcggagaagttttctgatgagggagattcggactcagccctggactcggtctctccctgcccgtcctctccaaaacagatacacctggatgtggacaacgaccgaaccacacccagcgacctggacagcacaggcaactccctgaatgaaccggaagagccctccgagatcccggaaagaagggattctggggttggggcttccctaaccaggtccaacaggcaccgactgagatggcacagtttccagagctcacatcggccaagcctcaactctgtatcactacagattaactgccagtctgtggcccagatgaacctgctgcagaaatactcactcctaaagctaacggccctgctggagaaatacacaccttctaacaagcatggttttagctgggccgtgcccaagttcatgaagaggatcaaggttccagactacaaggaccggagtgtgtttggggtcccactgacggtcaacgtgcagcgcacaggacaaccgttgcctcagagcatccagcaggccatgcgatacctccggaaccattgtttggatcaggttgggctcttcagaaaatcgggggtcaagtcccggattcaggctctgcgccagatgaatgaaggtgccatagactgtgtcaactacgaaggacagtctgcttatgacgtggcagacatgctgaagcagtattttcgagatcttcctgagccactaatgacgaacaaactctcggaaacctttctacagatctaccaatatgtgcccaaggaccagcgcctgcaggccatcaaggctgccatcatgctgctgcctgacgagaaccgggaggttctgcagaccctgctttatttcctgagcgatgtcacagcagccgtaaaagaaaaccagatgaccccaaccaacctggccgtgtgcttagcgccttccctcttccatctcaacaccctgaagagagagaattcctctcccagggtaatgcaaagaaaacaaagtttgggcaaaccagatcagaaagatttgaatgaaaacctagctgccactcaagggctggcccatatgatcgccgagtgcaagaagcttttccaggttcccgaggaaatgagccgatgtcgtaattcctataccgaacaagagctgaagcccctcactctggaagcactcgggcacctgggtaatgatgactcagctgactaccaacacttcctccaggactgtgtggatggcctgtttaaagaagtcaaagagaagtttaaaggctgggtcagctactccacttcggagcaggctgagctgtcctataagaaggtgagcgaaggaccccctctgaggctttggaggtcagtcattgaagtccctgctgtgccagaggaaatcttaaagcgcctacttaaagaacagcacctctgggatgtagacctgttggattcaaaagtgatcgaaattctggacagccaaactgaaatttaccagtatgtccaaaacagtatggcacctcatcctgctcgagactacgttgttttaagaacctggaggactaatttacccaaaggagcctgtgcccttttactaacctctgtggatcacgatcgcgcacctgtggtgggtgtgagggttaatgtgctcttgtccaggtatttgattgaaccctgtgggccaggaaaatccaaactcacctacatgtgcagagttgacttaaggggccacatgccagaatggtacacaaaatcttttggacatttgtgtgcagctgaagttgtaaagatccgggattccttcagtaaccagaacactgaaaccaaagacaccaaatctaggtgatcactgaagcaacgcaaccgcttccaccaccatggtgtttgtttctagaacttttgccagtccttgaagaatgggttctgtgtctaatcctgaaacaaagaaaactacaagctggagtgtaggaattgactatagcaatttgatacatttttaaagctgcttcctgtttgttgagggtctgtattcatagaccttgactggaatatgtaagactgtgcaaaaaaaaaaaaaaaa

SEQ ID NO: 8104 - DNA, 3556 bp, Homo sapiens
actgacttcgtgccctccatgttccttgacagcctgggcctctcctactggattaatacctgatgagtacctgatcacgcaacagtgaaacaacacaagaaattgaagccaaggaagcttgtgattggctacgggcaactggtttcccccagtatgcacagctttatgaagatttcctgttccccatcgatatttccttggtcaagagagagcatgattttttggacagagatgccattgaggctctatgcaggcgtctaaatactttaaacaaatgtgcggtgatgaagctagaaattagtcctcatcggaaacgaagtgacgattcagacgaggatgagccttgtgccatcagtggcaaatggactttccaaagggacagcaagaggtggtcccggcttgaagagtttgatgtcttttctccaaaacaagacctggtccctgggtccccagacgactcccacccgaaggacggccccagccccggaggcacgctgatggacctcagcgagcgccaggaggtgtcttccgtccgcagcctcagcagcactggcagcctccccagccacgcgccccccagcgaggatgctgccaccccccggactaactccgtcatcagcgtttgctcctccagcaacttggcaggcaatgacgactctttcggcagcctgccctctcccaaggaactgtccagcttcagcttcagcatgaaaggccacgaaaaaactgccaagtccaagacgcgcagtctgctgaaacggatggagagcctgaagctcaagagctcccatcacagcaagcacaaagcgccctcaaagctggggttgatcatcagcgggcccatcttgcaagaggggatggatgaggagaagctgaagcagctcaactgcgtggagatctccgccctcaatggcaaccgcatcaacgtccccatggtacgaaagaggagcgtttccaactccacgcagaccagcagcagcagcagccagtcggagaccagcagcgcggtcagcacgcccagccctgttacgaggacccggagcctcagtgcgtgcaacaagcgggtgggcatgtacttagagggcttcgatcctttcaatcagtcaacatttaacaacgtggtggagcagaactttaagaaccgcgagagctacccagaggacacggtgttctacatccctgaagatcacaagcctggcactttccccaaagctctcaccaatggcagtttctccccctcggggaataacggctctgtgaactggaggacgggaagcttccacggccctggccacatcagcctcaggagggaaaacagtagcgacagccccaaggaactgaagagacgcaattcttccagctccatgagcagccgcctgagcatctacgacaacgtgccgggctccatcctctactccagttcaggggacctggcggatctggagaacgaggacatcttccccgagctggacgacatcctctaccacgtgaaggggatgcagcggatagtcaatcagtggtcggagaagttttctgatgagggagattcggactcagccctggactcggtctctccctgcccgtcctctccaaaacagatacacctggatgtggacaacgaccgaaccacacccagcgacctggacagcacaggcaactccctgaatgaaccggaagagccctccgagatcccggaaagaagggattctggggttggggcttccctaaccaggtccaacaggcaccgactgagatggcacagtttccagagctcacatcggccaagcctcaactctgtatcactacagattaactgccagtctgtggcccagatgaacctgctgcagaaatactcactcctaaagctaacggccctgctggagaaatacacaccttctaacaagcatggttttagctgggccgtgcccaagttcatgaagaggatcaaggttccagactacaaggaccggagtgtgtttggggtcccactgacggtcaacgtgcagcgcacaggacaaccgttgcctcagagcatccagcaggccatgcgatacctccggaaccattgtttggatcaggttgggctcttcagaaaatcgggggtcaagtcccggattcaggctctgcgccagatgaatgaaggtgccatagactgtgtcaactacgaaggacagtctgcttatgacgtggcagacatgctgaagcagtattttcgagatcttcctgagccactaatgacgaacaaactctcggaaacctttctacagatctaccaatatgtgcccaaggaccagcgcctgcaggccatcaaggctgccatcatgctgctgcctgacgagaaccgggaggttctgcagaccctgctttatttcctgagcgatgtcacagcagccgtaaaagaaaaccagatgaccccaaccaacctggccgtgtgcttagcgccttccctcttccatctcaacaccctgaagagagagaattcctctcccagggtaatgcaaagaaaacaaagtttgggcaaaccagatcagaaagatttgaatgaaaacctagctgccactcaagggctggcccatatgatcgccgagtgcaagaagcttttccaggttcccgaggaaatgagccgatgtcgtaattcctataccgaacaagagctgaagcccctcactctggaagcactcgggcacctgggtaatgatgactcagctgactaccaacacttcctccaggactgtgtggatggcctgtttaaagaagtcaaagagaagtttaaaggctgggtcagctactccacttcggagcaggctgagctgtcctataagaaggtgagcgaaggaccccctctgaggctttggaggtcagtcattgaagtccctgctgtgccagaggaaatcttaaagcgcctacttaaagaacagcacctctgggatgtagacctgttggattcaaaagtgatcgaaattctggacagccaaactgaaatttaccagtatgtccaaaacagtatggcacctcatcctgctcgagactacgttgttttaagaacctggaggactaatttacccaaaggagcctgtgcccttttactaacctctgtggatcacgatcgcgcacctgtggtgggtgtgagggttaatgtgctcttgtccaggtatttgattgaaccctgtgggccaggaaaatccaaactcacctacatgtgcagagttgacttaaggggccacatgccagaatggtacacaaaatcttttggacatttgtgtgcagctgaagttgtaaagatccgggattccttcagtaaccagaacactgaaaccaaagacaccaaatctaggtgatcactgaagcaacgcaaccgcttccaccaccatggtgtttgtttctagaacttttgccagtccttgaagaatgggttctgtgtctaatcctgaaacaaagaaaactacaagctggagtgtaggaattgactatagcaatttgatacatttttaaagctgcttcctgtttgttgagggtctgtattcatagaccttgactggaatatgtaagactgtgc

SEQ ID NO: 8105 - DNA, 1890 bp, Homo sapiens
cgggtggaggaagggaggattgctgcaccaacctttcctcggcgcctgtttactggcaccgtcgcatccattccacgccgatcctccgcagtccccctatcctgccagccgctcctccttggggcaggggcggcgcgagccacaggggcgtgcccgcgagcgggtcggggctgcggagagaacgggccggggtaaaaacccgacggctgcccgcgggtgggcggggcgcgcagagccggtgggaggccgcggtggcagcagtcgcccccgcgcatcgagggacccagggactcgcgcagatggcacgcggccacctcggtcctgccggggagccccatttccaaccgaggcaactgaggttcccaaagcgccagctacccgccggggtctggagagcgccggggcccggccgccccgcccagccagaggtgccccgccccaagcctggcgcacctggccccgccccgccgggaccccgcccccgccctaatcagagctggttccgcgccgcggccgccgcgacaggtgcagcagagccgagccggccgcgctccgaacggcgcctcccgccccaccatgggcaacagcgcgagccgcagcgacttcgagtgggtctacaccgaccagccgcacacgcagcggcgcaaggagatactggccaagtacccggccatcaaggccctgatgcggccagacccgcgcctcaagtgggcggtgctggtgctggtgctggtgcagatgctggcctgctggctggtgcgcgggctggcctggcgctggctgctgttctgggcctacgcctttggtggctgcgtgaaccactcgctgacgctggccatccacgacatctcgcacaacgcggccttcggcacgggccgtgcggcacgcaaccgctggctggccgtgttcgccaacctgcccgtgggtgtgccctacgccgcctccttcaagaagtaccacgtggaccaccaccgctacctgggcggcgacgggctggacgtggacgtgcccacgcgtctggagggctggttcttctgcacacccgcccgcaagctgctctggctggtgctgcagcccttcttctactcactacggccgctctgcgtccaccccaaggccgtgacccgcatggaggtgctcaacacgctggtgcagctggcggccgacctggccatctttgccctttgggggctcaagcccgtggtctacctgctggccagctccttcctgggcctgggcctgcaccccatctcgggccacttcgtggccgagcactacatgttcctcaagggccacgagacctactcctactatgggcctctcaactggatcaccttcaatgtgggctaccacgtggagcaccacgacttccccagcatcccgggctacaacctgccgctggtgcggaagatcgcgcccgagtactacgaccacctgccgcagcaccactcctgggtgaaggtgctctgggattttgtgtttgaggactccctggggccctatgccagggtgaagcgggtgtacaggctggcaaaagatggtctgtgagcccgggctgcctcctggtggtggccattgtcccccatcggcccctcagccttgcaccccagcactgagaagctacatttccttcctgtgctctggactgctgcccttgtccccgaggagtgtcccgcgcagccacacctggcaacagcagtgtgggctgcagggctccgtctgcacgtggacttgccctggaccttgagtgtggccctccctttctgggcctccccaggtgaggcctggccctgccccaccatgacctgggtgctctgagcccacggttcccacggagctgacttctccggggtgcctgtgccctacattaaacccggcgtttgtttcaca

SEQ ID NO: 8106 - DNA, 3260 bp, Homo sapiens
cgcagctgcaggaggcgcccggcccggcggagcagccctagccgccaccgtcgctctcgcagctctcgtcgccactgccaccgccgccgccgtcactgcgtcctggctccggctcccgcgccctcccggccggccatgcagccccgccgcgcccaggcgcccggtgcgcagctgctgcccgcgctggccctgctgctgctgctgctcggagcggggccccgaggcagctccctggccaacccggtgcccgccgcgcccctgtctgcgcccgggccgtgcgccgcgcagccctgccggaatgggggtgtgtgcacctcgcgccctgagccggacccgcagcacccggcccccgccggcgagcctggctacagctgcacctgccccgccgggatctccggcgccaactgccagcttgttgcagatccttgtgccagcaacccttgtcaccatggcaactgcagcagcagcagcagcagcagcagcgatggctacctctgcatttgcaatgaaggctatgaaggtcccaactgtgaacaggcacttcccagtctcccagccactggctggaccgaatccatggcaccccgacagcttcagcctgttcctgctactcaggagcctgacaaaatcctgcctcgctctcaggcaacggtgacactgcctacctggcagccgaaaacagggcagaaagttgtagaaatgaaatgggatcaagtggaggtgatcccagatattgcctgtgggaatgccagttctaacagctctgcgggtggccgcctggtatcctttgaagtgccacagaacacctcagtcaagattcggcaagatgccactgcctcactgattttgctctggaaggtcacggccacaggattccaacagtgctccctcatagatggacgaagtgtgaccccccttcaggcttcagggggactggtcctcctggaggagatgctcgccttggggaataatcactttattggttttgtgaatgattctgtgactaagtctattgtggctttgcgcttaactctggtggtgaaggtcagcacctgtgtgccgggggagagtcacgcaaatgacttggagtgttcaggaaaaggaaaatgcaccacgaagccgtcagaggcaactttttcctgtacctgtgaggagcagtacgtgggtactttctgtgaagaatacgatgcttgccagaggaaaccttgccaaaacaacgcgagctgtattgatgcaaatgaaaagcaagatgggagcaatttcacctgtgtttgccttcctggttatactggagagctttgccagtccaagattgattactgcatcctagacccatgcagaaatggagcaacatgcatttccagtctcagtggattcacctgccagtgtccagaaggatacttcggatctgcttgtgaagaaaaggtggacccctgcgcctcgtctccgtgccagaacaacggcacctgctatgtggacggggtacactttacctgcaactgcagcccgggcttcacagggccgacctgtgcccagcttattgacttctgtgccctcagcccctgtgctcatggcacgtgccgcagcgtgggcaccagctacaaatgcctctgtgatccaggttaccatggcctctactgtgaggaggaatataatgagtgcctctccgctccatgcctgaatgcagccacctgcagggacctcgttaatggctatgagtgtgtgtgcctggcagaatacaaaggaacacactgtgaattgtacaaggatccctgcgctaacgtcagctgtctgaacggagccacctgtgacagcgacggcctgaatggcacgtgcatctgtgcacccgggtttacaggtgaagagtgcgacattgacataaatgaatgtgacagtaacccctgccaccatggtgggagctgcctggaccagcccaatggttataactgccactgcccgcatggttgggtgggagcaaactgtgagatccacctccaatggaagtccgggcacatggcggagagcctcaccaacatgccacggcactccctctacatcatcattggagccctctgcgtggccttcatccttatgctgatcatcctgatcgtggggatttgccgcatcagccgcattgaataccagggttcttccaggccagcctatgaggagttctacaactgccgcagcatcgacagcgagttcagcaatgccattgcatccatccggcatgccaggtttggaaagaaatcccggcctgcaatgtatgatgtgagccccatcgcctatgaagattacagtcctgatgacaaacccttggtcacactgattaaaactaaagatttgtaatctttttttggattatttttcaaaaagatgagatactacactcatttaaatatttttaagaaaataaaaagcttaagaaatttaaaatgctagctgctcaagagttttcagtagaatatttaagaactaattttctgcagcttttagtttggaaaaaatattttaaaaacaaaatttgtgaaacctatagacgatgttttaatgtaccttcagctctctaaactgtgtgcttctactagtgtgtgctcttttcactgtagacactatcacgagacccagattaatttctgtggttgttacagaataagtctaatcaaggagaagtttctgtttgacgtttgagtgccggctttctgagtagagttaggaaaaccacgtaacgtagcatatgatgtataatagagtatacccgttacttaaaaagaagtctgaaatgttcgttttgtggaaaagaaactagttaaatttactattcctaacccgaatgaaattagcctttgccttattctgtgcatgggtaagtaacttatttctgcactgttttgttgaactttgtggaaacattctttcgagtttgtttttgtcattttcgtaacagtcgtcgaactaggcctcaaaaacatacgtaacgaaaaggcctagcgaggcaaattctgattgatttgaatctatatttttctttaaaaagtcaagggttctatattgtgagtaaattaaatttacatttgagttgtttgttgctaagaggtagtaaatgtaagagagtactggttccttcagtagtgagtatttctcatagtgcagctttatttatctccaggatgtttttgtggctgtatttgattgatatgtgcttcttctgattcttgctaatttccaaccatattgaataaatgtgatcaagtcaagga

SEQ ID NO: 8107 - DNA, 2128 bp, Homo sapiens
aaagctttactgagcccctgctgcacgccaggagccctgtgctgggggagcggatctgtgcggagtctactgtgatcttctccaggagcactggggagaatgggcagctgttgggatgttgggaagtggtcaggagtctctgggaagaggtaatatgtgggctaggaacacatttccaaggtggagaaggagacaaagcttgggaggattcggcaagatgccactgcctcactgattttgctctggaaggtcacggccacaggattccaacagtgctccctcatagatggacgaagtgtgaccccccttcaggcttcagggggactggtcctcctggaggagatgctcgccttggggaataatcactttattggttttgtgaatgattctgtgactaagtctattgtggctttgcgcttaactctggtggtgaaggtcagcacctgtgtgccgggggagagtcacgcaaatgacttggagtgttcaggaaaaggaaaatgcaccacgaagccgtcagaggcaactttttcctgtacctgtgaggagcagtacgtgggtactttctgtgaagaatacgatgcttgccagaggaaaccttgccaaaacaacgcgagctgtattgatgcaaatgaaaagcaagatgggagcaatttcacctgtgtttgccttcctggttatactggagagctttgccagtccaagattgattactgcatcctagacccatgcagaaatggagcaacatgcatttccagtctcagtggattcacctgccagtgtccagaaggatacttcggatctgcttgtgaagaaaaggtggacccctgcgcctcgtctccgtgccagaacaacggcacctgctgcagcccgggcttcacagggccgacctgtgcccagcttattgacttctgtgccctcagcccctgtgctcatggcacgtgccgcagcgtgggcaccagctacaaatgcctctgtgatccaggttaccatggcctctactgtgaggaggaatataatgagtgcctctccgctccatgcctgaatgcagccacctgcagggacctcgttaatggctatgagtgtgtgtgcctggcagaatacaaaggaacacactgtgaattgtacaaggatccctgcgctaacgtcagctgtctgaacggagccacctgtgacagcgacggcctgaatggcacgtgcatctgtgcacccgggtttacaggtgaagagtgcgacattgacataaatgaatgtgacagtaacccctgccaccatggtgggagctgcctggaccagcccaatggttataactgccactgcccgcatggttgggtgggagcaaactgtgagatccacctccaatggaagtccgggcacatggcggagagcctcaccaacatgccacggcactccctctacatcatcattggagccctctgcgtggccttcatccttatgctgatcatcctgatcgtggggatttgccgcatcagccgcattgaataccagggttcttccaggccagcctatgaggagttctacaactgccgcagcatcgacagcgagttcagcaatgccattgcatccatccggcatgccaggtttggaaagaaatcccggcctgcaatgtatgatgtgagccccatcgcctatgaagattacagtcctgatgacaaacccttggtcacactgattaaaactaaagatttgtaatctttttttggattatttttcaaaaagatgagatactacactcatttaaatatttttaagaaaataaaaagcttaagaaatttaaaatgctagctgctcaagagttttcagtagaatatttaagaactaattttctgcagcttttagtttggaaaaaatattttaaaaacaaaatttgtgaaacctatagacgatgttttaatgtaccttcagctctctaaactgtgtgcttctactagtgtgtgctcttttcactgtagacactatcacgagacccagattaatttctgtggttgttacagaataagtctaatcaaggagaagtttctgtttgacgtttgagtgccggctttctgagtagagttaggaaaaccacgtaacgtagcatatgatgtataatagagtatacccgttactt

SEQ ID NO: 8108 - DNA, 1324 bp, Homo sapiens
ggcggtggagagcgcagcgcgcagcccggtgcagccctggctttcccctcgctgcgcgcccgcgccccctttcgcgtccgcaaccagaagcccagtgcggcgccaggagccggacccgcgcccgcaccgctcccgggaccgcgaccccggccgcccagagatgaccgcgaccgaagccctcctgcgcgtcctcttgctcctgctggctttcggccacagcacctatggggctgaatgcttcccggcctgcaacccccaaaatggattctgcgaggatgacaatgtttgcaggtgccagcctggctggcagggtcccctttgtgaccagtgcgtgacctctcccggctgccttcacggactctgtggagaacccgggcagtgcatttgcaccgacggctgggacggggagctctgtgatagagatgttcgggcctgctcctcggccccctgtgccaacaacaggacctgcgtgagcctggacgatggcctctatgaatgctcctgtgcccccgggtactcgggaaaggactgccagaaaaaggacgggccctgtgtgatcaacggctccccctgccagcacggaggcacctgcgtggatgatgagggccgggcctcccatgcctcctgcctgtgcccccctggcttctcaggcaatttctgcgagatcgtggccaacagctgcacccccaacccatgcgagaacgacggcgtctgcactgacattgggggcgacttccgctgccggtgcccagccggcttcatcgacaagacctgcagccgcccggtgaccaactgcgccagcagcccgtgccagaacgggggcacctgcctgcagcacacccagggccaggccatctgcttcaccatcctgggcgtgctcaccagcctggtggtgctgggcactgtgggtatcgtcttcctcaacaagtgcgagacctgggtgtccaacctgcgctacaaccacatgctgcggaagaagaagaacctgctgcttcagtacaacagcggggaggacctggccgtcaacatcatcttccccgagaagatcgacatgaccaccttcagcaaggaggccggcgacgaggagatctaagcagcgttcccacagccccctctagattcttggagttccgcagagcttactatacgcggtctgtcctaatctttgtggtgttcgctatctcttgtgtcaaatctggtgaacgctacgcttacatatattgtctttgtgctgctgtgtgacaaacgcaatgcaaaaacaatcctctttctctctcttaatgcatgatacagaataataataagaatttcatctttaaatgag

SEQ ID NO: 8109 - DNA, 1700 bp, Homo sapiens
ggggcggggggcgggggccgcgaggggggaggcggtacgaaaagggcggcgcgcgcggcggcggcggcagctccccggcagcggcggtggagagcgcagcgcgcagcccggtgcagccctggctttcccctcgctgcgcgcccgcgccccctttcgcgtccgcaaccagaagcccagtgcggcgccaggagccggacccgcgcccgcaccgctcccgggaccgcgaccccggccgcccagagatgaccgcgaccgaagccctcctgcgcgtcctcttgctcctgctggctttcggccacagcacctatggggctgaatgcttcccggcctgcaacccccaaaatggattctgcgaggatgacaatgtttgcaggtgccagcctggctggcagggtcccctttgtgaccagtgcgtgacctctcccggctgccttcacggactctgtggagaacccgggcagtgcatttgcaccgacggctgggacggggagctctgtgatagagatgttcgggcctgctcctcggccccctgtgccaacaacaggacctgcgtgagcctggacgatggcctctatgaatgctcctgtgcccccgggtactcgggaaaggactgccagaaaaaggacgggccctgtgtgatcaacggctccccctgccagcacggaggcacctgcgtggatgatgagggccgggcctcccatgcctcctgcctgtgcccccctggcttctcaggcaatttctgcgagatcgtggccaacagctgcacccccaacccatgcgagaacgacggcgtctgcactgacattgggggcgacttccgctgccggtgcccagccggcttcatcgacaagacctgcagccgcccggtgaccaactgcgccagcagcccgtgccagaacgggggcacctgcctgcagcacacccaggtgagctacgagtgtctgtgcaagcccgagttcacaggtctcacctgtgtcaagaagcgcgcgctgagcccccagcaggtcacccgtctgcccagcggctatgggctggcctaccgcctgacccctggggtgcacgagctgccggtgcagcagccggagcaccgcatcctgaaggtgtccatgaaagagctcaacaagaaaacccctctcctcaccgagggccaggccatctgcttcaccatcctgggcgtgctcaccagcctggtggtgctgggcactgtgggtatcgtcttcctcaacaagtgcgagacctgggtgtccaacctgcgctacaaccacatgctgcggaagaagaagaacctgctgcttcagtacaacagcggggaggacctggccgtcaacatcatcttccccgagaagatcgacatgaccaccttcagcaaggaggccggcgacgaggagatctaagcagcgttcccacagccccctctagattcttggagttccgcagagcttactatacgcggtctgtcctaatctttgtggtgttcgctatctcttgtgtcaaatctggtgaacgctacgcttacatatattgtctttgtgctgctgtgtgacaaacgcaatgcaaaaacaatcctctttctctctcttaatgcatgatacagaataataataagaatttcatctttaaatgagtaagagaaataagtatgttattctaaaatctaaactcaaatgaaatttcaaaaaagaccaaaaaaaaacaaggca

SEQ ID NO: 8110 - DNA, 555 bp, Homo sapiens
aatggggaggaggggtgtctgaggagcactccctctccctgggagctctgcagaggaagagggtctctggcaatcagcatcctctacctccacctctccagcgggcgacccctcagagaaggtctcccacgataagtgtttcggtgttcctgcgtgcggatttgtgctctccggggaggtctgcggcccagaagcccagtgcggcgccaggagccggacccgcgcccgcaccgctcccgggaccgcgaccccggccgcccagagatgaccgcgaccgaagccctcctgcgcgtcctcttgctcctgctggctttcggccacagcacctatggggctgaatgcttcccggcctgcaacccccaaaatggattctgcgaggatgacaatgtttgcaggtgccagcctggctggcagggtcccctttgtgaccagtgcgtgacctctcccggctgccttcacggactctgtggagaacccgggcagtgcatttgcaccgacggctgggacggggagctctgtgatagagatgttcgggcctgctcctcggccccctgt

SEQ ID NO: 8111 - DNA, 2380 bp, Homo sapiens
agatataaggcttggaagccagcagctgcgactcccgagacccccccaccagaaggccatggtctccccacggatgtccgggctcctctcccagactgtgatcctagcgctcattttcctcccccagacacggcccgctggcgtcttcgagctgcagatccactctttcgggccgggtccaggccctggggccccgcggtccccctgcagcgcccggctcccctgccgcctcttcttcagagtctgcctgaagcctgggctctcagaggaggccgccgagtccccgtgcgccctgggcgcggcgctgagtgcgcgcggaccggtctacaccgagcagcccggagcgcccgcgcctgatctcccactgcccgacggcctcttgcaggtgcccttccgggacgcctggcctggcaccttctctttcatcatcgaaacctggagagaggagttaggagaccagattggagggcccgcctggagcctgctggcgcgcgtggctggcaggcggcgcttggcagccggaggcccgtgggcccgggacattcagcgcgcaggcgcctgggagctgcgcttctcgtaccgcgcgcgctgcgagccgcctgccgtcgggaccgcgtgcacgcgcctctgccgtccgcgcagcgccccctcgcggtgcggtccgggactgcgcccctgcgcaccgctcgaggacgaatgtgaggcgccgctggtgtgccgagcaggctgcagccctgagcatggcttctgtgaacagcccggtgaatgccgatgcctagagggctggactggacccctctgcacggtccctgtctccaccagcagctgcctcagccccaggggcccgtcctctgctaccaccggatgccttgtccctgggcctgggccctgtgacgggaacccgtgtgccaatggaggcagctgtagtgagacacccaggtcctttgaatgcacctgcccgcgtgggttctacgggctgcggtgtgaggtgagcggggtgacatgtgcagatggaccctgcttcaacggcggcttgtgtgtcgggggtgcagaccctgactctgcctacatctgccactgcccacccggtttccaaggctccaactgtgagaagagggtggaccggtgcagcctgcagccatgccgcaatggcggactctgcctggacctgggccacgccctgcgctgccgctgccgcgccggcttcgcgggtcctcgctgcgagcacgacctggacgactgcgcgggccgcgcctgcgctaacggcggcacgtgtgtggagggcggcggcgcgcaccgctgctcctgcgcgctgggcttcggcggccgcgactgccgcgagcgcgcggacccgtgcgccgcgcgcccctgtgctcacggcggccgctgctacgcccacttctccggcctcgtctgcgcttgcgctcccggctacatgggagcgcggtgtgagttcccagtgcaccccgacggcgcaagcgccttgcccgcggccccgccgggcctcaggcccggggaccctcagcgctaccttttgcctccggctctgggactgctcgtggccgcgggcgtggccggcgctgcgctcttgctggtccacgtgcgccgccgtggccactcccaggatgctgggtctcgcttgctggctgggaccccggagccgtcagtccacgcactcccggatgcactcaacaacctaaggacgcaggagggttccggggatggtccgagctcgtccgtagattggaatcgccctgaagatgtagaccctcaagggatttatgtcatatctgctccttccatctacgctcgggaggtagcgacgccccttttccccccgctacacactgggcgcgctgggcagaggcagcacctgctttttccctacccttcctcgattctgtccgtgaaatgaattgggtagagtctctggaaggttttaagcccattttcagttctaacttactttcatcctattttgcatccctcttatcgttttgagctacctgccatcttctctttgaaaaacctatgggcttgaggaggtcacgatgccgactccgccagagcttttccactgattgtactcagcggggaggcaggggaggcagaggggcagcctctctaatgcttcctactcattttgtttctaggcctgacgcgtctcctccatccgcacctggagtcagagcgtggatttttgtatttgctcggtggtgcccagtctctgccccagaggctttggagttcaatcttgaaggggtgtctgggggaactttactgttgcaagttgtaaataatggttatttatatcctattttttctcaccccatctctctagaaacacctataaaggctattattgtgatcagttttgact

SEQ ID NO: 8112 - DNA, 2043 bp, Homo sapiens
agatataaggcttggaagccagcagctgcgactcccgagacccccccaccagaaggccatggtctccccacggatgtccgggctcctctcccagactgtgatcctagcgctcattttcctcccccagacacggcccgctggcgtcttcgagctgcagatccactctttcgggccgggtccaggccctggggccccgcggtccccctgcagcgcccggctcccctgccgcctcttcttcagagtctgcctgaagcctgggctctcagaggaggccgccgagtccccgtgcgccctgggcgcggcgctgagtgcgcgcggaccggtctacaccgagcagcccggagcgcccgcgcctgatctcccactgcccgacggcctcttgcaggtgcccttccgggacgcctggcctggcaccttctctttcatcatcgaaacctggagagaggagttaggagaccagattggagggcccgcctggagcctgctggcgcgcgtggctggcaggcggcgcttggcagccggaggcccgtgggcccgggacattcagcgcgcaggcgcctgggagctgcgcttctcgtaccgcgcgcgctgcgagccgcctgccgtcgggaccgcgtgcacgcgcctctgccgtccgcgcagcgccccctcgcggtgcggtccgggactgcgcccctgcgcaccgctcgaggacgaatgtgaggcgccgctggtgtgccgagcaggctgcagccctgagcatggcttctgtgaacagcccggtgaatgccgatgcctagagggctggactggacccctctgcacggtccctgtctccaccagcagctgcctcagccccaggggcccgtcctctgctaccaccggatgccttgtccctgggcctgggccctgtgacgggaacccgtgtgccaatggaggcagctgtagtgagacacccaggtcctttgaatgcacctgcccgcgtgggttctacgggctgcggtgtgaggtgagcggggtgacatgtgcagatggaccctgcttcaacggcggcttgtgtgtcgggggtgcagaccctgactctgcctacatctgccactgcccacccggtttccaaggctccaactgtgagaagagggtggaccggtgcagcctgcagccatgccgcaatggcggactctgcctggacctgggccacgccctgcgctgccgctgccgcgccggcttcgcgggtcctcgctgcgagcacgacctggacgactgcgcgggccgcgcctgcgctaacggcggcacgtgtgtggagggcggcggcgcgcaccgctgctcctgcgcgctgggcttcggcggccgcgactgccgcgagcgcgcggacccgtgcgccgcgcgcccctgtgctcacggcggccgctgctacgcccacttctccggcctcgtctgcgcttgcgctcccggctacatgggagcgcggtgtgagttcccagtgcaccccgacggcgcaagcgccttgcccgcggccccgccgggcctcaggcccggggaccctcagcgctaccttttgcctccggctctgggactgctcgtggccgcgggcgtggccggcgctgcgctcttgctggtccacgtgcgccgccgtggccactcccaggatgctgggtctcgcttgctggctgggaccccggagccgtcagtccacgcactcccggatgcactcaacaacctaaggacgcaggagggttccggggatggtccgagctcgtccgtagattggaatcgccctgaagatgtagaccctcaagggatttatgtcatatctgctccttccatctacgctcgggaggcctgacgcgtctcctccatccgcacctggagtcagagcgtggatttttgtatttgctcggtggtgcccagtctctgccccagaggctttggagttcaatcttgaaggggtgtctgggggaactttactgttgcaagttgtaaataatggttatttatatcctattttttctcaccccatctctctagaaacacctataaaggctattattgtgatcagttttgact

SEQ ID NO: 8113 - DNA, 3339 bp, Homo sapiens
gccgccttggtgcagcgtacaccggcactagcccgcttgcagccccaggattagacagaagacgcgtcctcggcgcggtcgccgcccagccgtagtcacctggattacctacagcggcagctgcagcggagccagcgagaaggccaaaggggagcagcgtcccgagaggagcgcctcttttcagggaccccgccggctggcggacgcgcgggaaagcggcgtcgcgaacagagccagattgagggcccgcgggtggagagagcgacgcccgaggggatggcggcagcgtcccggagcgcctctggctgggcgctactgctgctggtggcactttggcagcagcgcgcggccggctccggcgtcttccagctgcagctgcaggagttcatcaacgagcgcggcgtactggccagtgggcggccttgcgagcccggctgccggactttcttccgcgtctgccttaagcacttccaggcggtcgtctcgcccggaccctgcaccttcgggaccgtctccacgccggtattgggcaccaactccttcgctgtccgggacgacagtagcggcggggggcgcaaccctctccaactgcccttcaatttcacctggccgggtaccttctcgctcatcatcgaagcttggcacgcgccaggagacgacctgcggccagaggccttgccaccagatgcactcatcagcaagatcgccatccagggctccctagctgtgggtcagaactggttattggatgagcaaaccagcaccctcacaaggctgcgctactcttaccgggtcatctgcagtgacaactactatggagacaactgctcccgcctgtgcaagaagcgcaatgaccacttcggccactatgtgtgccagccagatggcaacttgtcctgcctgcccggttggactggggaatattgccaacagcctatctgtctttcgggctgtcatgaacagaatggctactgcagcaagccagcagagtgcctctgccgcccaggctggcagggccggctgtgtaacgaatgcatcccccacaatggctgtcgccacggcacctgcagcactccctggcaatgtacttgtgatgagggctggggaggcctgttttgtgaccaagatctcaactactgcacccaccactccccatgcaagaatggggcaacgtgctccaacagtgggcagcgaagctacacctgcacctgtcgcccaggctacactggtgtggactgtgagctggagctcagcgagtgtgacagcaacccctgtcgcaatggaggcagctgtaaggaccaggaggatggctaccactgcctgtgtcctccgggctactatggcctgcattgtgaacacagcaccttgagctgcgccgactccccctgcttcaatgggggctcctgccgggagcgcaaccagggggccaactatgcttgtgaatgtccccccaacttcaccggctccaactgcgagaagaaagtggacaggtgcaccagcaacccctgtgccaacgggggacagtgcctgaaccgaggtccaagccgcatgtgccgctgccgtcctggattcacgggcacctactgtgaactccacgtcagcgactgtgcccgtaacccttgcgcccacggtggcacttgccatgacctggagaatgggctcatgtgcacctgccctgccggcttctctggccgacgctgtgaggtgcggacatccatcgatgcctgtgcctcgagtccctgcttcaacagggccacctgctacaccgacctctccacagacacctttgtgtgcaactgcccttatggctttgtgggcagccgctgcgagttccccgtgggcttgccgcccagcttcccctgggtggccgtctcgctgggtgtggggctggcagtgctgctggtactgctgggcatggtggcagtggctgtgcggcagctgcggcttcgacggccggacgacggcagcagggaagccatgaacaacttgtcggacttccagaaggacaacctgattcctgccgcccagcttaaaaacacaaaccagaagaaggagctggaagtggactgtggcctggacaagtccaactgtggcaaacagcaaaaccacacattggactataatctggccccagggcccctggggcgggggaccatgccaggaaagtttccccacagtgacaagagcttaggagagaaggcgccactgcggttacacagtgaaaagccagagtgtcggatatcagcgatatgctcccccagggactccatgtaccagtctgtgtgtttgatatcagaggagaggaatgaatgtgtcattgccacggaggtataaggcaggagcctacctggacatccctgctcagccccgcggctggaccttccttctgcattgtttacattgcatcctggatgggacgtttttcatatgcaacgtgctgctctcaggaggaggagggaatggcaggaaccggacagactgtgaacttgccaagagatgcaatacccttccacacctttgggtgtctgtctggcatcagattggcagctgcaccaaccagaggaacagaagagaagagagatgccactgggcactgccctgccagtagtggccttcagggggctccttccggggctccggcctgttttccagagagagtggcagtagccccatggggcccggagctgctgtggcctccactggcatccgtgtttccaaaagtgcctttggcccaggctccacggcgacagttgggcccaaatcagaaaggagagagggggccaatgagggcagggcctcctgtgggctggaaaaccactgggtgcgtctcttgctggggtttgccctggaggtgaggtgagtgctcgagggaggggagtgctttctgccccatgcctccaactactgtatgcaggcctggctctctggtctaggccctttgggcaagaatgtccgtctacccggcttccaccaccctctggccctgggcttctgtaagcagacaggcagagggcctgcccctcccaccagccaagggtgccaggcctaactggggcactcagggcagtgtgttggaaattccactgagggggaaatcaggtgctgcggccgcctgggccctttcctccctcaagcccatctccacaacctcgagcctgggctctggtccactactgccccagaccaccctcaaagctggtcttcagaaatcaataatatgagtttttattttgtttttttttttttttttgtagtttattttggagtctagtatttcaataatttaagaatcagaagcactgacctttctacattttataacattattttgtatataat

SEQ ID NO: 8114 - DNA, 5868 bp, Homo sapiens
tactcacccggcaggccgctctcctcggtgcagacagcacagggaggagggggaagcggctctgccgggaacagggagggacctccagggaagcgaaactgaaactttgcgcccagtccgcagggcgggccgcgcctttaccgcccagctgcctcccggagcccccgcgccctcccgacgcgcagagccatggcctcccacctgcgcccgccgtccccgctcctcgtgcgggtgtacaagtccggcccccgagtacgaaggaagctggagagctacttccagagctctaagtcctcgggcggcggggagtgcacggtcagcacccaggaacacgaagccccgggcaccttccgggtggagttcagtgaaagggcagctaaggagagagtgttgaaaaaaggagagcaccaaatacttgttgacgaaaaacctgtgcccattttcctggtacccactgaaaattcaataaagaagaacacgagacctcaaatttcttcactgacacaatcacaagcagaaacaccgtctggtgatatgcatcaacatgaaggacatattcctaatgctgtggattcctgtctccaaaagatctttcttactgtaacagctgacctgaactgtaacctgttctccaaagagcagagggcatacataaccacactgtgccctagtatcagaaaaatggaaggtcacgatggaattgagaaggtgtgtggtgacttccaagacattgaaagaatacatcaatttttgagtgagcagttcctggaaagtgagcagaaacaacaattttccccttcaatgacagagaggaagccactcagtcagcaggagagggacagctgcatttctccttctgaaccagaaaccaaggcagaacaaaaaagcaactattttgaagttcccttgccttactttgaatactttaaatatatctgtcctgataaaatcaactcaatagagaaaagatttggtgtaaacattgaaatccaggagagttctccaaatatggtctgtttagatttcacctcaagtcgatcaggtgacctggaagcagctcgtgagtcttttgctagtgaatttcagaagaacacagaacctctgaagcaagaatgtgtctctttagcagacagtaagcaggcaaataaattcaaacaggaattgaatcaccagtttacaaagctccttataaaggagaaaggaggcgaattaactctccttgggacccaagatgacatttcagctgccaaacaaaaaatctctgaagcttttgtcaagatacctgtgaaactatttgctgccaattacatgatgaatgtaattgaggttgatagtgcccactataaacttttagaaactgaattactacaggagatatcagagatcgaaaaaaggtatgacatttgcagcaaggtttctgagaaaggtcagaaaacctgcattctgtttgaatccaaggacaggcaggtagatctatctgtgcatgcttatgcaagtttcatcgatgcctttcaacatgcctcatgtcagttgatgagagaagttcttttactgaagtctttgggcaaggagagaaagcacttacatcagaccaagtttgctgatgactttagaaaaagacatccaaatgtacactttgtgctaaatcaagagtcaatgactttgactggtttgccaaatcaccttgcaaaggcgaagcagtatgttctaaaaggaggaggaatgtcttcattggctggaaagaaattgaaagagggtcatgaaacaccgatggacattgatagcgatgattccaaagcagcttctccgccactcaagggctctgtgagttctgaggcctcagaactggacaagaaggaaaagggcatctgtgtcatctgtatggacaccattagtaacaaaaaagtgctaccaaagtgcaagcatgaattctgcgccccttgtatcaacaaagccatgtcatataagccaatctgtcccacatgccagacttcctatggtattcagaaaggaaatcagccagagggaagcatggttttcactgtttcaagagactcacttccaggttatgagtcctttggcaccattgtgattacttattctatgaaagcaggcatacaaacagaagaacacccaaacccaggaaagagataccctggaatacagcgaactgcatacttgcctgataataaggaaggaaggaaggttttgaaactgctttatagggcctttgaccaaaagctgatttttacagtggggtactctcgcgtattaggagtctcagatgtcatcacttggaatgatattcaccacaaaacatcccggtttggaggaccagaaatgtatggctatcctgatccttcttacctgaaacgtgtcaaagaggagctgaaagccaaaggaattgagtaagacaactgctggaagatgtcttaaatcaagctttcaaaaaaatatattttaggaggctgatttaatgccagtctaaatccttatgtagaaaggactttgaaatttttcttctcaagaaatggtttgtataagaataacaatctgctagtctgtcatttctggagtgatacttttttttttgagacggagtctgctctgtcgctcgcgctggagtgcagtggcatgatctcggctcactgcaagctccgcctcccaggttcatgccattctcctacctcagcctcccgagtagctgggactacaggcgcccaccaccatgcccggctaatttttgtttttgtatttttagtagagacagggtttcactgtgttagccaggatggtctcgatctcctgacctcgtgatccgcccgcctcagccttccaaagtgttgggattataggcgtgagccaccgcgcccagccctggagtgatactttttatggaagacaaaagccccccaaatctgtgtaaaatctgctgcaaaggtgtcatccctcttgtgtcatcactggggttagaggtgggtccgaaataatcttctgtgtccttcagttggactctcggctgccaattgatctctttttcattgccatctctggggtggttctttggttttttgtgtgttttccccttcatctctacctgtgaaagtgaaattctattgtaaatgggaggaaaaagggttggttgtgaaaaattaaagacccacattctgctttcttactcatggtaagaaaagtggccatgagtagagattgggcaagcattggtaataaatggaataagactattattattattatttgagatggagtctcactctgtcacccaggctggaatgcagtggtgtgatcttggctcactgcaacctccacttcccgggttcaagcgattctcctgcctcagcctcctgagtagctgggattacaggtgtgtgcctccacacccggctaattttttgtatttttagtagagacggggttttgccatgttggccaggctggtttcaaactcctgagctcaaatgatcctcctgccttggcctcccaaagtgctggaattacaggcatgagccaccacacccacacaagactatcatttttaatgaccaagagcctagtatatagttggtgcctgtcttagtctgtttgtgttgctataaaagaacacctgagactgggtaattgataaagaaaaaggtttgtttggctcacaattttgctggctagaaggttgggcatccggtgaaagcctcaggctgcttccattcatagcaaagggcagccagtgtgtgcagaaatcaaatgacagagaggaagtgagagagagaggtgtcggggaggtgccaggctctttttaacaagcagttcttcaggaactaagagtgagtcactcccatgagaacagcaccaagccattcatgggggaatctgcccccatgacccagacccctcccgttaggcttcacctccaacactgaggatcaaatttcaacatgagatttggaggaggtcaaacaaactaaactgtagcagtgtttcataaaattgtttgcctgactcaggttgctagtaagccagcagagggatatttgcctcctaaatctttggcagaggcaggagtaaggaagccatttctggagtccttgctactaatttggaaaactgagcttctttctttcattgctttttcccttaagagacaagtccttactatattgccctgtctctcaagggaagacatcaagactggacttgaactcctgggctcaagccatcccccaaccttggcctctcgagtagatgggattataggcatgtgccacggtgcctgacttgagtttcttattctagaacacttggagcctgaactctgaccaggcccctcacttgagcctttgctttctgctccttgtaaactgccatattgggtgcacttgccctgccacagtaatgctatatatttctgagcattgtttttctctagataattttatatttttgagtataccccacttccaagtgttttttgttttgttttgctttgtttttgttgttgttgttttgagacagggtctcactgtgtcccccaggctggagtgcagtggcacaatgacgactcactgcagcctcaacctcctggggccaagtgatcctcccacctcagcctctcaagtggctgggaccacagaagtgcaccaccatgcctggcttttttttttttttttggtcgagatggggtgtccctgtgttgcccagactggtcttgaactcctggactcaagggatcctcctgtcttgggctcccaaagtgttgggattacaggcgtgagtgaccatgcctagctcacttccaggtttaacagacaaaataaacttactctagtttccatctctatcattttataataaccgtagcccacattgtagtagtttttcagctctttactaagtcccaccaattcatgttttcacccttaaaatctttctcactgatactctctctggacagaaaaaaggtgaaataagcctactataaggaatatatgacatgctaaattttatttttaaacggttcttcaagtcagattaaagtaataatagcaaattatgtgattatccatgtcccagcctctctccaaaaaaatagtaaacaagatgtcttcttcttttcccaaagatacacatacacacatgtacaaatttttttatcagataataatagctaatatttaatgagtacttaccttagtttgtcccctttacaacagctttacatctgtgtgattgatacagttcatattcccattttataactgagaaaactggtgcacagagaggataagcaacttgccaaaggtcacacagttaataagtggaaatgctggggtatgaaccaggtagtctgcccccatagctctgccccccagagctgtactgtctcccatgagggtacttctccatggagcagcctgaggcgatccctttattctgggcttctctcagaaatggattcccacacagtattcaaagcaaatttccccagaggaaatcctattggaagaacttaaaaactcagaatctttttctttgtccagagagttgaggaagcttaagctaaatgatacatgtttttaaaaaaaaatcagattataaatttagtttttggtgattcattaaattctttactattatagttattttctagctgttcatcttttagctaaatttgttccaaagaagcaaaagtttggtttctactaagttctggattctggatgggagattgcactgtgtgtgacatgcaagtttcatggtgtgggagattgcagagcatttgggttactgcttttactctttggaagctgttatcatctgtatctgctttaaataaagttaaagatttggaacaaa

SEQ ID NO: 8115 - DNA, 3455 bp, Homo sapiens
gcgagaagccccactgaagccgggcgcagggtctgggacgcagttgggagtgcaaagggctggctgagagccgcaggagcagcaggctgtggcccaggcctcctgggtgacaggccctgtctggcggggaagagggaccaagagacaacacggaagaggctggacctcgaacaggggcggctgcctcactccctacctgagccagccgagggggccaaggactttagagctgtttcctccggcataagagagacacttgctttccagggcagcaccctttatcggagaaggctctacagggaaggggtctttgcagcctggatggccatcccacattcctttaacggaggtctctaggcctcagagagaacccagagttagaaaggaggccagacggtccttgctgtccccctggggagagaggaagttgccgcctgctgccaggcccaggaggagctgggcctgcaatagtgggggacctggcccctgaggcagtggcggccatgtcacggccaggccacggtgggctgatgcctgtgaatggtctgggcttcccaccgcagaacgtggcccgggtggtggtgtgggagtggctgaatgagcacagccgctggcggccctacacggccaccgtgtgccaccacattgagaacgtgctgaaggaggacgctcgcggttccgtggtcctggggcaggtggacgcccagcttgtgccctacatcatcgacctgcagtccatgcaccagtttcgccaggacacaggcaccatgcggcccgtgcggcgcaacttctacgacccgtcgtcggcgccgggcaagggcatcgtgtgggagtgggagaacgacggcggcgcatggacggcctacgatatggacatctgcatcaccatccagaacgcctacgagaagcagcacccgtggctcgacctctcatcgctaggcttctgctacctcatctacttcaacagcatgtcgcagatgaaccgccagacgcgccggcgccgccgcctgcgccgccgcctggacctcgcctacccgctcaccgtgggctccatccctaagtcgcagtcgtggcccgtgggcgccagctcgggccagccctgctcctgccagcagtgcctgctggtcaacagcacgcgcgccgcctccaacgccatcctggcctcgcagcgccgcaaggcgccccccgcgcccccgctgccgccgccgccgccacctggagggcctccaggcgcgcttgccgtgcgccccagcgccaccttcacaggcgccgcgctctgggcagcgcccgccgccggccccgccgagcccgcgccgcctcccggggcgcccccacggagcccgggcgcccccggcggagcgcgcaccccggggcagaacaacctcaaccggcccgggccccagcgcaccaccagcgtgagcgcgcgcgcctccatcccgccgggggtccccgcactcccggtgaagaacttgaatggtactgggccggtccatccggccctggcagggatgaccgggatactgctgtgcgcggccgggctgcccgtgtgcctgacgcgggcccccaagcccatcctgcacccgccgcccgtgagcaagagcgacgtgaagcccgtgcctggcgtgcccggggtgtgccgcaagaccaagaagaagcaccttaaaaagagtaagaatcccgaggatgtggttcgaagatacatgcagaaggtgaaaaacccacctgatgaggactgcaccatctgcatggagcgactggtcacagcatcaggctacgagggcgtgcttcggcacaagggcgtgcggcctgagctcgtgggccgcctgggccgctgtggccacatgtaccacctgctgtgcctcgtggccatgtactccaatggcaacaaggatggcagcctgcagtgccccacctgcaaggccatctacggggagaagacgggtacgcagccgcctgggaagatggagttccacctcatcccccactcgctgcccggcttccctgatacccagaccatccgcatcgtctatgacatccccacaggcatccagggccctgagcaccccaaccccgggaagaagttcaccgcaagaggattccctcgccactgctatctacccaacaacgagaaaggccggaaggtgctgcggctgctcatcacggcctgggagagaagactcatcttcactatcggcacgtccaacaccacgggcgagtcggacaccgtggtgtggaacgagatccaccacaagaccgagtttggatccaacctcacgggccacggctacccggacgctagctacctagacaacgtgctggctgagctcacagcccagggcgtatccgaggctgcagccaaggcttgaggcccaaggctgcccaccttccctcctgctttgcccctggtccggcaaatgcctccttcgccaggtgtgtcctggtagcccaggttcagggctggggaggagcctgcggaaggggccgcagccattcaggggacctgcctggtggcagctgggatgaagagagatggcatgtcaggctggccccgaatcatagctccctgagagggccaagcagagagtactggaaacctccctaccaaaaagacagagacccgccccctcacacacaaacacacatgtcctgttgaactcatgcacgcacacccacgtgcctgtacttgcccccaggctggaagagaagagacagaaagaccccatgacccccccatgtggatccccatctgtgtctcagttgcatctgtacagccttgtctgcaaactggaggatgcggggcaagcccttaggggcctgccagggctcggggggcaaagagggactcgggaaactcagtgtaccccagatgcctcacccattccgtgtcatcacccatgtctgccacccactgattgggcaattgtgggcccatggggtggaagcccccagatgactgagcagttctacaaaagaatggccagcacgagcggggactagagggtcctgattttgtgtctgtgcctcttcatctctctggactctgatctccttctcccttcccatctccaggccttctgtctgtcccagataaaggcgctgttctcccatcctccctaccccatcctctccaccaaatcgctcccaattttgagagccaaaggctggcgcttctgacttcaggagcgaaaggaggaggcctagtttgggccgatgtattttaaagcagagtggacagcagagagtcaatttccctttcgttgggagtgggcagtggggtggctaattgtcttcggccaaccaggggcctgttgcccaggcaactcaccagctccgcctctgctgattggctgccacggtgggagtcagccaagatttaaagggatgccagcgattgctcttttcaaaacctaccagtcccactgtgggtggagaaataaatggtctttctcctcctc

SEQ ID NO: 8116 - DNA, 2029 bp, Homo sapiens
ctcagtcatgtgaccggcaatggcggcgctgacgagagctgcatttggaagtgttgtggagacagccccgtagcccaatgcgaccagactcagggaaaacatcaggcccctccagctgagcccttgtgtgagccccgcccctccctaaatgccagacttgggagctgacagacagcactgcctgtgctgggtttaaaagtcctggtcagctgagtggaaatagaaggatttctgctgccatcatcttccatgggctttccaggtcacacgacctacaagtagggagcagggaaagaagagtgagcctgcatgccaattctaagctcttcaggatcaaatgtcgttcgtcctgtccagaatggcagcctgtggaggcacctgcaagaacaaagtgactgtgtccaagcccgtgtgggacttcctgagcaaagagaccccagcccggctggcccggcttcgggaggagcaccgtgtgtccatcctcatagatggcgagacttctgacatctatgttctccagctttccccacagggtcctcccccggcccctccaaatgggctctacctagcccggaaggctctcaaggggctgctaaaagaggcagagaaagagctgaagaaagctcagaggcagggggagctgatgggctgcctggctctggggggtggaggggagcaccctgagatgcaccgcgcaggcccaccccctctccgagcagccccacttctgcccccaggagctcgggggctcccccctcctcctccccccctgcccccacctcttcctcctcgccttcgggaggaggcagaagagcaggagagcacctgccccatctgtctgggggagatccagaatgccaagacattggagaagtgccggcattcattctgcgagggctgcatcacccgggctctgcaggtgaaaaaggcctgccccatgtgcggccgcttctatgggcagctggtgggcaaccagccccagaatgggcggatgctggtctctaaggacgccaccctcctactgcccagctatgagaagtacggcaccattgtcatccagtacgtcttcccgcccggtgtccagggggctgaacacccaaacccaggagttcggtatcctggcaccacacgggtggcctacctcccggactgccctgagggcaacaaggtgctgaccctgttccgcaaggcgtttgaccagcgtctcaccttcactatcggcacgtccatgaccacagggagaccgaatgtcatcacctggaacgacatccaccacaagaccagctgcacagggggaccccagctgtttgggtacccagaccccacctacctgacccgggtgcaagaggagctgagagcgaagggtatcacagatgactgaaggacatcgcctttgccaaggcccctgctgtctgcctctactaggacccagcagaagcctctttctcctctctgccccctgccccccacaccacacctgtaggggacctgtctgactgggaagggagttccgagagggagggggcaatcccttcccccatcccccactggccaagtgtttcaatgcagtgtgagccactcccttctggcagaggccgacctccaaggctctgttctcccctccccgtgtacatatactcccggtttccctgcccctccattgcccttggctttttctggtatgtgctgtgctccacgaccaagccgagaaaggacctagggtggggaagggagggtctcttgattcctaaccgcccccacatactgctccaccgctgaacttcgggtgccggggaggagaaattgggctgatgtgagctccccgtcacccgccatggagccggctgtgtgtgttcatcagatacagttctcccttaaccttgtcctttctctcctgtgtctcagtctccgtcagtctgtctttctccgctcttctctgacccctgtgaggaacctccttaccctgttctggaatcgctgccagactgtagcttttaatttaataaaaataaagtaaaatatgcaactc

SEQ ID NO: 8117 - DNA, 3199 bp, Homo sapiens
agtcatgtgaccggcaatggcggcgctgacgagaggtaggtgagcccggcgccccccacacccaccgcgcgccccccgggccccgctcgcacccctcacgcgccccccgctcccccggcgccccctcctccacctcccctccccgcgcgcggctccgggctccccgctccgtgcccggccgatcatctttctagcaccctccagccttggcctccattcgggggttctgagggctgcgatcgggccgacatgcacccccacccggcggtggggatccgggggctttggctactgagggatgtggggagttggttccgggtcgggtcttggaggaggccgtggggggagggcgggagctgcttcagtggatgcccccagggacccttgcccatccgggctgtgcctccctctggcctctgtctggagggagagactggttccttgtccggcctgggttgccacagaggaatcacagacccaccctaaactggggccccgcctcccttttctgtgccagcaggacttggacctaggacacctaggtcctgggtcccccgtgatggggagagaagtgttgcatcgcggatagactgtatgggctgagactctagggttccattttcacttatgaatctcgaggtgcatctggccttgggggacgatgatggaggcatgaagggacagctgctccttcttggatcagtcaataaatggaggtcacactaatggcccttctttctgtttgagctgcatttggaagtgttgtggagacagccccgtagcccaatgcgaccagactcagggaaaacatcaggcccctccagctgagcccttgtgtgagccccgcccctccctaaatgccagacttgggagctgacagacagcactgcctgtgctgggtttaaaaggtgacaatgagaactttgttattgcaggggctgctgccactttgttcacatccttaacagacttcagcagaagggactgagttagctctcaaggaaggctccctggcaataggggctgaattatttggcaatgtggagcaggcgaggagttggggagcataggaaatattccggtccatgtgatctgagggaggtggcaagaagacctccacctgtgtgggcgttttctttcctgacttctcttatgtgtgccctaggctttcttgggggcctcagagctggggaagaaaggaggaaggttagcatgttgaagttccttcttgagcaacttggggagaagctgataatggaattctgcagagaagagaggagatggaaggggagtttttatttctgggttggctgaggggaatggtaacatttgccatcataactttttacccttcccccactcccagtcctggtcagctgagtggaaatagaaggatttctgctgccatcatcttccatgggctttccaggtcacacgacctacaagtagggagcagggaaagaagagtgagcctgcatgccaattctaagctcttcaggatcaaatgtcgttcgtcctgtccagaatggcagcctgtggaggcacctgcaagaacaaagtgactgtgtccaagcccgtgtgggacttcctgagcaaagagaccccagcccggctggcccggcttcgggaggagcaccgtgtgtccatcctcatagatggcgagacttctgacatctatgttctccagctttccccacagggtcctcccccggcccctccaaatgggctctacctagcccggaaggctctcaaggggctgctaaaagaggcagagaaagagctgaagaaagctcagaggcagggggagctgatgggctgcctggctctggggggtggaggggagcaccctgagatgcaccgcgcaggcccaccccctctccgagcagccccacttctgcccccaggagctcgggggctcccccctcctcctccccccctgcccccacctcttcctcctcgccttcgggaggaggcagaagagcaggagagcacctgccccatctgtctgggggagatccagaatgccaagacattggagaagtgccggcattcattctgcgagggctgcatcacccgggctctgcaggtgaaaaaggcctgccccatgtgcggccgcttctatgggcagctggtgggcaaccagccccagaatgggcggatgctggtctctaaggacgccaccctcctactgcccagctatgagaagtacggcaccattgtcatccagtacgtcttcccgcccggtgtccagggggctgaacacccaaacccaggagttcggtatcctggcaccacacgggtggcctacctcccggactgccctgagggcaacaaggtgctgaccctgttccgcaaggcgtttgaccagcgtctcaccttcactatcggcacgtccatgaccacagggagaccgaatgtcatcacctggaacgacatccaccacaagaccagctgcacagggggaccccagctgtttgggtacccagaccccacctacctgacccgggtgcaagaggagctgagagcgaagggtatcacagatgactgaaggacatcgcctttgccaaggcccctgctgtctgcctctactaggacccagcagaagcctctttctcctctctgccccctgccccccacaccacacctgtaggggacctgtctgactgggaagggagttccgagagggagggggcaatcccttcccccatcccccactggccaagtgtttcaatgcagtgtgagccactcccttctggcagaggccgacctccaaggctctgttctcccctccccgtgtacatatactcccggtttccctgcccctccattgcccttggctttttctggtatgtgctgtgctccacgaccaagccgagaaaggacctagggtggggaagggagggtctcttgattcctaaccgcccccacatactgctccaccgctgaacttcgggtgccggggaggagaaattgggctgatgtgagctccccgtcacccgccatggagccggctgtgtgtgttcatcagatacagttctcccttaaccttgtcctttctctcctgtgtctcagtctccgtcagtctgtctttctccgctcttctctgacccctgtgaggaacctccttaccctgttctggaatcgctgccagactgtagcttttaatttaataaaaataaagtaaaatatgcaactcttt

SEQ ID NO: 8118 - DNA, 2067 bp, Homo sapiens
catttttgttttggggaggaagggcaggggcttgcggatagaagggggtcaaaggaacggtgattatcacctgtgaggggaaagggggtgctgtcctccctccttcccttttcctcagcctgcaccccctgcaatcccccacctttcggggtctccccctccttgttgctaaggcccggaccgtcatcccagcaacagcctcagtcatgtgaccggcaatggcggcgctgacgagagtcctggtcagctgagtggaaatagaaggatttctgctgccatcatcttccatgggctttccaggtcacacgacctacaagtagggagcagggaaagaagagtgagcctgcatgccaattctaagctcttcaggatcaaatgtcgttcgtcctgtccagaatggcagcctgtggaggcacctgcaagaacaaagtgactgtgtccaagcccgtgtgggacttcctgagcaaagagaccccagcccggctggcccggcttcgggaggagcaccgtgtgtccatcctcatagatggcgagacttctgacatctatgttctccagctttccccacagggtcctcccccggcccctccaaatgggctctacctagcccggaaggctctcaaggggctgctaaaagaggcagagaaagagctgaagaaagctcagaggcagggggagctgatgggctgcctggctctggggggtggaggggagcaccctgagatgcaccgcgcaggcccaccccctctccgagcagccccacttctgcccccaggagctcgggggctcccccctcctcctccccccctgcccccacctcttcctcctcgccttcgggaggaggcagaagagcaggagagcacctgccccatctgtctgggggagatccagaatgccaagacattggagaagtgccggcattcattctgcgagggctgcatcacccgggctctgcaggtgaaaaaggcctgccccatgtgcggccgcttctatgggcagctggtgggcaaccagccccagaatgggcggatgctggtctctaaggacgccaccctcctactgcccagctatgagaagtacggcaccattgtcatccagtacgtcttcccgcccggtgtccagggggctgaacacccaaacccaggagttcggtatcctggcaccacacgggtggcctacctcccggactgccctgagggcaacaaggtgctgaccctgttccgcaaggcgtttgaccagcgtctcaccttcactatcggcacgtccatgaccacagggagaccgaatgtcatcacctggaacgacatccaccacaagaccagctgcacagggggaccccagctgtttgggtacccagaccccacctacctgacccgggtgcaagaggagctgagagcgaagggtatcacagatgactgaaggacatcgcctttgccaaggcccctgctgtctgcctctactaggacccagcagaagcctctttctcctctctgccccctgccccccacaccacacctgtaggggacctgtctgactgggaagggagttccgagagggagggggcaatcccttcccccatcccccactggccaagtgtttcaatgcagtgtgagccactcccttctggcagaggccgacctccaaggctctgttctcccctccccgtgtacatatactcccggtttccctgcccctccattgcccttggctttttctggtatgtgctgtgctccacgaccaagccgagaaaggacctagggtggggaagggagggtctcttgattcctaaccgcccccacatactgctccaccgctgaacttcgggtgccggggaggagaaattgggctgatgtgagctccccgtcacccgccatggagccggctgtgtgtgttcatcagatacagttctcccttaaccttgtcctttctctcctgtgtctcagtctccgtcagtctgtctttctccgctcttctctgacccctgtgaggaacctccttaccctgttctggaatcgctgccagactgtagcttttaatttaataaaaataaagtaaaatatgcaactc

SEQ ID NO: 8119 - DNA, 1331 bp, Homo sapiens
ggaagggcaggggcttgcggatagaagggggtcaaaggaacggtgattatcacctgtgaggggaaagggggtgctgtcctccctccttcccttttcctcagcctgcaccccctgcaatcccccacctttcggggtctccccctccttgttgctaaggcccggaccgtcatcccagcaacagcctcagtcatgtgaccggcaatggcggcgctgacgagaggacttggacctaggacacctaggtcctgggtcccccgtgatggggagagaagtgttgcatcgcggatagactgtatgggctgagactctagggttccattttcacttatgaatctcgaggtgcatctggccttgggggacgatgatggaggcatgaagggacagctgctccttcttggatcagtcaataaatggaggtcacactaatggcccttctttctgtttgagctgcatttggaagtgttgtggagacagccccgtagcccaatgcgaccagactcagggaaaacatcaggcccctccagctgagcccttgtgtgagccccgcccctccctaaatgccagacttgggagctgacagacagcactgcctgtgctgggtttaaaagtcctggtcagctgagtggaaatagaaggatttctgctgccatcatcttccatgggctttccaggtcacacgacctacaagtagggagcagggaaagaagagtgagcctgcatgccaattctaagctcttcaggatcaaaaatggcagcctgtggaggcacctgcaagaacaaagtgactgtgtccaagcccgtgtgggacttcctgagcaaagagaccccagcccggctggcccggcttcgggaggagcaccgtgtgtccatcctcatagatggcgagacttctgacatctatgttctccagctttccccacagggtcctcccccggcccctccaaatgggctctacctagcccggaaggctctcaaggggctgctaaaagaggcagagaaagagctgaagaaagctcagaggcagggggagctgatgggctgcctggctctggggggtggaggggagcaccctgagatgcaccgcgcaggcccaccccctctccgagcagccccacttctgcccccaggagctcgggggctcccccctcctcctccccccctgcccccacctcttcctcctcgccttcgggaggaggcagaagagcaggagagcacctgccccatctgtctgggggagatccagaatgccaagacattggagaagtgccggcattcattctgcgagggctgcatcacccgggctctgcaggtgaaaaaggcctgccccatgt

SEQ ID NO: 8120 - DNA, 569 bp, Homo sapiens
atttttgttttggggaggaagggcaggggcttgcggatagaagggggtcaaaggaacggtgattatcacctgtgaggggaaagggggtgctgtcctccctccttcccttttcctcagcctgcaccccctgcaatcccccacctttcggggtctccccctccttgttgctaaggcccggaccgtcatcccagcaacagcctcagtcatgtgaccggcaatggcggcgctgacgagaggctttcttgggggcctcagagctggggaagaaaggaggaaggttagcatgttgaagttccttcttgagcaacttggggagaagctgataatggaattctgcagagaagagaggagatggaaggggagtttttatttctgggttggctgaggggaatggtaacatttgccatcataactttttacccttcccccactcccagtcctggtcagctgagtggaaatagaaggatttctgctgccatcatcttccatgggctttccaggtcacacgacctacaagtagggagcagggaaagaagagtgagcctgcatgccaattctaagctcttcag

SEQ ID NO: 8121 - DNA, 1840 bp, Homo sapiens
ccggcaatggcggcgctgacgagagtcctggtcagctgagtggaaatagaaggatttctgctgccatcatcttccatgggctttccaggtcacacgacctacaagtagggagcagggaaagaagagtgagcctgcatgccaattctaagctcttcaggatcaaaaatggcagcctgtggaggcacctgcaagaacaaagtgactgtgtccaagcccgtgtgggacttcctgagcaaagagaccccagcccggctggcccggcttcgggaggagcaccgtgtgtccatcctcatagatggcgagacttctgacatctatgttctccagctttccccacagggtcctcccccggcccctccaaatgggctctacctagcccggaaggctctcaaggggctgctaaaagaggcagagaaagagctgaagaaagctcagaggcagggggagctgatgggctgcctggctctggggggtggaggggagcaccctgagatgcaccgcgcaggcccaccccctctccgagcagccccacttctgcccccaggagctcgggggctcccccctcctcctccccccctgcccccacctcttcctcctcgccttcgggaggaggcagaagagcaggagagcacctgccccatctgtctgggggagatccagaatgccaagacattggagaagtgccggcattcattctgcgagggctgcatcacccgggctctgcaggtgaaaaaggcctgccccatgtgcggccgcttctatgggcagctggtgggcaaccagccccagaatgggcggatgctggtctctaaggacgccaccctcctactgcccagctatgagaagtacggcaccattgtcatccagtacgtcttcccgcccggtgtccagggggctgaacacccaaacccaggagttcggtatcctggcaccacacgggtggcctacctcccggactgccctgagggcaacaaggtgctgaccctgttccgcaaggcgtttgaccagcgtctcaccttcactatcggcacgtccatgaccacagggagaccgaatgtcatcacctggaacgacatccaccacaagaccagctgcacagggggaccccagctgtttgggtacccagaccccacctacctgacccgggtgcaagaggagctgagagcgaagggtatcacagatgactgaaggacatcgcctttgccaaggcccctgctgtctgcctctactaggacccagcagaagcctctttctcctctctgccccctgccccccacaccacacctgtaggggacctgtctgactgggaagggagttccgagagggagggggcaatcccttcccccatcccccactggccaagtgtttcaatgcagtgtgagccactcccttctggcagaggccgacctccaaggctctgttctcccctccccgtgtacatatactcccggtttccctgcccctccattgcccttggctttttctggtatgtgctgtgctccacgaccaagccgagaaaggacctagggtggggaagggagggtctcttgattcctaaccgcccccacatactgctccaccgctgaacttcgggtgccggggaggagaaattgggctgatgtgagctccccgtcacccgccatggagccggctgtgtgtgttcatcagatacagttctcccttaaccttgtcctttctctcctgtgtctcagtctccgtcagtctgtctttctccgctcttctctgacccctgtgaggaacctccttaccctgttctggaatcgctgccagactgtagcttttaatttaataaaaataaagtaaaatatgcaactcttta

SEQ ID NO: 8122 - DNA, 561 bp, Homo sapiens
atttttgttttggggaggaagggcaggggcttgcggatagaagggggtcaaaggaacggtgattatcacctgtgaggggaaagggggtgctgtcctccctccttcccttttcctcagcctgcaccccctgcaatcccccacctttcggggtctccccctccttgttgctaaggcccggaccgtcatcccagcaacagcctcagtcatgtgaccggcaatggcggcgctgacgagaggctttcttgggggcctcagagctggggaagaaaggaggaagtcctggtcagctgagtggaaatagaaggatttctgctgccatcatcttccatgggctttccaggtcacacgacctacaagtagggagcagggaaagaagagtgagcctgcatgccaattctaagctcttcaggatcaaatgtcgttcgtcctgtccagaatggcagcctgtggaggcacctgcaagaacaaagtgactgtgtccaagcccgtgtgggacttcctgagcaaagagaccccagcccggctggcccggcttcgggaggagcaccgtgtgtccatcct

SEQ ID NO: 8123 - DNA, 3749 bp, Homo sapiens
ggccggggtggggtggggcaggatgctggatggcccactgttctccgaggggcctgacagcccccgggagctccaggatgaggagtctggcagctgcctctgggtgcagaagtccaagctattggtgatagaagtgaagactatttcctgtcattatagtcgccgcgccccttctcgacagcccatggacttccaggccagccactgggctcgcgggttccagaaccgcacgtgtgggccgcgcccgggatccccacagccgccgccccgccggccctgggcctccagggtgctgcaggaggcgaccaactggcgggcggggcccctggccgaggtccgagctcgggagcaagagaaaaggaaagcggcgtcgcaggagcgggaggccaaggagaccgagcgaaaaaggcgcaaggctggtggggcccgacggagccccccgggtcgaccccgcccggagccccgcaacgcccctcgggtggcccagctggcagggctccctgctcccttgcggccggagcgcctggcgcctgtggggcgagcgccccgtccatccgcgcagccgcagagcgacccagggtcggcgtgggcggggccctggggaggtcggcggcccgggcccccaagctacgaggctcacctgctgctgagaggttctgccgggaccgccccacgacgccgctgggaccggccgccaccctacgtggctccaccttcttacgaaggcccccataggaccttggggactaagagaggccccgggaactctcaggtgcccacttcatcagccccagctgcgactccagccaggacagacggagggcgcacaaagaagaggctggatcctcggatctaccgggacgtcctcggggcttggggtctccgacaggggcaaggtctcttggggggatccccaggctgtggagcggccagagcaaggccagagcccggcaagggggtcgtggagaaaagcctggggctggctgctgctgacctgaacagtggtagcgacagccatccccaagccaaagctacagggagcgcaggcaccgagatagctcctgcggggtctgcaactgcggctccctgtgccccgcatcccgctcccagatccaggcaccacctcaagggctcgagggaagggaaagaaggagaacagatctggtttcccaaatgctggattccctcccctaaaaagcagccgccccgccatagccagacactccccagaccctgggctcccggaggcaccggatggagagaatctctgggtcttggagagggggcaggaccggagaccctggagggttggaaggcgacccgccgtgcccacaccttgccccgcagttcccagggcctgtcccgtggggaaggcgtctttgtcattgacgccacgtgcgtagtgatacgatcccaatatgttccaaccccccgaacccagcaggtgcagcttttgccctctggggtgacacgcgtggtgggggattcccccagccaatcgaagcccggcaaggaggagggtgaaggggccacggtctttccttccccttgtcaaaagcggctgtcgagcagtcgccttttacaccagcccggcgggggccgcgggggcgaagctgagggcgggaggccgggggactccacactggaggagcgcactttccgcatcttggggctcccggcccccgaagtaaacctgcgggacgcccccacgcagccaggtagcccagagcaccaagccttaggcccagcagcttcgggagcccagggcagagccgaggggtcggaagtggcggtggtccagcggcgcgccggccggggctgggcgcggaccccagggccctacgccggggccctgcgagaagccgtgtcccgtatccgccgccacacagcccctgactcggacacggacgaagctgaggagctcagcgtccatagcggctcctctgatggaagcgacacagaagccccgggcgcctcctggcggaatgagaggaccctgcccgaggttggaaacagttcgccagaggaagatgggaagacagcggaactgagcgacagtgtcggggagatcctagatgtcataagccaaaccgaggaggtcctcttcggggtgagggacatcagagggacccaacagggaaataggaagaggcagtgagaggccccttcttgtatttgtgtccccaacgcatccatccttgggtccactggtccccattcttccccacagacttcctttgcttctcttttccttgtatctttacccatacctgttctcatccttgaaatataaatgaaaggaagggaagcatatgcccattaatgattttgtttcaggagaggtgagaatgagcagatttaattaatgtctgttatgttcagggcacaagggtgagctcttcgcaggggctgatgcactgggtgtggagctgagcagagaggcctaaccaggatcaggcaggagggcagggatggtggcagccataggagggcagggtagggtagggcctctgaggaggagggaaaaagtgaaggagaggctttggacctggtgacagagtgatcagatgacagaggggttcttgggagaagaggcataggtccagcaacaaccaacaaagcagaaggagggctcaccttggtgtcacaagtcttggatttcaatcccaactctgccactgagttgctggttgactgaggccagtcactttccctctccaggcctccaggcctcctggtatataaaatgatggtattctaaggtccatccttccgtctctgacattttgagatctttggaaaggactctatctcatcctcccctcgacaagccaagaatgagaattgggaataagtgaacagagtttgagggtttctgggcggcctccgtgtcacccaaagtcatgatcaattcaggagactgcccaaggcttgcagaagaggtaagggagtgaggcactcctatcccagtctcccaggtttggttgagggctccccaaggcagggcaagatagcggccctgtcactgaccctggcctgtggtggtctgagctggggagggaaggacaccaatgaatcagcttgggacctctttaggccttccccttttcctccaccccgatgctccttagtgatgctctgaggcgtggccacgatctccctcccaggtggtatcgcccacctgaaaaaatcctgagaatttctcccatcttggcctcttccagaaaccggccaggcaaggaaagaggccggtcaccagaagccagcaggcgtggggtgtgatactctctatagccactacagggcgcgcgcaggtcgcggatctccccagttgctaatcccggctctgccactcaatcctatccctagttcccgagcgcgggtcccccgccttgcagtctccagccgtgcggggccgggagcaggcctccggcctcccagacttctagagcccgccgggcccatctttgtactcatccaccccagccggcttgggactcagacaccgaagtctttttttttttctctccgatccttggacacctcctctgtctgccatttattagccatgtgaacttggccacatcacttcacctccctgagcctcagtttcctcatctgtcaaatgggggtttataaacacctacctcgcagggttgttgtgaggatttaatgcgataatgtatgtaaagcgccttgcacactgcctggcacacagtaggcgctcaataaatctaagcttcccttta

SEQ ID NO: 8124 - DNA, 949 bp, Homo sapiens
gacgcagggagcatgggtatctggacctcaggcactgatatcttcctaagtctttgggagatttacgtgtctccaagaagccccggatggatggactttatccagcatttgggagtttgctgtttggttgctcttatttcagtgggcctcctgtctgtggccgcctgctggtttctgccatcaatcatagcggccgctgcctcctggattatcacgtgtgttctgctgtgttgctccaagcatgcacgatgttttattcttcttgtctttctctcttgtggcctgcgtgaaggcaggaatgctttgattgcagctggcacagggatcgtcatcttgggacacgtagaaaatatttttcacaactttaaaggtctcctagatggtatgacttgcaacctaagggcaaagagcttttccatacattttccacttttgaaaaaatatattgaggcaattcagtggatttatggccttgccactccactaagtgtatttgatgaccttgtttcttggaaccagaccctggcagtctctcttttcagtcccagccatgtcctggaggcacagctaaatgacagcaaaggggaagtcctgagcgtcttgtaccagatggcaacaaccacagaggtgttgtcctccctgggtcagaagctacttgcctttgcagggctttcgctcgtcctgcttggcactggcctcttcatgaagcgatttttgggcccttgtggttggaagtatgaaaacatctacatcaccagacaatttgttcagtttgatgaaagggagagacatcaacagaggccctgtgtgctcccgctgaataaggaggaaaggaggaaattcatttctggcttccagtcctgaaaatgattaggaagaagcaaatggacatggcaagtgcagacaagtcatgagagaccccgactactcctcagccacatcgcaccaa

SEQ ID NO: 8125 - DNA, 3003 bp, Homo sapiens
ggcggagggggcggcgcgcgccgggcacgcgcgccggcgaccatggcgttcgccgggctggagcgagtacattaacccctggaggcggcggcggcggcgagggagcgagcctcgagcgggcgggccccagcctgagggaagggaggaaggggcggggagagcgccagagggaggccggtcggccgcgggcgggcgggcagcgcagcgccgagcggggcccgcgggcccatgaggaggcctggggaccatgggctccaggatcaagcagaatccagagaccacatttgaagtatatgttgaagtggcctatcccaggacaggtggcactctttcagatcctgaggtgcagaggcaattcccggaggactacagtgaccagcctcacagttagccaagttggccagaacttcacattcgtgctcactgacattgacagcaaacagagattcgggttctgccgcttatcttcaggagcgaagagctgcttctgtatcttaagctatctcccctggttcgaggtattttataagctgcttaacatcctggcagattacacgacaaaaagacaggaaaatcagtggaatgagcttcttgaaactctgcacaaacttcccatccctgacccaggagtgtctgtccatctcagcgtgcattcttattttactgtgcctgataccagagaacttcccagcatacctgagaatagaaatctgacagaatattttgtggctgtggatgttaacaacatgttgcatctgtacgccagtatgctgtacgaacgccggatactcatcatttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtgatctcttccctgaagaacaggctgaaaaaggtctccacaaccactggggatggtgtggccagagcgttcctcaaggcccaggctgctttcttcggtagctaccgaaacgctctgaaaatcgagccggaggagccgatcactttctgtgaggaagccttcgtgtcccactaccgctccggagccatgaggcagttcctgcagaacgccacacagctgcagctcttcaagcagtttattgatggtcgattagatcttctcaattccggcgaaggtttcagtgatgtttttgaagaggaaatcaacatgggcgagtacgctggcagtgacaaactgtaccatcagtggctctccactgtccggaaaggaagtggagcaattctgaatactgtaaagaccaaagcaaatccggccatgaagactgtctacaagttcgcaaaagatcatgcaaaaatgggaataaaagaggtgaaaaaccgcttgaagcaaaaggacattgccgagaatggctgcgcccccaccccagaagagcagctgccaaagactgcaccgtccccactggtggaggccaaggaccccaagctccgagaagaccggcggccaatcacagtccactttggacaggcgttgtgaatccccaaaaggagcaagacagaagacagcatttctcagatttgcctggctggggaacctccttttttcccttcacacaatgcgtctcccaggatggtgtttctcagcagacaccctgtgagatgccggccttccactgagatgatttcatctgccaagtgccaagactgggtggacatttttttaagtcctctctggaaacaaatgtaggcgatggactgggagggggagaggctggaggcagggaaacctgctgatggtaatggttgctaatgtctgttggtggcactgtgcaaagaacctgacgtccatcatctcgttgaatcttcctaacaggacactcgggtaggcagtgctgttacctgtacttcacagatgaggacagtaaggcttggaatggtcaaatcgtgggcctggagtaacccagggagtaaatgggagaactggggttctctccaaaactgtctgacccctagaggctgcctcccgagcgctctggtgcactgccacccagcaggaatggaaatagcccaagccagaggtgacaagcagtgaagacagtggggctggagaagatggttcccccgaagtagaaaggccaagcataagagaagcagtattgtggggagtggtgtaggagagctgggtgtctagacagggtagcagcctgtgcaccggtggagggggtgggctcccctctccctgatcacctcttcctcttgatgaatggtgtgaattgaggggtgggggggctgttcccctttcccccacacacttcctgtaagccaggaaggggaaaaaacatggtggccttgcccatccctaggcagcacccccaactcccgggtagctgtcagctgaagggtcaccaagcatgggtcagccctcacgcccagctaatggcataggatctgggaagccacggtgtcattctatcccatcgtgttctccatgtgccgccagggaaccctccaccaagtccctggacccgctttcccctcaggctgccccgacaggttccatgcagagcaccagggacccagggacaactgggacacaggccctgccctccaggagtagtggggcaggttcagaaaacaaattctaaggcagatttgagatctgaagtgtcactcccactcagtagagccctatatcagcactgtccaagaaaaacataatgggagcttcatacgggagtcacatgtggaattctgaatgtgaaacataaacaggtgaaattgattttaatataatgaacccaatatatccaaaatattatttcaacatgtaatcaatctaaaaatta

SEQ ID NO: 8126 - DNA, 3612 bp, Homo sapiens
acgcgcgccggcgaccatggcgttcgccgggctggagcgagtacattaacccctggaggcggcggcggcggcgagggagcgagcctcgagcgggcgggccccagcctgagggaagggaggaaggggcggggagagcgccagagggaggccggtcggccgcgggcgggcgggcagcgcagcgccgagcggggcccgcgggcccatgaggaggcctggggaccatgggctccaggatcaagcagaatccagagaccacatttgaagtatatgttgaagtggcctatcccaggacaggtggcactctttcagatcctgaggtgcagaggcaattcccggaggactacagtgaccaggaagttctacagactttgaccaagttttgtttccccttctatgtggacagcctcacagttagccaagttggccagaacttcacattcgtgctcactgacattgacagcaaacagagattcgggttctgccgcttatcttcaggagcgaagagctgcttctgtatcttaagctatctcccctggttcgaggtattttataagctgcttaacatcctggcagattacacgacaaaaagacaggaaaatcagtggaatgagcttcttgaaactctgcacaaacttcccatccctgacccaggagtgtctgtccatctcagcgtgcattcttattttactgtgcctgataccagagaacttcccagcatacctgagaatagaaatctgacagaatattttgtggctgtggatgttaacaacatgttgcatctgtacgccagtatgctgtacgaacgccggatactcatcatttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtgatctcttccctgaagaacaggctgaaaaaggtctccacaaccactggggatggtgtggccagagcgttcctcaaggcccaggctgctttcttcggtagctaccgaaacgctctgaaaatcgagccggaggagccgatcactttctgtgaggaagccttcgtgtcccactaccgctccggagccatgaggcagttcctgcagaacgccacacagctgcagctcttcaagcagtttattgatggtcgattagatcttctcaattccggcgaaggtttcagtgatgtttttgaagaggaaatcaacatgggcgagtacgctggcagtgacaaactgtaccatcagtggctctccactgtccggaaaggaagtggagcaattctgaatactgtaaagaccaaagcaaatccggccatgaagactgtctacaagttcgcaaaagatcatgcaaaaatgggaataaaagaggtgaaaaaccgcttgaagcaaaaggacattgccgagaatggctgcgcccccaccccagaagagcagctgccaaagactgcaccgtccccactggtggaggccaaggaccccaagctccgagaagaccggcggccaatcacagtccactttggacaggtgcgcccacctcgtccacatgttgttaagagaccaaagagcaacatcgcagtggaaggccggaggacgtctgtgccgagccctgagcaaaacaccattgcaacaccagctacactccacatcctacagaaaagcattacccattttgcggccaagttcccgacgagaggctggacctcttcatcacattgacttacgccgttgcttttccagactgggcagaggggctgacttcgcagtgtgtgccaaagagccggtgtctgataatcccattttcctgcttatcacctgaactgtgtcagtatcacttttagttttgttggttggttggtttgttgtttgtttaatatgccctgttttctacttctgttggaaaatatttggggttgaaataaaccagtgggagcatgggagccagtttggtggttggcaaactaccagtgatagaaaacaaatgacaggttttctgtgagcgtacgtcacagtggctcgggcccacaaggagacagaggggtacgtttcaggacatcattccaagggtttctgttcacgtttgtttaacgaggaaggggaagttgttctcccataataccagtggtatttctagtgcaacccgggtgtttttctacgcctcttcccatgctgcttccccacccccccactgtgctccgccccttccaaatgccatgtcacaacagcacttggatgtgtttttctcaactgtcatcagctccagctggcaggaccaacttcttgaaacacaggaagcatccagcggaaaatattttaataaaacagactcctcataaaatattgttcgggggagggggaagaaaccggctccaccaatctgtcggcattgtattgggagatgtgagaagccaggctggcagcaggggcccgatcctaatgggcctttgtcaggtggtggttccgtgttgggcacacggacttggtgcctggccctttaatctggcctgggttttcttgaatcacagatcttcatctccactgggaatatcaaagtgcttgggaaacttagaagactggggcagcagaaggggatgcaggatctttgaagtggagaggagagattcattcctcctgacttcttgccccaactctcacttccaattgcacattaaataatcccagcactttgggaggccaaggcgagcggatcacctgaggtcaggggttcgagaccagcctgggcaacatggcgaaaccccgtctctactaaaaatacaaaaattagccgagtgtggtggcgcacccctgtaattccagctactcgggaggctgaggcatgagaatcacttgaacccaggaggcggaggctgccgtgagctgagatcacaccaccacactccagcctgtgcaacagagtgagactctgtctcaaaaataaaataaccagctttgtggacagcaagatggggctgattaagagtaagactgtctcctggagtagctgagcatcctgggactcatcagggcccagaaacactagccagccactctctggccagtccacccctgaagttcatttcttccttcccagctgatgtccatccctccatcattccatctgtccattcgtgcattcattcattcagcaagtatctttgaaaacctactaggcgcaagcacggacgatttttttaaaggaggccttaaaagggagtccccatgctgactcttggttgacttgcattttcccaaaatgaaattttcctgtgtcaaattttctttctgaatcaatgataggtttcctagtcccttaaaactggccgttggcaattggaagaagacttttttgaagatttgtgggggaaacattccctttacttttcaggtaacattacttggttaatattcagttactaaatctcttcaagaa

SEQ ID NO: 8127 - DNA, 5010 bp, Homo sapiens
gcgttcgccgggctggagcgagtacattaacccctggaggcggcggcggcggcgagggagcgagcctcgagcgggcgggccccagcctgagggaagggaggaaggggcggggagagcgccagagggaggccggtcggccgcgggcgggcgggcagcgcagcgccgagcggggcccgcgggcccatgaggaggcctggggaccatgggctccaggatcaagcagaatccagagaccacatttgaagtatatgttgaagtggcctatcccaggacaggtggcactctttcagatcctgaggtgcagaggcaattcccggaggactacagtgaccaggaagttctacagactttgaccaagttttgtttccccttctatgtggacagcctcacagttagccaagttggccagaacttcacattcgtgctcactgacattgacagcaaacagagattcgggttctgccgcttatcttcaggagcgaagagctgcttctgtatcttaagctatctcccctggttcgaggtattttataagctgcttaacatcctggcagattacacgacaaaaagacaggaaaatcagtggaatgagcttcttgaaactctgcacaaacttcccatccctgacccaggagtgtctgtccatctcagcgtgcattcttattttactgtgcctgataccagagaacttcccagcatacctgagaatagaaatctgacagaatattttgtggctgtggatgttaacaacatgttgcatctgtacgccagtatgctgtacgaacgccggatactcatcatttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtgatctcttccctgaagaacaggctgaaaaaggtctccacaaccactggggatggtgtggccagagcgttcctcaaggcccaggctgctttcttcggtagctaccgaaacgctctgaaaatcgagccggaggagccgatcactttctgtgaggaagccttcgtgtcccactaccgctccggagccatgaggcagttcctgcagaacgccacacagctgcagctcttcaagcagtttattgatggtcgattagatcttctcaattccggcgaaggtttcagtgatgtttttgaagaggaaatcaacatgggcgagtacgctggcagtgacaaactgtaccatcagtggctctccactgtccggaaaggaagtggagcaattctgaatactgtaaagaccaaagcaaatccggccatgaagactgtctacaagttcgcaaaagatcatgcaaaaatgggaataaaagaggtgaaaaaccgcttgaagcaaaaggacattgccgagaatggctgcgcccccaccccagaagagcagctgccaaagactgcaccgtccccactggtggaggccaaggaccccaagctccgagaagaccggcggccaatcacagtccactttggacaggtgcgcccacctcgtccacatgttgttaagagaccaaagagcaacatcgcagtggaaggccggaggacgtctgtgccgagccctgagcagccgcagccgtatcggacactcagggagtcagacagcgcggaaggcgacgaggcagagagtccagagcagcaagtgcggaagtccacaggccctgtcccagctccccctgaccgggctgccagcatcgaccttctggaagacgtcttcagcaacctggacatggaggccgcactgcagccactgggccaggccaagagcttagaggaccttcgtgcccccaaagacctgagggagcagccagggacctttgactatcagaggctggatctgggcgggagtgagaggagccgcggggtgacagtggccttgaagcttacccacccgtacaacaagctctggagcctgggccaggacgacatggccatccccagcaagcccccagctgcctcccctgagaagccctcagccctgctcggaaactccctggccctgcctcgaaggccccagaaccgggacagcatcctgaaccccagtgacaaggaggaggtgcccacccctactctgggcagcatcaccatcccccggccccaaggcaggaagaccccagagctgggcatcgtgcctccaccgcccattccccgcccggccaagctccaggctgccggcgccgcacttggtgacgtctcagagcggctgcagacggatcgggacaggcgagctgccctgagtccagggctcctgcctggtgttgtcccccaaggccccactgaactgctccagccgctcagccctggccccggggctgcaggcacgagcagtgacgccctgctcgccctcctggacccgctcagcacagcctggtcaggcagcaccctcccgtcacgccccgccaccccgaatgtagccaccccattcaccccccaattcagcttcccccctgcagggacacccaccccattcccacagccaccactcaacccctttgtcccatccatgccagcagccccacccaccctgcccctggtctccacaccagccgggcctttcggggcccctccagcttccctggggccggcttttgcgtccggcctcctgctgtccagtgctggcttctgtgcccctcacaggtctcagcccaacctctccgccctctccatgcccaacctctttggccagatgcccatgggcacccacacgagccccctacagccgctgggtcccccagcagttgccccgtcgaggatccgaacgttgcccctggcccgctcaagtgccagggctgctgagaccaagcaggggctggccctgaggcctggagaccccccgcttctgcctcccaggccccctcaaggcctggagccaacactgcagccctctgctcctcaacaggccagagacccctttgaggatttgttacagaaaaccaagcaagacgtgagcccgagtccggccctggccccggccccagactcggtggagcagctcaggaagcagtgggagaccttcgagtgagccgggccctgagggtgggggatgcaccgaggcccgagggtccgtccactgctgcggttccgaggctcccccgccactctctctctgcccaggttctgctggtgggaagggatgggacccctctctgctgccccctcctcccctccacactgcccatctctgatgtctggccctggggaatggcaccagttccagcctgggaatcaacccagttcctgagtgcccatcccaccccgcggttgcctctcctcggcacccttgattgggttttgcactaaagaggtcagctgggccaatgatattgctccagaccgagtcctacccaccttcccccggaagtgtcccaagaggctccgaaggcctcccctccgagcccagctctcctgtctcctccacagccaggccctgcacgcccacctcctcggacacaggtgacagggttaccctccagtttgagctcatctgcacgagacacaggtagcttggggttgaagttaggactcctcctgggctggaggatttacctggtggggcacttccagactgtttctagcaatatacacacacgttctttcctgtgtcttcaccccaaaacttcagttgattctgacctgggaggatctggggaccagggggtcttgggctgccttgtgatacacagccccagccaccctgcacgggggctgcgagcaccagcaactttgatttatagaaggaaaatggaaacccccatctgagtattttgggaggagcccccagccctcatccagctctggcacgctgatacctccaggtactcccctcactgtcaaagctggggctcagcctcttgtcatctggagctttgtgggcaaagctgagaagctgcaacccagatttcaacccaaaaaggtcaagctgaatgcctcagactgatgtggaaggcagctggccttcctgggttggaacgaggcagtggccctgagccccttctccagggccaggtagaaaggacaaacttggtctctgcctcggggaagcaggaggagggctagaagccagtccctccccacctgcccagagctccaggccagcacagaaattcctgaggccaacgtcaccaaagttagattgaatgtttattatctttctttttcctttttaccttattgatttgatgaatcttgaaatggattcatttccataaaccaagttaaagtatggcccgaccatttaagaaaacaaccatctgagacacgcaggaaattgtgagcatttcgacccgagctctcatttcctatttgtgaagggtcagacacagtctacccaggggtgtctgggggacaagggggtctctggagatgtcacccagggagccccctctatgtctgagaggctgccactgctgcacatgctcagtgaggcttggcggccatcctggcacatggctcttcctgggtcaaccgtgacctgtctggctcaggaatgggctctggctgctgggggagccgtgtcactcctgggccatgggggcacctcctgggcacttaggtgtttcagcatagattccagtttcgcaccctgggcagacccccaggccccatccgggatagggcagaggaggtgctggcggccccagggaaggagggtgtgtaccccaaggccccctggctgtgctgaggggctggggtgagcgctccatgttcacatgagcactgctgcctcttcacttgtgggactttttgcaaacccaaggatgaactttgtgtgcattcaataaaatcatcttggggaagagg

SEQ ID NO: 8128 - DNA, 2088 bp, Homo sapiens
cgcgcgccgggcacgcgcgccggcgaccatggcgttcgccgggctggagcgagtacattaacccctggaggcggcggcggcggcgagggagcgagcctcgagcgggcgggccccagcctgagggaagggaggaaggggcggggagagcgccagagggaggccggtcggccgcgggcgggcgggcagcgcagcgccgagcggggcccgcgggcccatgaggaggcctggggaccatgggctccaggatcaagcagaatccagagaccacatttgaagtatatgttgaagtggcctatcccaggacaggtggcactctttcaggaagttctacagactttgaccaagttttgtttccccttctatgtggacagcctcacagttagccaagttggccagaacttcacattcgtgctcactgacattgacagcaaacagagattcgggttctgccgcttatcttcaggagcgaagagctgcttctgtatcttaagctatctcccctggttcgaggtattttataagctgcttaacatcctggcagattacacgacaaaaagacaggaaaatcagtggaatgagcttcttgaaactctgcacaaacttcccatccctgacccaggagtgtctgtccatctcagcgtgcattcttattttactgtgcctgataccagagaacttcccagcatacctgagaatagaaatctgacagaatattttgtggctgtggatgttaacaacatgttgcatctgtacgccagtatgctgtacgaacgccggatactcatcatttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtgatctcttccctgaagaacaggctgaaaaaggtctccacaaccactggggatggtgtggccagagcgttcctcaaggcccaggctgctttcttcggtagctaccgaaacgctctgaaaatcgagccggaggagccgatcactttctgtgaggaagccttcgtgtcccactaccgctccggagccatgaggcagttcctgcagaacgccacacagctgcagctcttcaagcagtttattgatggtcgattagatcttctcaattccggcgaaggtttcagtgatgtttttgaagaggaaatcaacatgggcgagtacgctggcagtgacaaactgtaccatcagtggctctccactgtccggaaaggaagtggagcaattctgaatactgtaaagaccaaagcaaatccggccatgaagactgtctacaagttcgcaaaagatcatgcaaaaatgggaataaaagaggtgaaaaaccgcttgaagcaaaaggacattgccgagaatggctgcgcccccaccccagaagagcagctgccaaagactgcaccgtccccactggtggaggccaaggaccccaagctccgagaagaccggcggccaatcacagtccactttggacaggtgcgcccacctcgtccacatgttgttaagagaccaaagagcaacatcgcagtggaaggccggaggacgtctgtgccgagccctgagcaaaacaccattgcaacaccagctacactccacatcctacagaaaagcattacccattttgcggccaagttcccgacgagaggctggacctcttcatcacattgacttacgccgttgcttttccagactgggcagaggggctgacttcgcagtgtgtgccaaagagccggtgtctgataatcccattttcctgcttatcacctgaactgtgtcagtatcacttttagttttgttggttggttggtttgttgtttgtttaatatgccctgttttctacttctgttggaaaatatttggggttgaaataaaccagtgggagcatgg

SEQ ID NO: 8129 - DNA, 3348 bp, Homo sapiens
gaccatggcgttcgccgggctggagcgagtacattaacccctggaggcggcggcggcggcgagggagcgagcctcgagcgggcgggccccagcctgagggaagggaggaaggggcggggagagcgccagagggaggccggtcggccgcgggcgggcgggcagcgcagcgccgagcggggcccgcgggcccatgaggaggcctggggaccatgggctccaggatcaagaagttctacagactttgaccaagttttgtttccccttctatgtggacagcctcacagttagccaagttggccagaacttcacattcgtgctcactgacattgacagcaaacagagattcgggttctgccgcttatcttcaggagcgaagagctgcttctgtatcttaagctatctcccctggttcgaggtattttataagctgcttaacatcctggcagattacacgacaaaaagacaggaaaatcagtggaatgagcttcttgaaactctgcacaaacttcccatccctgacccaggagtgtctgtccatctcagcgtgcattcttattttactgtgcctgataccagagaacttcccagcatacctgagaatagaaatctgacagaatattttgtggctgtggatgttaacaacatgttgcatctgtacgccagtatgctgtacgaacgccggatactcatcatttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtgatctcttccctgaagaacaggctgaaaaaggtctccacaaccactggggatggtgtggccagagcgttcctcaaggcccaggctgctttcttcggtagctaccgaaacgctctgaaaatcgagccggaggagccgatcactttctgtgaggaagccttcgtgtcccactaccgctccggagccatgaggcagttcctgcagaacgccacacagctgcagctcttcaagcagtttattgatggtcgattagatcttctcaattccggcgaaggtttcagtgatgtttttgaagaggaaatcaacatgggcgagtacgctggcagtgacaaactgtaccatcagtggctctccactgtccggaaaggaagtggagcaattctgaatactgtaaagaccaaagcaaatccggccatgaagactgtctacaagttcgcaaaagatcatgcaaaaatgggaataaaagaggtgaaaaaccgcttgaagcaaaaggacattgccgagaatggctgcgcccccaccccagaagagcagctgccaaagactgcaccgtccccactggtggaggccaaggaccccaagctccgagaagaccggcggccaatcacagtccactttggacaggtgcgcccacctcgtccacatgttgttaagagaccaaagagcaacatcgcagtggaaggccggaggacgtctgtgccgagccctgagcacctggtaaagcccttgcgacactatgcggtcttcctctccgaagactcctctgatgatgaatgccagcgggaagagggcccgagctctggcttcaccgagagctttttcttctccgctccctttgaatggccgcagccgtatcggacactcagggagtcagacagcgcggaaggcgacgaggcagagagtccagagcagcaagtgcggaagtccacaggccctgtcccagctccccctgaccgggctgccagcatcgaccttctggaagacgtcttcagcaacctggacatggaggccgcactgcagccactgggccaggccaagagcttagaggaccttcgtgcccccaaagacctgagggagcagccagggacctttgactatcagaggctggatctgggcgggagtgagaggagccgcggggtgacagtggccttgaagcttacccacccgtacaacaagctctggagcctgggccaggacgacatggccatccccagcaagcccccagctgcctcccctgagaagccctcagccctgctcggaaactccctggccctgcctcgaaggccccagaaccgggacagcatcctgaaccccagtgacaaggaggaggtgcccacccctactctgggcagcatcaccatcccccggccccaaggcaggaagaccccagagctgggcatcgtgcctccaccgcccattccccgcccggccaagctccaggctgccggcgccgcacttggtgacgtctcagagcggctgcagacggatcgggacaggcgagctgccctgagtccagggctcctgcctggtgttgtcccccaaggccccactgaactgctccagccgctcagccctggccccggggctgcaggcacgagcagtgacgccctgctcgccctcctggacccgctcagcacagcctggtcaggcagcaccctcccgtcacgccccgccaccccgaatgtagccaccccattcaccccccaattcagcttcccccctgcagggacacccaccccattcccacagccaccactcaacccctttgtcccatccatgccagcagccccacccaccctgcccctggtctccacaccagccgggcctttcggggcccctccagcttccctggggccggcttttgcgtccggcctcctgctgtccagtgctggcttctgtgcccctcacaggtctcagcccaacctctccgccctctccatgcccaacctctttggccagatgcccatgggcacccacacgagccccctacagccgctgggtcccccagcagttgccccgtcgaggatccgaacgttgcccctggcccgctcaagtgccagggctgctgagaccaagcaggggctggccctgaggcctggagaccccccgcttctgcctcccaggccccctcaaggcctggagccaacactgcagccctctgctcctcaacaggccagagacccctttgaggatttgttacagaaaaccaagcaagacgtgagcccgagtccggccctggccccggccccagactcggtggagcagctcaggaagcagtgggagaccttcgagtgagccgggccctgagggtgggggatgcaccgaggcccgagggtccgtccactgctgcggttccgaggctcccccgccactctctctctgcccaggtt

SEQ ID NO: 8130 - DNA, 2557 bp, Homo sapiens
gaacgccggatactcatcatttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtggaggagccgatcactttctgtgaggaagccttcgtgtcccactaccgctccggagccatgaggcagttcctgcagaacgccacacagctgcagctcttcaagcagtttattgatggtcgattagatcttctcaattccggcgaaggtttcagtgatgtttttgaagaggaaatcaacatgggcgagtacgctggcagtgacaaactgtaccatcagtggctctccactgtccggaaaggaagtggagcaattctgaatactgtaaagaccaaagcaaatccggccatgaagactgtctacaagttcgcaaaagatcatgcaaaaatgggaataaaagaggtgaaaaaccgcttgaagcaaaaggacattgccgagaatggctgcgcccccaccccagaagagcagctgccaaagactgcaccgtccccactggtggaggccaaggaccccaagctccgagaagaccggcggccaatcacagtccactttggacaggtgcgcccacctcgtccacatgttgttaagagaccaaagagcaacatcgcagtggaaggccggaggacgtctgtgccgagccctgagcacctggtaaagcccttgcgacactatgcggtcttcctctccgaagactcctctgatgatgaatgccagcgggaagagggcccgagctctggcttcaccgagagctttttcttctccgctccctttgaatggccgcagccgtatcggacactcagggagtcagacagcgcggaaggcgacgaggcagagagtccagagcagcaagtgcggaagtccacaggccctgtcccagctccccctgaccgggctgccagcatcgaccttctggaagacgtcttcagcaacctggacatggaggccgcactgcagccactgggccaggccaagagcttagaggaccttcgtgcccccaaagacctgagggagcagccagggacctttgactatcagaggctggatctgggcgggagtgagaggagccgcggggtgacagtggccttgaagcttacccacccgtacaacaagctctggagcctgggccaggacgacatggccatccccagcaagcccccagctgcctcccctgagaagccctcagccctgctcggaaactccctggccctgcctcgaaggccccagaaccgggacagcatcctgaaccccagtgacaaggaggaggtgcccacccctactctgggcagcatcaccatcccccggccccaaggcaggaagaccccagagctgggcatcgtgcctccaccgcccattccccgcccggccaagctccaggctgccggcgccgcacttggtgacgtctcagagcggctgcagacggatcgggacaggcgagctgccctgagtccagggctcctgcctggtgttgtcccccaaggccccactgaactgctccagccgctcagccctggccccggggctgcaggcacgagcagtgacgccctgctcgccctcctggacccgctcagcacagcctggtcaggcagcaccctcccgtcacgccccgccaccccgaatgtagccaccccattcaccccccaattcagcttcccccctgcagggacacccaccccattcccacagccaccactcaacccctttgtcccatccatgccagcagccccacccaccctgcccctggtctccacaccagccgggcctttcggggcccctccagcttccctggggccggcttttgcgtccggcctcctgctgtccagtgctggcttctgtgcccctcacaggtctcagcccaacctctccgccctctccatgcccaacctctttggccagatgcccatgggcacccacacgagccccctacagccgctgggtcccccagcagttgccccgtcgaggatccgaacgttgcccctggcccgctcaagtgccagggctgctgagaccaagcaggggctggccctgaggcctggagaccccccgcttctgcctcccaggccccctcaaggcctggagccaacactgcagccctctgctcctcaacaggccagagacccctttgaggatttgttacagaaaaccaagcaagacgtgagcccgagtccggccctggccccggccccagactcggtggagcagctcaggaagcagtgggagaccttcgagtgagccgggccctgagggtgggggatgcaccgaggcccgagggtccgtccactgctgcggttccgaggctcccccgccactctctctctgcccaggttctgctggt

SEQ ID NO: 8131 - DNA, 2195 bp, Homo sapiens
gggggccggacggacagccccacaccgacatgtaaccatggactgcaggaccaaggcaaatccagacagaacctttgacttggtgttgaaagtgaaatgtcatgcctctgaaaatgaagaggacagtccagcttatctgccgaggattccccctggaaaagtacgccgattcgcattttgcattaagaaactggaaaactttcctgtcggtcctggcgtagcgcctcccgtgtccggggtagaccttgtaccggctgaaaccgcatagctcgaccttcatggcggcagctccacgggaggagaaaagatggccccaacctgtattttcgaatcctgtggtattgtggaaattcccagaggactttggagaccaggaaatactacagagtgtgccaaagttctgttttccctttgacgttgaaagggtgtctcagaatcaagttggacagcactttacctttgtactgacagacattgaaagtaaacagagatttggattctgcagactgacgtcaggaggcacaatttgtttatgcatccttagttaccttccctggtttgaagtgtattacaagcttctaaatactcttgcagattacttggctaaggaactggaaaatgatttgaatgaaactctcagatcactgtataaccacccagtaccaaaggcaaatactcctgtaaatttgagtgtgcattcctacttcattgcccctgatgtaactggactcccaacaatacccgagagtagaaatcttacagaatattttgttgccgtggatgtgaacaacatgctgcagctgtatgccagtatgctgcatgaaaggcgcatcgtgattatctcgagcaaattaagcactttaactgcctgtatccatggatcagctgctcttctatacccaatgtattggcaacacatatacatcccagtgcttcctccacacctgctggactactgctgtgccccaatgccatacctgattggaatacactccagcctcatagagagagtgaaaaacaaatcattggaagatgttgttatgttaaatgttgatacaaacacattagaatcaccatttagtgacttgaacaacctaccaagtgatgtggtctcggccttgaaaaataaactgaagaagcagtctacagctacgggtgatggagtagctagggcctttcttagagcacaggctgctttgtttggatcctacagagatgcactgagatacaaacctggtgagcccatcactttctgtgaggagagttttgtaaagcaccgctcaagcgtgatgaaacagttcctggaaactgccattaacctccagctttttaagcagtttatcgatggtcgactggcaaaactaaatgcaggaaggggtttctctgatgtatttgaagaagagatcacttcaggtggcttttgtggaggtaaagacaagttacaatatgattatccattttctcaataacaattttcttggtctttgcacttgtgtctgataaaacctatttcataaacaactaatgatttcctcctaaatatgtaatgtcttaaatacatttttcatcttataaaagctatggaattagcttattttgcctgatacctgttactcaaggcattaagttggcctcctgaattggcagctgttggcctcgataatctcttaatattgctggaaattagtaatacagaaatccaatcaactcatatcttcctgtctttccttctgaatagtagtattctctgctagaaaactactagtgatggttattactgagtatgaatttaagaactgaggttatgattggtaatacaatccaaaaagaagggtctgaacaccaaaattctttatacatatttaagtaactgtattattattatacagatgtctttacctttttgactttatagatcactgcagcattaagaaagtttccagtttaccattccataagtacaattaatccttctagtgtaaatgttcaaatactgttataattatctaggcaattaataatttacaaactgatatttttgcacgattgtagtggtgtatagtcttgacttgcagagcattttgcttgagtccttgaaatgtcgtgttcattcattatttgctgagtgcttacaatgtattaggcactgttctaaatattaagtgtactaaataaacaaaaatccttgtattctg

SEQ ID NO: 8132 - DNA, 2177 bp, Homo sapiens
gccgggggcgcagccgacatgggcccgccgccacggctgctgtgagcagcctctttccctgtgtggccgccggcgtgggcggggacggcgcgaccctcgcgcggccgggctgcgggcttccaggccagcgcgcgggggccggacggacagccccacaccgacatgtaaccatggactgcaggaccaaggcaaatccagacagaacctttgacttggtgttgaaagtgaaatgtcatgcctctgaaaatgaagatcctgtggtattgtggaaattcccagaggactttggagaccaggaaatactacagagtgtgccaaagttctgttttccctttgacgttgaaagggtgtctcagaatcaagttggacagcactttacctttgtactgacagacattgaaagtaaacagagatttggattctgcagactgacgtcaggaggcacaatttgtttatgcatccttagttaccttccctggtttgaagtgtattacaagcttctaaatactcttgcagattacttggctaaggaactggaaaatgatttgaatgaaactctcagatcactgtataaccacccagtaccaaaggcaaatactcctgtaaatttgagtgtgaaccaagagatatttattgcctgtgagcaagttctgaaagatcagcctgctctagtaccgcattcctacttcattgcccctgatgtaactggactcccaacaatacccgagagtagaaatcttacagaatattttgttgccgtggatgtgaacaacatgctgcagctgtatgccagtatgctgcatgaaaggcgcatcgtgattatctcgagcaaattaagcactttaactgcctgtatccatggatcagctgctcttctatacccaatgtattggcaacacatatacatcccagtgcttcctccacacctgctggactactgctgtgccccaatgccatacctgattggaatacactccagcctcatagagagagtgaaaaacaaatcattggaagatgttgttatgttaaatgttgatacaaacacattagaatcaccatttagtgacttgaacaacctaccaagtgatgtggtctcggccttgaaaaataaactgaagaagcagtctacagctacgggtgatggagtagctagggcctttcttagagcacaggctgctttgtttggatcctacagagatgcactgagatacaaacctggtgagcccatcactttctgtgaggagagttttgtaaagcaccgctcaagcgtgatgaaacagttcctggaaactgccattaacctccagctttttaagcagtttatcgatggtcgactggcaaaactaaatgcaggaaggggtttctctgatgtatttgaagaagagatcacttcaggtggcttttgtggaggtaaagacaagttacaatatgattatccattttctcaataacaattttcttggtctttgcacttgtgtctgataaaacctatttcataaacaactaatgatttcctcctaaatatgtaatgtcttaaatacatttttcatcttataaaagctatggaattagcttattttgcctgatacctgttactcaaggcattaagttggcctcctgaattggcagctgttggcctcgataatctcttaatattgctggaaattagtaatacagaaatccaatcaactcatatcttcctgtctttccttctgaatagtagtattctctgctagaaaactactagtgatggttattactgagtatgaatttaagaactgaggttatgattggtaatacaatccaaaaagaagggtctgaacaccaaaattctttatacatatttaagtaactgtattattattatacagatgtctttacctttttgactttatagatcactgcagcattaagaaagtttccagtttaccattccataagtacaattaatccttctagtgtaaatgttcaaatactgttataattatctaggcaattaataatttacaaactgatatttttgcacgattgtagtggtgtatagtcttgacttgcagagcattttgcttgagtccttgaaatgtcgtgttcattcattatttgctgagtgcttacaatgtattaggcactgttctaaatattaagtgtactaaataaacaaaaatccttgtattctg

SEQ ID NO: 8133 - DNA, 1917 bp, Homo sapiens
atggcggcagctccacgggaggagaaaagatggccccaacctgtattttcgaatcctgtggtattgtggaaattcccagaggactttggagaccaggaaatactacagagtgtgccaaagttctgttttccctttgacgttgaaagggtgtctcagaatcaagttggacagcactttacctttgtactgacagacattgaaagtaaacagagatttggattctgcagactgacgtcaggaggcacaatttgtttatgcatccttagttaccttccctggtttgaagtgtattacaagcttctaaatactcttgcagattacttggctaaggaactggaaaatgatttgaatgaaactctcagatcactgtataaccacccagtaccaaaggcaaatactcctgtaaatttgagtgtgcattcctacttcattgcccctgatgtaactggactcccaacaatacccgagagtagaaatcttacagaatattttgttgccgtggatgtgaacaacatgctgcagctgtatgccagtatgctgcatgaaaggcgcatcgtgattatctcgagcaaattaagcactttaactgcctgtatccatggatcagctgctcttctatacccaatgtattggcaacacatatacatcccagtgcttcctccacacctgctggactactgctgtgccccaatgccatacctgattggaatacactccagcctcatagagagagtgaaaaacaaatcattggaagatgttgttatgttaaatgttgatacaaacacattagaatcaccatttagtgacttgaacaacctaccaagtgatgtggtctcggccttgaaaaataaactgaagaagcagtctacagctacgggtgatggagtagctagggcctttcttagagcacaggctgctttgtttggatcctacagagatgcactgagatacaaacctggtgagcccatcactttctgtgaggagagttttgtaaagcaccgctcaagcgtgatgaaacagttcctggaaactgccattaacctccagctttttaagcagtttatcgatggtcgactggcaaaactaaatgcaggaaggggtttctctgatgtatttgaagaagagatcacttcaggtggcttttgtggaggtaaagacaagttacaatatgattatccattttctcaataacaattttcttggtctttgcacttgtgtctgataaaacctatttcataaacaactaatgatttcctcctaaatatgtaatgtcttaaatacatttttcatcttataaaagctatggaattagcttattttgcctgatacctgttactcaaggcattaagttggcctcctgaattggcagctgttggcctcgataatctcttaatattgctggaaattagtaatacagaaatccaatcaactcatatcttcctgtctttccttctgaatagtagtattctctgctagaaaactactagtgatggttattactgagtatgaatttaagaactgaggttatgattggtaatacaatccaaaaagaagggtctgaacaccaaaattctttatacatatttaagtaactgtattattattatacagatgtctttacctttttgactttatagatcactgcagcattaagaaagtttccagtttaccattccataagtacaattaatccttctagtgtaaatgttcaaatactgttataattatctaggcaattaataatttacaaactgatatttttgcacgattgtagtggtgtatagtcttgacttgcagagcattttgcttgagtccttgaaatgtcgtgttcattcattatttgctgagtgcttacaatgtattaggcactgttctaaatattaagtgtactaaataaacaaaaatccttgtattctg

SEQ ID NO: 8134 - DNA, 2351 bp, Homo sapiens
attgagacaaaaacaagggcaaatccagacagaacctttgacttggtgttgaaagtgaaatgtcatgcctctgaaaatgaagatcctgtggtattgtggaaattcccagaggactttggagaccaggaaatactacagagtgtgccaaagttctgttttccctttgacgttgaaagggtgtctcagaatcaagttggacagcactttacctttgtactgacagacattgaaagtaaacagagatttggattctgcagactgacgtcaggaggcacaatttgtttatgcatccttagttaccttccctggtttgaagtgtattacaagcttctaaatactcttgcagattacttggctaaggaactggaaaatgatttgaatgaaactctcagatcactgtataaccacccagtaccaaaggcaaatactcctgtaaatttgagtgtgcattcctacttcattgcccctgatgtaactggactcccaacaatacccgagagtagaaatcttacagaatattttgttgccgtggatgtgaacaacatgctgcagctgtatgccagtatgctgcatgaaaggcgcatcgtgattatctcgagcaaattaagcactttaactgcctgtatccatggatcagctgctcttctatacccaatgtattggcaacacatatacatcccagtgcttcctccacacctgctggactactgctgtgccccaatgccatacctgattggaatacactccagcctcatagagagagtgaaaaacaaatcattggaagatgttgttatgttaaatgttgatacaaacacattagaatcaccatttagtgacttgaacaacctaccaagtgatgtggtctcggccttgaaaaataaactgaagaagcagtctacagctacgggtgatggagtagctagggcctttcttagagcacaggctgctttgtttggatcctacagagatgcactgagatacaaacctggtgagcccatcactttctgtgaggagagttttgtaaagcaccgctcaagcgtgatgaaacagttcctggaaactgccattaacctccagctttttaagcagtttatcgatggtcgactggcaaaactaaatgcaggaaggggtttctctgatgtatttgaagaagagatcacttcaggtggcttttgtggagggaacccgaggtcatatcaacaatgggtgcatacagtcaagaaaggaggtgcactgttcaacacagcaatgaccaaagcaacccctgctgtacggacagcatataaatttgcaaaaaatcatgcaaagctgggactaaaggaagtgaagagtaaactaaaacacaaggaaaatgaagaagattatgggacctgttctagttctgtacaatatacaccagtttacaaattacacaatgaaaagggaggaaactcagaaaagcgtaagcttgctcaggcacgcttaaaaaggcctcttaagagccttgatggtgctctatatgatgatgaagatgatgatgacattgaaagagcaagcaagttatcttctgaagatggtgaagaagcttctgcttatctctatgagagtgatgactctgttgaaacaagagtgaagactccttactcaggtgaaatggacttactaggagagattcttgatacattgagcacacacagctcagatcaggggaagctggcagctgcaaagagcttggatttctttagatcaatggatgacattgattacaaacctacgaataaatctaatgctcctagtgagaataacctggctttcctctgtggtggttctggtgaccaagcagagtggaatcttgggcaagacgatagtgccctccatggcaaacacctccctccatctcctaggaagcgggtttcctctagtggtttgacagattctctgtttatcctgaaagaggaaaacagtaacaagcacctcggtgctgacaatgtgagtgaccctacttcaggactggatttccaactcacttcccctgaagtttcccagactgataaaggaaaaacagaaaagagggaaacactaagccagatttcagatgatctgcttatacccggtcttgggcggcattcatcgacttttgttccttgggagaaagaagggaaagaagccaaagagacttcagaagatattggactgctccatgaagtagtgtcattatgtcatatgacatctgacttccaacaaagcttgaacatttcagacaaaaacacaaatggaaaccaaacttaaatcttgcatccaagcttctatggagacattttgagattcaatgcaatctgtataataaacagaattatttgtaggaatggcaa

SEQ ID NO: 8135 - DNA, 2411 bp, Homo sapiens
attgagacaaaaacaagggcaaatccagacagaacctttgacttggtgttgaaagtgaaatgtcatgcctctgaaaatgaagatcctgtggtattgtggaaattcccagaggactttggagaccaggaaatactacagagtgtgccaaagttctgttttccctttgacgttgaaagggtgtctcagaatcaagttggacagcactttacctttgtactgacagacattgaaagtaaacagagatttggattctgcagactgacgtcaggaggcacaatttgtttatgcatccttagttaccttccctggtttgaagtgtattacaagcttctaaatactcttgcagattacttggctaaggaactggaaaatgatttgaatgaaactctcagatcactgtataaccacccagtaccaaaggcaaatactcctgtaaatttgagtgtgaaccaagagatatttattgcctgtgagcaagttctgaaagatcagcctgctctagtaccgcattcctacttcattgcccctgatgtaactggactcccaacaatacccgagagtagaaatcttacagaatattttgttgccgtggatgtgaacaacatgctgcagctgtatgccagtatgctgcatgaaaggcgcatcgtgattatctcgagcaaattaagcactttaactgcctgtatccatggatcagctgctcttctatacccaatgtattggcaacacatatacatcccagtgcttcctccacacctgctggactactgctgtgccccaatgccatacctgattggaatacactccagcctcatagagagagtgaaaaacaaatcattggaagatgttgttatgttaaatgttgatacaaacacattagaatcaccatttagtgacttgaacaacctaccaagtgatgtggtctcggccttgaaaaataaactgaagaagcagtctacagctacgggtgatggagtagctagggcctttcttagagcacaggctgctttgtttggatcctacagagatgcactgagatacaaacctggtgagcccatcactttctgtgaggagagttttgtaaagcaccgctcaagcgtgatgaaacagttcctggaaactgccattaacctccagctttttaagcagtttatcgatggtcgactggcaaaactaaatgcaggaaggggtttctctgatgtatttgaagaagagatcacttcaggtggcttttgtggagggaacccgaggtcatatcaacaatgggtgcatacagtcaagaaaggaggtgcactgttcaacacagcaatgaccaaagcaacccctgctgtacggacagcatataaatttgcaaaaaatcatgcaaagctgggactaaaggaagtgaagagtaaactaaaacacaaggaaaatgaagaagattatgggacctgttctagttctgtacaatatacaccagtttacaaattacacaatgaaaagggaggaaactcagaaaagcgtaagcttgctcaggcacgcttaaaaaggcctcttaagagccttgatggtgctctatatgatgatgaagatgatgatgacattgaaagagcaagcaagttatcttctgaagatggtgaagaagcttctgcttatctctatgagagtgatgactctgttgaaacaagagtgaagactccttactcaggtgaaatggacttactaggagagattcttgatacattgagcacacacagctcagatcaggggaagctggcagctgcaaagagcttggatttctttagatcaatggatgacattgattacaaacctacgaataaatctaatgctcctagtgagaataacctggctttcctctgtggtggttctggtgaccaagcagagtggaatcttgggcaagacgatagtgccctccatggcaaacacctccctccatctcctaggaagcgggtttcctctagtggtttgacagattctctgtttatcctgaaagaggaaaacagtaacaagcacctcggtgctgacaatgtgagtgaccctacttcaggactggatttccaactcacttcccctgaagtttcccagactgataaaggaaaaacagaaaagagggaaacactaagccagatttcagatgatctgcttatacccggtcttgggcggcattcatcgacttttgttccttgggagaaagaagggaaagaagccaaagagacttcagaagatattggactgctccatgaagtagtgtcattatgtcatatgacatctgacttccaacaaagcttgaacatttcagacaaaaacacaaatggaaaccaaacttaaatcttgcatccaagcttctatggagacattttgagattcaatgcaatctgtataataaacagaattatttgtaggaatggcaa

SEQ ID NO: 8136 - DNA, 6960 bp, Homo sapiens
gtaaagcaccgctcaagcgtgatgaaacagttcctggaaactgccattaacctccagctttttaagcagtttatcgatggtcgactggcaaaactaaatgcaggaaggggtttctctgatgtatttgaagaagagatcacttcaggtggcttttgtggagggaacccgaggtcatatcaacaatgggtgcatacagtcaagaaaggaggtgcactgttcaacacagcaatgaccaaagcaacccctgctgtacggacagcatataaatttgcaaaaaatcatgcaaagctgggactaaaggaagtgaagagtaaactaaaacacaaggaaaatgaagaagattatgggacctgttctagttctgtacaatatacaccagtttacaaattacacaatgaaaagggaggaaactcagaaaagcgtaagcttgctcaggcacgcttaaaaaggcctcttaagagccttgatggtgctctatatgatgatgaagatgatgatgacattgaaagagcaagcaagttatcttctgaagatggtgaagaagcttctgcttatctctatgagagtgatgactctgttgaaacaagagtgaagactccttactcaggtgaaatggacttactaggagagattcttgatacattgagcacacacagctcagatcaggggaagctggcagctgcaaagagcttggatttctttagatcaatggatgacattgattacaaacctacgaataaatctaatgctcctagtgagaataacctggctttcctctgtggtggttctggtgaccaagcagagtggaatcttgggcaagacgatagtgccctccatggcaaacacctccctccatctcctaggaagcgggtttcctctagtggtttgacagattctctgtttatcctgaaagaggaaaacagtaacaagcacctcggtgctgacaatgtgagtgaccctacttcaggactggatttccaactcacttcccctgaagtttcccagactgataaaggaaaaacagaaaagagggaaacactaagccagatttcagatgatctgcttatacccggtcttgggcggcattcatcgacttttgttccttgggagaaagaagggaaagaagccaaagagacttcagaagatattggactgctccatgaagtagtgtcattatgtcatatgacatctgacttccaacaaagcttgaacatttcagacaaaaacacaaatggaaaccaaacttaaatcttgcatccaagcttctatggagacattttgagattcaatgcaatctgtataataaacagaattatttgtaggaatggcaactcatactatttaaatttttttttgcatttgcaacatttttctcacttgttcatttcgaggatatatgaaatgcattgatttttaaatataaagcgaattctactgtgcttttaaatcaggtactagtgtgtatgtatgtttaaagtatgtattgaccatgagatttcccagtgtttggtgcttaatgccgtttattttatttaagctaagaatgcatatgtaacccatgcacataaccagtagctactatactaatctggttgagcatgaactgatcaagatatcaaaacttatcaaaactagcctgaagctgatgaaactgttaacccactaattgccttaatcttaaagctgttttttaagcatacttaaataatgtatgaaagtatgtataaagtttgaaggataagttattagtgttctgcagagcaataatgcctttttctattcatcaaatcaaggtcaaaattcatcttttcaagattaaaaagctctcttaatggaaatatttaatttgcttatataaagcactatagccatgttttccaaaaagtataaaaatatacacttacctttcattcagtgaaatataggaagtgctgaattacaatgtgaagttaatgacttctgtttacaaatgagacactctaacgagttttcagtctctctgtatgcctttgctatttaggggtccaccccaagaaagccaaatacaacataaaccgtcctgacaaaaaaaaaaaaaaaaatctttttttaactaataattctctatcaaaatgcttcatatcatcatctcaaatttactttttaaaataattgactttgtattttagaagttttagatttacagaaaaattgcaaagatagtacagagagttcccatctacccctgttactaacatcttacgttactatggtacatctgccccaattagtgaaccaatattgatattccatactttattcagattttcttagttttctcctaatatccattttccacatcaagatcctattcagaataccacactatattgagttggaatgtctccttaggctcctcttgcctgtgacagtttcttagactttccttatttttgatgacattgacagctttgaagagtactgtcagataaattgtagcatgctcctctcttggagtttgttgggtatttttttcatgattagactgggattgtgggttttgaggagatgatcacagaagtaaagtgccattttcatcaggtcatatcaagggtacgtactgtcaacatgatttgtgaatgctgacagggaccttgataacctggctgaggtagcgtttgtcactctaaagttcttcctgccctttccatgctgtcatttttggaaggaagtcactacatgcaggagtgaggagtcataattccccttctttagggcagagaagtatctacataaataactgggaattctgtatagaaaatttgtttcttctttctcaaattcactgttgagctttggaattcatctgagaaggaatcatgtactaattacttcatgatagactagattaccaggcacaatcagggaaaaaagcagtgatagtatggttaaattgttattagcattttcagtatatccactttatacatccccaatcatgattttttttacatttctttttagaaaagatgttcaagaaatcattaaagaaccccaataagactatattctaaatatttattgaaagaatataatttcagctaaaatcctagaagagggtttgaaataatttaaagaaaatgaccaagtttttttaaaacctacgtttcaaaatctaaatggatatgtgttatttgggacacttattcattatgattatataagaagacaattcttgtttcccttataagtatggactgtatacattaaggaaaacaatgtttaatccttattttttaatacagaagtctcaaggttcttgtcaaattttgcctttataagcttattacaaaattacaacttactttactgaagtttataatggaagaagtccatatagcaaaagagctgttttaaatcagaaggaaaaaaggttactctggttgttaatctgcttggcaaatattccttcataatttgtgaaaagaatgcaaatcagcattttaatatgaattttgaaatgaggtatggttttttgtttgtttttttcagaactcagtctgaaaaacaactgtgagtgtagcatgggtcaaatttggtttttagtccatttgctttatcaacatcacggcttcagaaatccaaattttgttctacttttcagccacctttcaaggtgtttggttataatactgtgttgctttgaggatatttagccactcataaataattgtctcaaggtatttaaaagtgatttgtgccttattttaatgcaaaattagcagttttattctattttaaaaacaaaggcagaaaaacaattctgcatgttattctttaaaaacatccagaataatactaccaagtatttgtatttcaaaccagtaaaattttgaatattcaaagtctgctcttaaacttagacttcctagtattatggtggttatagtgagaatgaaattaaactgggtgagttccgaaataaaggaaagtgttatattctacagtgcccatattttctatggtaactaaatcaaatatttgtaagttcctctgctttttgaaattatttttcaaagaagcaacacctgttatacaacagaattgtataaactaaaaagacttttggccttggtacatagtctttatctggcctgcaatggagtcatggttctttctgaatcccactctcacttttttctttttacccttagatattgcatccgtggtatttcaggggtatagagaaataatattggaatttaggagctatttttttaagtgaaaatattactaagtggtatcttttgatgattacctactttaatgtgtcttagaaaagcaccaaaacatagcatgattattttttcagttaattaaaattagttaataacatgttcatttaaaaactattcattgactttttgtaccagtcatatgcagggtacagtaactgaggatatgggaaataaaataactgacatagtccctgctctgaaggaacaaaggaaaaggaattgcaaatttttattaaaataataataataataataataataataataataataataataatgtgttttgcctggaagttattagctgagattctaacacacaaaaagttcaaaaaaaaagaacaaaaactggctgcttaatttaaagcatgctctaagtatgaaccatagtatcatttctaatttcattaactttctcaattattatgctaagtatattatgctgctaagatacccacatttaaggggcagatttagagactcttttagaaactgagtgtctttatcttattatcagataaccaggctgcacagggctctctataatggaatgatgctccttttcaatacttagagccactgtactcagtttaggagtaactgaaggtgtggatgcatgttaatgggaatccaatttttactatttttatatgaataacagcgttctgtagaaacagtctctcccttctaaataaaaactatgtgactgctgttactagtgctattctatgcgaatatcctaataataggattcaggaattctaatgaattgtttcttaattaaggtgaacaagtagactcctgatcaagaggagaacactgtgaatgtctcataatcaatagaccttcattctcttgtagaaaatgtggattttcaggaaaagactgattattttcatgaataaattttcttatacaaattccattttgtttgacataaaagaccctgaatcttaagatatttgtaaatcagaatatttaagaatgtaaaatgaatccccaaatctagtttcctccaaagcacttcttaatgtaggaaatagtttttacaaaccctatgtcagtactaatgttcctgggtcaaacccagtaatattgttagtgtatgttgttacaccttatttaagaggcagagtggttttgagcaagtcagttaacgtgatttgatgaagaaataaggaattatatacatttagacagaagaatattttattttgaaaataggatttcgtgcaataatttttcttgcataacttagttcatataaatatgtacatctgtttttctggcagatgccttaaggtcatgtttttcagtatttgagtaaatctgtatgtagcaatgttctcattgatttcagaaaaaaatatattctttatattgttgccaggagaaatgtttttgtttatttaaaattattatggatattgtgttgttgtatcataactaactgcctcagcaacaataaatatgcaataagaaaatcctgtaccttagattagattgacaatactgttactttaaaagaaatatatacggtacaaattgctgattctacatgtgtacatttaacagatactcagttctgcaccacctaaatcaaaatggcatttgtatgctgatgattacatatgtggattgtagtatcctttgtgatgaatctttgataagatttataaagggcattgccaatactttttgactgtgtaaattaattttttgtatgatgtacagtttgtttaatcttagagcttctatagatttctactttattatacttgaatgaggcagaaaagcactgtggaaaatctgtagctctggatgcaacatgcagacataccaaaaaaataataataaagcaaggtactgaagagcaatgttaacagaatgctttatatccagaatgctatgtttttttcaagccacattttagttgaatgaagtaaagttattcaatcttttattttaaaatattggaaagtcacaaatgattacttctttgatatgatgaacctataagtctattcatctctgttatttcatttctcaaatgtgagccttgttgaggtccattatcaaatctacactttggttgattatatgatgtttaggacaaggcagaatttaaaacctgcatgtttagtgcatcacatgtcaagtcaccatccttctgacagtgtaacttccataacgttattttgagagccatttaataatcatatttgaaaaagtggatttcttgagtctgttgtagtttagtacttacagcagtgcctaaaacagcaactaatatgaactgcctgagtcctacaacataaatgcataaagcttttttatgtaaaagccacaggaggggttcaaaattgaacttttccaaagtttatttctcttgcgttagatgaaaaactatttaaaaggactgaaaaccctgagctttttgctcgtcttggtagcagatatctgtaaaaacctacccagaattgtgattttacttcattgttcttgcatccttgaggctacagtataaatcatctccaaacttgactactattgggaagatgtgtataaaagcatcgctttgggaatttttttaaaaatatgcaaaaataaatattgaataaaatctacattaccataaaacacccaaaaatgcagttctaaaataaaattggtcacaattaaa

SEQ ID NO: 8137 - DNA, 2794 bp, Homo sapiens
acacaggaagctgagccggcttggggcccagcatacacaggcccccaggacccctggggagagggccccgctgggctggccctgcagggaccatggaatccagagctgaagggggctcccctgctgtgtttgattggttcttcgaagcggcctgccctgcctccctgcaggaggatccccccatcctgcggcagttccctccagacttcagggaccaggaagctatgcagatggtgcctaaattctgcttcccttttgatgtggaaagggagccccccagccccgccgtgcagcatttcaccttcgccctcacagaccttgccggcaaccgcagatttggtttctgccgcctgcgggcgggtacccagagctgtctctgcatcctcagccacctgccttggttcgaggtgttttacaagctattgaacacagtgggagacctcctagcccaggaccaagtcaccgaggcagaggaacttcttcaaaatctgtttcagcagtccctgtctgggccccaggcctcagtggggcttgagctgggcagcggagtgacggtctccagcgggcagggtatccccccccctacccgggggaatagcaagccgctttcctgcttcgtggccccggactccggccgcctgccatccatccctgagaacaggaacctaacggagctggtggtggccgtgactgacgagaacatcgtggggctgttcgcggcgctcctggccgagagaagagtcctgctcaccgccagcaaactcagcaccctgacctcgtgcgtccacgcgtcctgcgcgctcctgtaccccatgcgctgggagcacgtgctgatccccacgctgcccccacacctgctggactactgctgcgcgcccatgccctacctcattggagtgcacgccagtctcgccgagagagtacgagaaaaagccctggaggacgtcgtggtgctgaacgtggacgccaataccttggagacgacctttaacgacgtgcaggcgctgcctccagacgtggtgtccctgctgaggctccggctcaggaaggtcgccctggcccccggggaaggggtgtcccgtctcttcctcaaagcccaggccctgctcttcggggggtaccgcgacgcactcgtctgcagcccgggccagccagtgaccttcagtgaggaagtcttcttggcccagaagcctggggcacctctgcaggccttccaccggcgggctgtgcacctgcagctgttcaaacagttcatcgaagcccggctggagaagctcaacaagggggagggcttctcagatcaattcgagcaggagatcactggctgcggggcctcctcaggggcccttcgatcctatcagctctgggccgacaatctaaagaaaggtggtggcgccctcctgcactcagtcaaggccaagacccaaccagccgtcaagaacatgtaccgctcggccaagagtggcttgaagggggtgcagagccttctaatgtataaggatggggactctgtcctgcagagggggggctctctgagggccccagccctccccagccgctcagaccgcctgcagcaacgcctcccaatcactcagcactttggaaagaaccggccccttcgccccagcaggagacgccagctggaagagggaacttccgagcccccaggggcggggacacccccactgagccctgaggatgaggggtgcccgtgggcagaagaagctctggacagcagcttcttggggtctggagaagaactggatttgttgagcgagattctggacagtcttagcatgggagccaagagcgcaggcagcctgagaccgagccagagtttagactgctgtcacagaggagacctggacagctgcttcagcctgcccaacataccaagatggcaaccagacgataagaaactaccagagccggagccccagcccctttccctgccatccctgcaaaatgcctcgtctttggatgccaccagctcttcaaaggactccaggtcccagctgataccctcagagtccgaccaagaagtcacgtctccatcccagtcctcaacagcttctgcagacccaagcatctggggggaccccaaaccctctcctctcacagagcccctaattcttcatctcaccccttcccacaaggcagctgaagattctacagcccaggaaaaccccactccctggctctccactgcacccactgagcccagccctccagaaagcccccaaattctggcccccacaaagcccaactttgatatagcctggacgtcccagccccttgatccttcctcagaccccagttctctggaggaccccagagcccggcctcccaaagccctgctggcagagcgcgctcacctccagccacgggaggaaccaggagccctgaattcccctgctacacccaccagcaactgtcaaaagtcccagcccagcagccggcccagagtcgctgatcttaagaagtgctttgagggttaagaatcaggggtccaagagagaccccagtccctcaataaagccacaagagcccaaaaaagctggtttttttcctggtgaatttctctggtgccctcactctgctcggaaatccatcccacccacctctgtccctccaagggcagcctctctaactggctcctagcagggaattccaggaagcctcctggtcttctagaatcctggcaaccttacaattcctctcggcatttgtcacttccatctcagctaatgcacccaccagctcaaacacaccaataaagcttttgttacatctc

SEQ ID NO: 8138 - DNA, 2395 bp, Homo sapiens
acacaggaagctgagccggcttggggcccagcatacacaggcccccaggacccctggggagagggccccgctgggctggccctgcagggaccatggaatccagagctgagaagctatgcagatggtgcctaaattctgcttcccttttgatgtggaaagggagccccccagccccgccgtgcagcatttcaccttcgccctcacagaccttgccggcaaccgcagatttggtttctgccgcctgcgggcgggtacccagagctgtctctgcatcctcagccacctgccttggttcgaggtgttttacaagctattgaacacagtgggagacctcctagcccaggaccaagtcaccgaggcagaggaacttcttcaaaatctgtttcagcagtccctgtctgggccccaggcctcagtggggcttgagctgggcagcggagtgacggtctccagcgggcagggtatccccccccctacccgggggaatagcaagccgctttcctgcttcgtggccccggactccggccgcctgccatccatccctgagaacaggaacctaacggagctggtggtggccgtgactgacgagaacatcgtggggctgttcgcggcgctcctggccgagagaagagtcctgctcaccgccagcaaactcagcaccctgacctcgtgcgtccacgcgtcctgcgcgctcctgtaccccatgcgctgggagcacgtgctgatccccacgctgcccccacacctgctggactactgctgcgcgcccatgccctacctcattggagtgcacgccagtctcgccgagagagtacgagaaaaagccctggaggacgtcgtggtgctgaacgtggacgccaataccttggagacgacctttaacgacgtgcaggcgctgcctccagacgtggtgtccctgctgaggctccggctcaggaaggtcgccctggcccccggggaaggggtgtcccgtctcttcctcaaagcccaggccctgctcttcggggggtaccgcgacgcactcgtctgcagcccgggccagccagtgaccttcagtgaggaagtcttcttggcccagaagcctggggcacctctgcaggccttccaccggcgggctgtgcacctgcagctgttcaaacagttcatcgaagcccggctggagaagctcaacaagggggagggcttctcagatcaattcgagcaggagatcactggctgcggggcctcctcaggggcccttcgatcctatcagctctgggccgacaatctaaagaaaggtggtggcgccctcctgcactcagtcaaggccaagacccaaccagccgtcaagaacatgtaccgctcggccaagagtggcttgaagggggtgcagagccttctaatgtataaggatggggactctgtcctgcagagggggggctctctgagggccccagccctccccagccgctcagaccgcctgcagcaacgcctcccaatcactcagcactttggaaagaaccggccccttcgccccagcaggagacgccagctggaagagggaacttccgagcccccaggggcggggacacccccactgagccctgaggatgaggggtgcccgtgggcagaagaagctctggacagcagcttcttggggtctggagaagaactggatttgttgagcgagattctggacagtcttagcatgggagccaagagcgcaggcagcctgagaccgagccagagtttagactgctgtcacagaggagacctggacagctgcttcagcctgcccaacataccaagatggcaaccagacgataagaaactaccagagccggagccccagcccctttccctgccatccctgcaaaatgcctcgtctttggatgccaccagctcttcaaaggactccaggtcccagctgataccctcagagtccgaccaagaagtcacgtctccatcccagtcctcaacagcttctgcagacccaagcatctggggggaccccaaaccctctcctctcacagagcccctaattcttcatctcaccccttcccacaaggcagctgaagattctacagcccaggaaaaccccactccctggctctccactgcacccactgagcccagccctccagaaagcccccaaattctggcccccacaaagcccaactttgatatagcctggacgtcccagccccttgatccttcctcagaccccagttctctggaggaccccagagcccggcctcccaaagccctgctggcagagcgcgctcacctccagccacgggaggaaccaggagccctgaattcccctgctacacccaccagcaactgtcaaaagtcccagcccagcagccggcccagagtcgctgatcttaagaagtgctttgagggttaagaatca

SEQ ID NO: 8139 - DNA, 4573 bp, Homo sapiens
cgcggtttgtccgcgcctctgctaccccctgcgcaggcgctcaaggagctcttggactccaggttcccgcggctgggagaaaaggaggcggggatccgaagggggaaatgactctgaggcgcccggacgtcgctcggaagccaatcagagagcgtgacgtcagtttggcgcggagtttggcggccggggcttacagtggcgggagttggaggcgataacgatttgtgttgtgagaggcgcaagctgcgatttctgctgaacttggaggcatttctacgacttttctctcagctgaggcttttcctccgaccctgatgctcttcaattcggtgctccgccagccccagcttggcgtcctgagaaatggatggtcttcacaataccctcttcaatcccttctgactggttatcagtgcagtggtaatgatgaacacacttcttatggagaaacaggagtcccagttcctccttttggatgtaccttctcttctgctcccaatatggaacatgtactagcagttgccaatgaagaaggctttgttcgattgtataacacagaatcacaaagtttcagaaagaagtgcttcaaagaatggatggctcactggaatgccgtctttgacctggcctgggttcctggtgaacttaaacttgttacagcagcaggtgatcaaacagccaaattttgggacgtaaaagctggtgagctgattggaacatgcaaaggtcatcaatgcagcctcaagtcagttgccttttctaagtttgagaaagctgtattctgtacgggtggaagagatggcaacattatggtctgggataccaggtgcaacaaaaaagatgggttttataggcaagtgaatcaaatcagtggagctcacaatacctcagacaagcaaaccccttcaaaacccaagaagaaacagaattcaaaaggacttgctccttctgtggatttccagcaaagtgttactgtggtcctctttcaagacgagaataccttagtctcagcaggagctgtggatgggataatcaaagtatgggatttacgtaagaattatactgcttatcgacaagaacccatagcatccaagtctttcctgtacccaggtagcagcactcgaaaacttggatattcaagtctgattttggattccactggctctactttatttgctaattgcacagacgataacatctacatgtttaatatgactgggttgaagacttctccagtggctattttcaatggacaccagaactctaccttttatgtaaaatccagccttagtccagatgaccagtttttagtcagtggctcaagtgatgaagctgcctacatatggaaggtctccacaccctggcaacctcctactgtgctcctgggtcattctcaagaggtcacgtctgtgtgctggtgtccatctgacttcacaaagattgctacctgttctgatgacaatacactaaaaatctggcgcttgaatagaggcttagaggagaaaccaggaggtgataaactttccacggtgggttgggcctctcagaagaaaaaagagtcaagacctggcctagtaacagtaacgagtagccagagtactcctgccaaagcccccagggcaaagtgcaatccatccaattcttccccgtcatccgcagcttgtgccccaagctgtgctggagacctccctcttccttcaaatactcctacgttctctattaaaacctctcctgccaaggcccggtctcccatcaacagaagaggctctgtctcctccgtctctcccaagccaccttcatctttcaagatgtcgattagaaactgggtgacccgaacaccttcctcatcaccacccatcactccacctgcttcggagaccaagatcatgtctccgagaaaagcccttattcctgtgagccagaagtcatcccaagcagaggcttgctctgagtctagaaatagagtaaagaggaggctagactcaagctgtctggagagtgtgaaacaaaagtgtgtgaagagttgtaactgtgtgactgagcttgatggccaagttgaaaatcttcatttggatctgtgctgccttgctggtaaccaggaagaccttagtaaggactctctaggtcctaccaaatcaagcaaaattgaaggagctggtaccagtatctcagagcctccgtctcctatcagtccgtatgcttcagaaagctgtggaacgctacctcttcctttgagaccttgtggagaagggtctgaaatggtaggcaaagagaatagttccccagagaataaaaactggttgttggccatggcagccaaacggaaggctgagaatccatctccacgaagtccgtcatcccagacacccaattccaggagacagagcggaaagaaattgccaagcccggtcaccatcacgcccagctccatgaggaaaatctgcacatacttccatagaaagtcccaggaggacttctgtggtcctgaacactcaacagaattatagattctaatctgagtgagttactgagctttggtccactaaaacaagctgagctttggtccactaaaacaagatgaaaaatacaagagtgactctataactctggtctttaagaaagctgccttttcatttttagacaaaatcttttcaacgctgaaatgtacctaatctggttctactaccataatgtatatgcagcttcccgaggatgaatgctgtgtttaaatttcataaagtaaatttgtcactctagcattttgaatgaatagtcttcactttttaaattattcatcttctctataataatgacatcccagttcatggaggcaaaaaacaagtttcttgttatcctgaaactttctatgctcagtggaaagtatctgccagccacagcatgaggcctgtgaaggctgactgagaaatcctctgctgaagacccctggttctgttctgcctccaacatgtataattttatttgaaatacataatcttttcactatgcttttgtggggttttttttaagtatgtgtaaaaatgtgatgctcagataagtacatttatatcagttcagtgttaaaatgcagtctcttgagttaaagtcatctttattttaaatgcagtgataaatgtcaactcttcggagaaactaggagaacaacaacagaaagctgtgtttgtcttttttctctcaaatatatctcccgtatgagatttcaggtccccatgttttcaccaagcaatctgctatgtcagccaacccaacatcactttctacaggaggttatgatttttgccatttactagaggaagatgttttatgaaatcaatttggggtttgaattcaggtgcagtcatcagttctttaggggctgcaatgttttaaaaaaaataagtcatcagattttaagaaaaaagtgatgatttcttattgatatttttgtaacagaatatagctcttaactgaaaatccagaaccagaaacataaatcttgagtttcttttcatgtacataaaaagcaatagccttttagtatagatagccctgagccaaaaagtaatagaattttctctagatatttaatacagagagtgtatagactgactctaagttaataatgtgcaaaatatcttaaacatccctccccttattcaacaattatgtatcagtgatcttgaaccattgttttatatttttcacctttgtaacctcatggaaagaggctttacatactttctatgtactatttacttagaagggagcccccttccagtcatgaaacttcatttgttttatccatatccctgaggactgtgtagactttatgtcagtttttgtcattatttgaaaatctattctgacaactttttaattcctttgatcttataagttaaagctgtaacaactgaaattgcatggatcaagtaagcatagttttatccagggagaaaaataaaaggaagccatagaattgctctggtcaaaaccaagcacaccatagccttaactgaatatttaggaaatctgcctaatctgcttatatttggtgtttgttttttgactgttgggctttgggaagatgttatttatgaccaatatctgccagtaacgctgtttatctcacttgctttgaaagccaatgggggaaaaaaatccatgaaaaaaaaaagattgataaagtagatgattttgtttgtatccctacccatctcctggcagccctactgagtgaaattgggatacatttggctgtcagaaattataccgagtctactgggtataacatgtctcacttggaaagctagtacttttaaatgggtgccaaaggtcaactgtaatgagataattatccctgcctgtgtccatgtcagactttgagctgatcctgaataataaagccttttaccttatctgatgtccttttctgagctttttgcattacctagaagcagtctacaaaaaagaactatagtagtcaagaatcccttctacttgttcattaaaatgtttattcccaaagttataatctatttcaagctgaaagagcttttaataaaaaacatcttgcttg

SEQ ID NO: 8140 - DNA, 1637 bp, Homo sapiens
aacgatttgtgttgtgagaggcgcaagctgcgatttctgctgaacttggaggcatttctacgacttttctctcagctgaggcttttcctccgaccctgatgctcttcaattcggtgctccgccagccccagcttggcgtcctgagaaatggatggtcttcacaataccctcttcaatcccttctgactggttatcagtgcagtggtaatgatgaacacacttcttatggagaaacaggagtcccagttcctccttttggatgtaccttctcttctgatgacaatacactaaaaatctggcgcttgaatagaggcttagaggagaaaccaggaggtgataaactttccacggtgggttgggcctctcagaagaaaaaagagtcaagacctggcctagtaacagtaacgagtagccagagtactcctgccaaagcccccagggcaaagtgcaatccatccaattcttccccgtcatccgcagcttgtgccccaagctgtgctggagacctccctcttccttcaaatactcctacgttctctattaaaacctctcctgccaaggcccggtctcccatcaacagaagaggctctgtctcctccgtctctcccaagccaccttcatctttcaagatgtcgattagaaactgggtgacccgaacaccttcctcatcaccacccatcactccacctgcttcggagaccaagatcatgtctccgagaaaagcccttattcctgtgagccagaagtcatcccaagcagaggcttgctctgagtctagaaatagagtaaagaggaggctagactcaagctgtctggagagtgtgaaacaaaagtgtgtgaagagttgtaactgtgtgactgagcttgatggccaagttgaaaatcttcatttggatctgtgctgccttgctggtaaccaggaagaccttagtaaggactctctaggtcctaccaaatcaagcaaaattgaaggagctggtaccagtatctcagagcctccgtctcctatcagtccgtatgcttcagaaagctgtggaacgctacctcttcctttgagaccttgtggagaagggtctgaaatggtaggcaaagagaatagttccccagagaataaaaactggttgttggccatggcagccaaacggaaggctgagaatccatctccacgaagtccgtcatcccagacacccaattccaggagacagagcggaaagaaattgccaagcccggtcaccatcacgcccagctccatgaggaaaatctgcacatacttccatagaaagtcccaggaggacttctgtggtcctgaacactcaacagaattatagattctaatctgagtgagttactgagctttggtccactaaaacaagctgagctttggtccactaaaacaagatgaaaaatacaagagtgactctataactctggtctttaagaaagctgccttttcatttttagacaaaatcttttcaacgctgaaatgtacctaatctggttctactaccataatgtatatgcagcttcccgaggatgaatgctgtgtttaaatttcataaagtaaatttgtcactctagcattttgaatgaatagtcttcactttttaaattattcatcttctctataataatgacat

SEQ ID NO: 8141 - DNA, 2530 bp, Homo sapiens
agtttggcggccggggcttacagtggcgggagttggaggcgataacgatttgtgttgtgagaggcgcaagctgcgatttctgctgaacttggaggcatttctacgacttttctctcagctgaggcttttcctccgaccctgatgctcttcaattcggtgctccgccagccccagcttggcgtcctgagaaatgctcccaatatggaacatgtactagcagttgccaatgaagaaggctttgttcgattgtataacacagaatcacaaagtttcagaaagaagtgcttcaaagaatggatggctcactggaatgccgtctttgacctggcctgggttcctggtgaacttaaacttgttacagcagcaggtgatcaaacagccaaattttgggacgtaaaagctggtgagctgattggaacatgcaaaggtcatcaatgcagcctcaagtcagttgccttttctaagtttgagaaagctgtattctgtacgggtggaagagatggcaacattatggtctgggataccaggtgcaacaaaaaagatgggttttataggcaagtgaatcaaatcagtggagctcacaatacctcagacaagcaaaccccttcaaaacccaagaagaaacagaattcaaaaggacttgctccttctgtggatttccagcaaagtgttactgtggtcctctttcaagacgagaataccttagtctcagcaggagctgtggatgggataatcaaagtatgggatttacgtaagaattatactgcttatcgacaagaacccatagcatccaagtctttcctgtacccaggtagcagcactcgaaaacttggatattcaagtctgattttggattccactggctctactttatttgctaattgcacagacgataacatctacatgtttaatatgactgggttgaagacttctccagtggctattttcaatggacaccagaactctaccttttatgtaaaatccagccttagtccagatgaccagtttttagtcagtggctcaagtgatgaagctgcctacatatggaaggtctccacaccctggcaacctcctactgtgctcctgggtcattctcaagaggtcacgtctgtgtgctggtgtccatctgacttcacaaagattgctacctgttctgatgacaatacactaaaaatctggcgcttgaatagaggcttagaggagaaaccaggaggtgataaactttccacggtgggttgggcctctcagaagaaaaaagagtcaagacctggcctagtaacagtaacgagtagccagagtactcctgccaaagcccccagggcaaagtgcaatccatccaattcttccccgtcatccgcagcttgtgccccaagctgtgctggagacctccctcttccttcaaatactcctacgttctctattaaaacctctcctgccaaggcccggtctcccatcaacagaagaggctctgtctcctccgtctctcccaagccaccttcatctttcaagatgtcgattagaaactgggtgacccgaacaccttcctcatcaccacccatcactccacctgcttcggagaccaagatcatgtctccgagaaaagcccttattcctgtgagccagaagtcatcccaagcagaggcttgctctgagtctagaaatagagtaaagaggaggctagactcaagctgtctggagagtgtgaaacaaaagtgtgtgaagagttgtaactgtgtgactgagcttgatggccaagttgaaaatcttcatttggatctgtgctgccttgctggtaaccaggaagaccttagtaaggactctctaggtcctaccaaatcaagcaaaattgaaggagctggtaccagtatctcagagcctccgtctcctatcagtccgtatgcttcagaaagctgtggaacgctacctcttcctttgagaccttgtggagaagggtctgaaatggtaggcaaagagaatagttccccagagaataaaaactggttgttggccatggcagccaaacggaaggctgagaatccatctccacgaagtccgtcatcccagacacccaattccaggagacagagcggaaagaaattgccaagcccggtcaccatcacgcccagctccatgaggaaaatctgcacatacttccatagaaagtcccaggaggacttctgtggtcctgaacactcaacagaattatagattctaatctgagtgagttactgagctttggtccactaaaacaagctgagctttggtccactaaaacaagatgaaaaatacaagagtgactctataactctggtctttaagaaagctgccttttcatttttagacaaaatcttttcaacgctgaaatgtacctaatctggttctactaccataatgtatatgcagcttcccgaggatgaatgctgtgtttaaatttcataaagtaaatttgtcactctagcattttgaatgaatagtcttcactttttaaattattcatcttctctataataatgacatcccagttcatgga

SEQ ID NO: 8142 - DNA, 2634 bp, Homo sapiens
tgggcatagatttcctctttgagaacatcaacctgatttttgagactttttgaaaaaattctttgtgaactacggagggtagaggtatcacacccaactatgaagatcagcatcctgctcatgttcctttggggattatcctgtgctctcccagtaaccaggtatcaaaataatgaatctgaggattctgaagaatggaagggtcatttggctcaggcaccaacaccacccttggcaaatgaagaccccagtgacagcactcagtcagaggagggcctgggctctgatgatcatcaatacatttataggctagctggtggcttctccaggagcacaggaaaaggaggagatgataaagatgacgatgaagatgacagtggagatgacacctttggtgacgatgacagtggcccagggcccaaagacagacaagaaggaggaaactccagactgggaagtgatgaggactctgatgacaccatacaagccagtgaagagagtgccccacaagggcaagacagtgcccaagataccaccagtgagagcagggaacttgacaatgaggaccgggtggacagcaagcctgagggaggtgactccactcaagagagtgagagtgaagagcactgggtgggaggtggcagtgatggggagagcagccatggagacggctccgagttggacgatgagggaatgcagagtgatgacccagagagcatcaggagtgaaaggggaaactccagaatgaacagtgcaggcatgaaatcaaaagaatctggagaaaacagtgagcaagcaaacactcaagattcaggtggcagccaattgctggagcatcccagtaggaaaatttttaggaagtctcgcatctcagaggaagatgacagaagcgagcttgatgacaacaacacaatggaagaagtcaagagtgactctacagaaaacagcaactccagagacactggcctcagccaacccaggagagacagcaagggtgactctcaagaagacagcaaggagaatctgtcccaggaagagagccaaaacgtagatggtcccagcagtgagtccagccaagaggccaacctgtcatctcaagagaacagcagtgagtctcaggaagaggtggtgagtgagtccaggggagataaccccgaccccacaactagttatgtagaagaccaggaagacagtgactccagcgaggaggacagctcgcacacactctcccactcaaaaagtgaatccagagaggagcaagcagacagcgaatccagtgagagcctcaacttctcagaggaaagcccggagtcccctgaggatgagaacagctccagccaggagggcctccagtctcacagcagctcagcagagagtcagagcgaggaaagccattctgaggaagacgacagtgactctcaagacagcagcagatccaaagaagatagcaactccacggagagcaaatcaagcagtgaggaagatggccagttgaaaaacattgagatagagagccggaaattaacagttgatgcctatcacaacaaacccattggggaccaagatgacaatgactgccaagacggctattagcatcagctgtcctaagaagcagttgtcacataaaggagtcttagggacttgaaaatgtatcatgataactataatttattgatgttttgatcaaaagaataaccagatgccatatttttcctgaaaggaattgctggacattacacttgtttttagggtgtcatcatttcacagaggtttaaatactgtggagtgacaccagaacacagccaaagaggctagaagcaagaaaggatctgcatgataactttgcagctgagatagttcctaattcatcaacgtaacaaacaaagctattgggtgtccatgatataccaggcactatgctaggtgttgagaatgtaaagcaggttaagacttgtttcttgctcctgaggagcgtatagaaggacccacaaagctacagagttaaagagggatatgtataagagaaacaagaattgttacaacccagtatggtgagtgccaagacagagagctatgaacacgatatctatctgggaacactgagaagggtgaccaatgcgttggagaacgagggagggcttcatagcagaagacattggagttggaaggttgcatagggtttcctcattggagaccgggaaattctattcttgggataaataatagtaaattctataggattcaatacttagtttgcaaaagcactttgaaattatggcacagtgagttgttttggataagaaaatctttttctcccaattaatttaccaattcatcatttttttttttttgtagaactcccataaacatcaccttactaatcactggtgatgataagaaggattgggtcaggaagagtgggagaaagaaattcctctttacgtagatactttttagctttattttttctaaaatcagtttgcgtgcaatgctagaaaaaaactgttctctgagtcctttacagagcaaaattctgtatgtaagattcaattgatttttgacaaataccatttgaaatattacctcaacataaaatacttgttttgtaataaagattataatacccagaagaaa

SEQ ID NO: 8143 - DNA, 2682 bp, Homo sapiens
tgggcatagatttcctctttgagaacatcaacctgatttttgagactttttgaaaaaattctttgtgaactacggagggtagaggtatcacacccaactatgaagatcagcatcctgctcatgttcctttggggattatcctgtgctctcccagtaaccaggtatcaaaataatgaatctgaggattctgaagaatggaagggtcatttggctcaggcaccaacaccacccttggagagcagtgagtcatcagaaggcagtaaagttagctcagaggaacaggcaaatgaagaccccagtgacagcactcagtcagaggagggcctgggctctgatgatcatcaatacatttataggctagctggtggcttctccaggagcacaggaaaaggaggagatgataaagatgacgatgaagatgacagtggagatgacacctttggtgacgatgacagtggcccagggcccaaagacagacaagaaggaggaaactccagactgggaagtgatgaggactctgatgacaccatacaagccagtgaagagagtgccccacaagggcaagacagtgcccaagataccaccagtgagagcagggaacttgacaatgaggaccgggtggacagcaagcctgagggaggtgactccactcaagagagtgagagtgaagagcactgggtgggaggtggcagtgatggggagagcagccatggagacggctccgagttggacgatgagggaatgcagagtgatgacccagagagcatcaggagtgaaaggggaaactccagaatgaacagtgcaggcatgaaatcaaaagaatctggagaaaacagtgagcaagcaaacactcaagattcaggtggcagccaattgctggagcatcccagtaggaaaatttttaggaagtctcgcatctcagaggaagatgacagaagcgagcttgatgacaacaacacaatggaagaagtcaagagtgactctacagaaaacagcaactccagagacactggcctcagccaacccaggagagacagcaagggtgactctcaagaagacagcaaggagaatctgtcccaggaagagagccaaaacgtagatggtcccagcagtgagtccagccaagaggccaacctgtcatctcaagagaacagcagtgagtctcaggaagaggtggtgagtgagtccaggggagataaccccgaccccacaactagttatgtagaagaccaggaagacagtgactccagcgaggaggacagctcgcacacactctcccactcaaaaagtgaatccagagaggagcaagcagacagcgaatccagtgagagcctcaacttctcagaggaaagcccggagtcccctgaggatgagaacagctccagccaggagggcctccagtctcacagcagctcagcagagagtcagagcgaggaaagccattctgaggaagacgacagtgactctcaagacagcagcagatccaaagaagatagcaactccacggagagcaaatcaagcagtgaggaagatggccagttgaaaaacattgagatagagagccggaaattaacagttgatgcctatcacaacaaacccattggggaccaagatgacaatgactgccaagacggctattagcatcagctgtcctaagaagcagttgtcacataaaggagtcttagggacttgaaaatgtatcatgataactataatttattgatgttttgatcaaaagaataaccagatgccatatttttcctgaaaggaattgctggacattacacttgtttttagggtgtcatcatttcacagaggtttaaatactgtggagtgacaccagaacacagccaaagaggctagaagcaagaaaggatctgcatgataactttgcagctgagatagttcctaattcatcaacgtaacaaacaaagctattgggtgtccatgatataccaggcactatgctaggtgttgagaatgtaaagcaggttaagacttgtttcttgctcctgaggagcgtatagaaggacccacaaagctacagagttaaagagggatatgtataagagaaacaagaattgttacaacccagtatggtgagtgccaagacagagagctatgaacacgatatctatctgggaacactgagaagggtgaccaatgcgttggagaacgagggagggcttcatagcagaagacattggagttggaaggttgcatagggtttcctcattggagaccgggaaattctattcttgggataaataatagtaaattctataggattcaatacttagtttgcaaaagcactttgaaattatggcacagtgagttgttttggataagaaaatctttttctcccaattaatttaccaattcatcatttttttttttttgtagaactcccataaacatcaccttactaatcactggtgatgataagaaggattgggtcaggaagagtgggagaaagaaattcctctttacgtagatactttttagctttattttttctaaaatcagtttgcgtgcaatgctagaaaaaaactgttctctgagtcctttacagagcaaaattctgtatgtaagattcaattgatttttgacaaataccatttgaaatattacctcaacataaaatacttgttttgtaataaagattataatacccagaagaaa

SEQ ID NO: 8144 - DNA, 4281 bp, Homo sapiens
tacagccattgattattattattcctaaagaaaatgaagataattacatatttttgcatttgggcagtagcatgggccattccagttcctcaaagcaaaccactggagagacatgtcgaaaaatccatgaatttgcatctcctagcaagatcaaatgtgtcagtacaggatgagttaaatgccagtggaaccatcaaagaaagtggtgtcctggtgcatgaaggtgatagaggaaggcaagagaatacccaagatggtcacaagggagaagggaatggctctaagtgggcagaagtaggagggaagagtttttctacatattccacattagcaaacgaagaggggaatattgagggctggaatggggacacaggaaaagcagaaacatatggtcatgatggaatacatgggaaagaagaaaacatcacagcaaatggcatccagggacaagtaagcatcattgacaatgctggagccacaaacagaagcaacactaatggaaatactgataagaatacccaaaatggggatgttggcgatgcaggtcacaatgaggatgtcgctgttgtccaagaagatggacctcaagtagctggaagcaataacagtacagacaatgaggatgaaataattgagaattcctgtagaaacgagggtaatacaagtgaaataacacctcagatcaacagcaagagaaatgggactaaggaagctgaggtaacaccaggcactggagaagatgctggcctggataattccgatgggagtcctagtgggaatggagcagatgaggatgaagacgagggttctggtgatgatgaagatgaagaagcagggaatggaaaagacagtagtaataacagcaagggccaggagggccaggaccatgggaaagaagatgatcatgatagtagcataggtcaaaattcagatagtaaagaatattatgaccctgaaggcaaagaagatccccataatgaagttgatggagacaagacctccaagagtgaggagaattctgctggtattccagaagacaatggcagccaaagaatagaggacacccagaagctcaaccatagagaaagcaaacgcgtagaaaatagaatcaccaaagaatcagagacacatgctgttgggaagagccaagataagggaatagaaatcaagggtcccagcagtggcaacagaaatattaccaaagaagttgggaaaggcaacgaaggtaaagaggataaaggacaacatggaatgatcttgggcaaaggcaatgtcaagacacaaggagaggttgtcaacatagaaggacctggccaaaaatcagaaccaggaaataaagttggacacagcaatacaggtagtgacagcaatagtgatggatatgacagttatgattttgatgataagtccatgcaaggagatgatcccaatagcagtgatgaatctaatggcaatgatgatgctaattcagaaagtgacaataacagcagtagccgaggagatgcttcttataactctgatgaatcaaaagataatggcaatggcagtgactcaaaaggagcagaagatgatgacagtgatagcacatcagacactaataatagtgacagtaatggcaatggtaacaatgggaatgatgacaatgacaaatcagacagtggcaaaggtaaatcagatagcagtgacagtgatagtagtgatagcagcaatagcagtgatagtagtgacagcagtgacagtgacagcagtgatagcaacagtagcagtgatagtgacagcagtgacagtgacagcagtgatagcagtgacagtgatagtagtgatagcagcaatagcagtgacagtagtgacagcagtgatagcagtgacagtagtgatagtagtgacagcagtgacagcaagtcagacagcagcaaatcagagagcgacagcagtgatagtgacagtaagtcagacagcagtgacagcaacagcagtgacagtagtgacaacagtgatagcagcgacagcagcaatagcagtaacagcagtgatagtagtgacagcagtgatagcagtgacagcagcagtagcagtgacagcagcaacagcagtgatagtagtgacagtagtgacagcagcaatagcagtgagagcagtgatagtagtgacagcagtgatagtgacagcagtgatagtagtgacagcagtaatagtaacagcagcgatagtgacagcagcaacagcagcgatagcagtgacagcagcaacagcagtgacagcagtgatagcagtgacagcagcaacagcagtgacagtagcgatagcagtgacagcagcaacagcagtgacagcagtgatagcagtgacagcagtgatagtagtgacagcagcaacagcagtgatagcaacgacagcagcaatagcagtgacagcagtgatagcagcaacagcagtgatagcagcaacagcagtgatagcagtgatagcagtgacagcagtgatagcgacagcagcaatagcagtgacagcagtaatagtagtgacagcagcgatagcagcaacagcagtgatagcagcgacagcagcgatagcagtgacggcagtgatagcgacagcagcaatagaagtgacagtagtaatagtagtgacagcagcgatagcagtgacagcagcaacagcagtgacagcagtgatagcagtgacagcaacgaaagcagcaatagcagtgacagcagtgatagcagcaacagcagtgatagtgacagcagtgatagcagcaacagcagtgacagcagtgatagcagcaacagcagtgatagcagtgaaagcagtaatagtagtgacaacagcaatagcagtgacagcagcaacagcagtgacagcagtgatagcagtgacagcagtaatagtagtgacagcagcaatagcagtgacagcagcaacagcagtgacagcagtgatagcaatagcagcgacagcagtgacagcagcaacagcagcgatagcagtgacagcagtgatagcagtgacagcagtgacagcagtgatagcagcaacagcagtgatagcagtgacagcagtgacagcagtgatagcagtaatagtagtgacagcagcaatagcagtgacagcagcaacagcagtgacagcagcgatagcagtgacagcagcgatagcagtgacagcagcgatagcagtgacagcagtgacagcagcaatagcagtgacagcagtgacagcagcgacagcagtgatagcagtgacagcagtgacagcagcgacagcagtgatagcagtgaaagcagtgatagcagtgacagcagcaatagcagtgacagcagcgatagcagcgacagcagcgacagcagcgatagcagtgacagcagcgatagcagtgacagcagtgacagcagcaatagcagtgacagcagtgacagcagcgacagcagtgatagcagtgacagcagcaacagcagtgacagcagtgacagcagtgaaagcagcgacagcagtgacagcagcgacagcagtgacagcagcgatagcagcgacagcagcgacagcagcgatagcagtgacagcagcaatagcagtgatagcagcgacagcagtgatagcagtgacagcagcgacagcagcgatagcagcgacagcagcgatagtagtgatagcagtgacagcagtgacagcagcgacagcagtgacagcagcgacagcagtgacagcagcgacagcagtgacagcaatgaaagcagcgacagcagtgacagcagcgatagcagtgacagcagcaacagcagtgacagcagcgacagcagtgatagcagtgacagcacatctgacagcaatgatgagagtgacagccagagcaagtctggtaacggtaacaacaatggaagtgacagtgacagtgacagtgaaggcagtgacagtaaccactcaaccagtgatgattagaacaaaagaaaaacccgtaagattccttttgtgaaaagtttggtaatgggataggaaaaaaagatttccaagaaagtaaagaaaggggagaaataaacataagacgtatgtaaacaaaaacaactgggggaatcaaatcaaacagttggattcagaaccaagacctaactcctgcagagacagactctgaatgcatgacctttggtacatgcctgttaatattcatgttctgaaaatattttgttaaaagtgtaaatctaaacataaaagaacaattaaaatattctttaatacttcacacagaaacctcaagtaatcactacatgataacttcaatttaag

SEQ ID NO: 8145 - DNA, 4331 bp, Homo sapiens
atgcaaaagtccaggacagtgggccactttcagtcttcaaagagaaagataagaaattctggattttcaaaatccttttgaagccttttaagccattgattattattattcctaaagaaaatgaagataattacatatttttgcatttgggcagtagcatgggccattccagttcctcaaagcaaaccactggagagacatgtcgaaaaatccatgaatttgcatctcctagcaagatcaaatgtgtcagtacaggatgagttaaatgccagtggaaccatcaaagaaagtggtgtcctggtgcatgaaggtgatagaggaaggcaagagaatacccaagatggtcacaagggagaagggaatggctctaagtgggcagaagtaggagggaagagtttttctacatattccacattagcaaacgaagaggggaatattgagggctggaatggggacacaggaaaagcagaaacatatggtcatgatggaatacatgggaaagaagaaaacatcacagcaaatggcatccagggacaagtaagcatcattgacaatgctggagccacaaacagaagcaacactaatggaaatactgataagaatacccaaaatggggatgttggcgatgcaggtcacaatgaggatgtcgctgttgtccaagaagatggacctcaagtagctggaagcaataacagtacagacaatgaggatgaaataattgagaattcctgtagaaacgagggtaatacaagtgaaataacacctcagatcaacagcaagagaaatgggactaaggaagctgaggtaacaccaggcactggagaagatgctggcctggataattccgatgggagtcctagtgggaatggagcagatgaggatgaagacgagggttctggtgatgatgaagatgaagaagcagggaatggaaaagacagtagtaataacagcaagggccaggagggccaggaccatgggaaagaagatgatcatgatagtagcataggtcaaaattcagatagtaaagaatattatgaccctgaaggcaaagaagatccccataatgaagttgatggagacaagacctccaagagtgaggagaattctgctggtattccagaagacaatggcagccaaagaatagaggacacccagaagctcaaccatagagaaagcaaacgcgtagaaaatagaatcaccaaagaatcagagacacatgctgttgggaagagccaagataagggaatagaaatcaagggtcccagcagtggcaacagaaatattaccaaagaagttgggaaaggcaacgaaggtaaagaggataaaggacaacatggaatgatcttgggcaaaggcaatgtcaagacacaaggagaggttgtcaacatagaaggacctggccaaaaatcagaaccaggaaataaagttggacacagcaatacaggtagtgacagcaatagtgatggatatgacagttatgattttgatgataagtccatgcaaggagatgatcccaatagcagtgatgaatctaatggcaatgatgatgctaattcagaaagtgacaataacagcagtagccgaggagatgcttcttataactctgatgaatcaaaagataatggcaatggcagtgactcaaaaggagcagaagatgatgacagtgatagcacatcagacactaataatagtgacagtaatggcaatggtaacaatgggaatgatgacaatgacaaatcagacagtggcaaaggtaaatcagatagcagtgacagtgatagtagtgatagcagcaatagcagtgatagtagtgacagcagtgacagtgacagcagtgatagcaacagtagcagtgatagtgacagcagtgacagtgacagcagtgatagcagtgacagtgatagtagtgatagcagcaatagcagtgacagtagtgacagcagtgatagcagtgacagtagtgatagtagtgacagcagtgacagcaagtcagacagcagcaaatcagagagcgacagcagtgatagtgacagtaagtcagacagcagtgacagcaacagcagtgacagtagtgacaacagtgatagcagcgacagcagcaatagcagtaacagcagtgatagtagtgacagcagtgatagcagtgacagcagcagtagcagtgacagcagcaacagcagtgatagtagtgacagtagtgacagcagcaatagcagtgagagcagtgatagtagtgacagcagtgatagtgacagcagtgatagtagtgacagcagtaatagtaacagcagcgatagtgacagcagcaacagcagcgatagcagtgacagcagcaacagcagtgacagcagtgatagcagtgacagcagcaacagcagtgacagtagcgatagcagtgacagcagcaacagcagtgacagcagtgatagcagtgacagcagtgatagtagtgacagcagcaacagcagtgatagcaacgacagcagcaatagcagtgacagcagtgatagcagcaacagcagtgatagcagcaacagcagtgatagcagtgatagcagtgacagcagtgatagcgacagcagcaatagcagtgacagcagtaatagtagtgacagcagcgatagcagcaacagcagtgatagcagcgacagcagcgatagcagtgacggcagtgatagcgacagcagcaatagaagtgacagtagtaatagtagtgacagcagcgatagcagtgacagcagcaacagcagtgacagcagtgatagcagtgacagcaacgaaagcagcaatagcagtgacagcagtgatagcagcaacagcagtgatagtgacagcagtgatagcagcaacagcagtgacagcagtgatagcagcaacagcagtgatagcagtgaaagcagtaatagtagtgacaacagcaatagcagtgacagcagcaacagcagtgacagcagtgatagcagtgacagcagtaatagtagtgacagcagcaatagcagtgacagcagcaacagcagtgacagcagtgatagcaatagcagcgacagcagtgacagcagcaacagcagcgatagcagtgacagcagtgatagcagtgacagcagtgacagcagtgatagcagcaacagcagtgatagcagtgacagcagtgacagcagtgatagcagtaatagtagtgacagcagcaatagcagtgacagcagcaacagcagtgacagcagcgatagcagtgacagcagcgatagcagtgacagcagcgatagcagtgacagcagtgacagcagcaatagcagtgacagcagtgacagcagcgacagcagtgatagcagtgacagcagtgacagcagcgacagcagtgatagcagtgaaagcagtgatagcagtgacagcagcaatagcagtgacagcagcgatagcagcgacagcagcgacagcagcgatagcagtgacagcagcgatagcagtgacagcagtgacagcagcaatagcagtgacagcagtgacagcagcgacagcagtgatagcagtgacagcagcaacagcagtgacagcagtgacagcagtgaaagcagcgacagcagtgacagcagcgacagcagtgacagcagcgatagcagcgacagcagcgacagcagcgatagcagtgacagcagcaatagcagtgatagcagcgacagcagtgatagcagtgacagcagcgacagcagcgatagcagcgacagcagcgatagtagtgatagcagtgacagcagtgacagcagcgacagcagtgacagcagcgacagcagtgacagcagcgacagcagtgacagcaatgaaagcagcgacagcagtgacagcagcgatagcagtgacagcagcaacagcagtgacagcagcgacagcagtgatagcagtgacagcacatctgacagcaatgatgagagtgacagccagagcaagtctggtaacggtaacaacaatggaagtgacagtgacagtgacagtgaaggcagtgacagtaaccactcaaccagtgatgattagaacaaaagaaaaacccgtaagattccttttgtgaaaagtttggtaatgggataggaaaaaaagatttccaagaaagtaaagaaaggggagaaataaacataagacgtatgtaaacaaaaacaactgggggaatcaaatcaaacagttggattcagaaccaagacctaactcctgcagagacagactctgaatgcatgacctttggtacatgcctgttaatattcatgttctgaaaatattttgttaaaagtgtaaatctaaacataaaagaacaattaaaatattctttaatacttcacacagaa

SEQ ID NO: 8146 - DNA, 2716 bp, Homo sapiens
acccgactccggaacctcttcccgcgccctgcccgggcgcctggctgcttggggtagaggccttccgccacacgcgcggccccgccccggccttcacgtgacctggcgtgcggagcgcgcacgcgggaacccgcgctggaggcgggcgagggccgaggggcagctagggagcgcggcttgaggagggcggggccgccccgcaggcccgccagtgtcctcagctgcctccgcgcgccaaagtcaaaccccgacacccgccggcgggccggtgagctcactagctgacccggcaggtcaggatctggcttagcggcgccgcgagctccagtgcgcgcacccgtggccgcctcccagccctctttgccggacgagctctgggccgccacaagactaaggaatggccaccccgcccaagagaagctgcccgtctttctcagccagctctgaggggacccgcatcaagaaaatctccatcgaagggaacatcgctgcagggaagtcaacatttgtgaatatccttaaacaattgtgtgaagattgggaagtggttcctgaacctgttgccagatggtgcaatgttcaaagtactcaagatgaatttgaggaacttacaatgtctcagaaaaatggtgggaatgttcttcagatgatgtatgagaaacctgaacgatggtcttttaccttccaaacatatgcctgtctcagtcgaataagagctcagcttgcctctctgaatggcaagctcaaagatgcagagaaacctgtattattttttgaacgatctgtgtatagtgacaggtatatttttgcatctaatttgtatgaatctgaatgcatgaatgagacagagtggacaatttatcaagactggcatgactggatgaataaccaatttggccaaagccttgaattggatggaatcatttatcttcaagccactccagagacatgcttacatagaatatatttacggggaagaaatgaagagcaaggcattcctcttgaatatttagagaagcttcattataaacatgaaagctggctcctgcataggacactgaaaaccaacttcgattatcttcaagaggtgcctatcttaacactggatgttaatgaagactttaaagacaaatatgaaagtctggttgaaaaggtcaaagagtttttgagtactttgtgatcttgctgaagactacaggcagccaaatggttccagatacttcagctttgtgtatcttcgtaacttcatattaatataagtttctttagaaaacccaagtttttaatcgtttttgttttaaggaaaaaagatttttaaaatgaatcttatgcaaaactttttgaccagtttcttttcttttgttttttttttaaaaaagacatttaaagacaaagacattatttctcatagcaggaaatgtagaggtagatggttccagtatcagcatagtgactaaactacattataaaagatccagcttccttctgtcattcccctcttttgtcttcctcagcaggttggcttttttccctggtgcctctcacttcgttggtgaccagtttcttaaactgaaagctttaatgttacatagtaaatggtagtgtgtcctgtgtaaattagtgtacctattaaaagttgcaaagtggaattaaaggaatccctagaataaggattctgaagttttattttaaattattatcttcttaacagtttagtcccacctcttacttcctgcctcagtctgctttctctactgtctggattaattaggcagcctgctataaagttaaagtcacacatttctattttgcaaacactgtgattactctttgctttgtagtttgctttgctttgtagggttctgcttttaagtttttctctttttcagacaaattactgataaaaatgatattgctctatatgtaatatatcctgaaagcattattttttgttgaataggaaataaaattaatgaagacagaggctagaaagcatccattaattaatgagacacacttaactacttatctctaaaccatctatgtgaatatttgtaaaaataatgaatggactcatcttagttctgtatataaatatattttctttctagtttgtttagttaaggtgtgcagtgtttttcctgtgtattaaacctttccattttacgttttagaaaattttatgtattttaaaataaggggaagagtcattttcacttttaaactactatttttctttccaagtcatttttgtttttggtttcttattcaaagatgataatttagtggattaaccagtccagacgcactgatctttgcaaaggagacttaatttcaaatctgtaattaccatacataaactgtctcattatacgtatgcatttttttagtttgtttttgtttggtataaattaatttgttaattaaatatttcttaagtataaaccttatgaactacagtggagctacactcattgaaatgtaatttcagttctaaaaagatgtaataatcattttagaattaaaatttattctacttttaaataaattatgaatattaaaggtgaaaattgtataaattactttgattccattttaagtggagacatatttcagtgatttttagtaacctttaaaaatgtataatgacttttaaaatttgtagaattgaaaagacgctaataaaaatttattatttatttgtcatgactcaaaa

SEQ ID NO: 8147 - DNA, 428 bp, Homo sapiens
gaggacaatcagaggcgatgtggaaacttctgtcttgtaatcacaggagtgaaggtgtcgggcaggctgagttaacagctgaacagaaacctacctacccaacgtgctaacttctatacagcatggtcgtgcatccaaatcaaatggaaagcggtatgggagatctggaaaggcctcctgtgggtggcatctgactacctaaattcccatcccagtttcacttactgactttgacacttggaacaagcagcctctcagtgcctgttttcccactggcaggtcaggatctggcttagcggcgccgcgagctccagtgcgcgcacccgtggccgcctcccagccctctttgccggacgagctctgggccgccacaagactaaggaatggccaccccgcccaagagaagctgcccgtctttctcagccagc

SEQ ID NO: 8148 - DNA, 1144 bp, Homo sapiens
aacggtgcgctggagcgagtgagcagcgatacctagggcggaagtgctctcggcggaagtgatcgctgtgtgaatcgtgggtgggatggccgcgggccgcctctttctaagtcggcttcgagcacccttcagttccatggccaagagcccactcgagggcgtttcctcctccagaggcctgcacgcggggcgcgggccccgaaggctctccatcgaaggcaacattgctgtgggaaagtccacgtttgtgaagttactcacgaaaacttacccagaatggcacgtagctacagaacctgtagcaacatggcagaatatccaggctgctggcacccaaaaagcctgcactgcccaaagtcttggaaacttgctggatatgatgtaccgggagccagcacgatggtcctacacattccagacattttcctttttgagccgcctgaaagtacagctggagcccttccctgagaaactcttacaggccaggaagccagtacagatctttgagaggtctgtgtacagtgacaggtatatctttgcaaagaatctttttgaaaatggttccctcagtgacatcgagtggcatatctatcaggactggcattcttttctcctgtgggagtttgccagccggatcacattacatggcttcatctacctccaggcttctccccaggtttgtttgaagagactgtaccagagggccagggaggaggagaaaggaattgagctggcctatctagagcagctgcatggccaacacgaagcctggcttattcacaagacaacgaagctccactttgaggctctgatgaacattccagtgctggtgttggatgtcaatgatgatttttctgaggaagtaaccaaacaagaagacctcatgagagaggtaaacacctttgtaaagaatctgtaaccaataccatgaagttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttcttttgtacctgaagcattttgaaaataaagtttacttaagttatgcttgtttttctaa

SEQ ID NO: 8149 - DNA, 933 bp, Homo sapiens
gggatggccgcgggccgcctctttctaagtcggcttcgagcacccttcagttccatggccaagagcccactcgagggcgtttcctcctccagaggcctgcacgcggggcgcgggccccgaaggctctccatcgaaggcaacattgcctgcactgcccaaagtcttggaaacttgctggatatgatgtaccgggagccagcacgatggtcctacacattccagacattttcctttttgagccgcctgaaagtacagctggagcccttccctgagaaactcttacaggccaggaagccagtacagatctttgagaggtctgtgtacagtgacaggtatatctttgcaaagaatctttttgaaaatggttccctcagtgacatcgagtggcatatctatcaggactggcattcttttctcctgtgggagtttgccagccggatcacattacatggcttcatctacctccaggcttctccccaggtttgtttgaagagactgtaccagagggccagggaggaggagaaaggaattgagctggcctatctagagcagctgcatggccaacacgaagcctggcttattcacaagacaacgaagctccactttgaggctctgatgaacattccagtgctggtgttggatgtcaatgatgatttttctgaggaagtaaccaaacaagaagacctcatgagagaggtaaacacctttgtaaagaatctgtaaccaataccatgaagttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttcttttgtacctgaagcattttgaaaataaagtttacttaagtta

SEQ ID NO: 8150 - DNA, 880 bp, Homo sapiens
aacggtgcgctggagcgagtgagcagcgatacctagggcggaagtgctctcggcggaagtgatcgctgtgtgaatcgtgggtgggatggccgcgggccgcctctttctaagtcggcttcgagcacccttcagttccatggccaagagcccactcgagggcgtttcctcctccagaggcctgcacgcggggcgcgggccccgaaggctctccatcgaaggcaacattgctgtgggaaagtccacgtttgtgaagttactcacgaaaacttacccagaatggcacgtagctacagaacctgtagcaacatggcagaatatccaggctgctggcacccaaaaagcctgcactgcccaaagtcttggaaacttgctggatatgatgtaccgggagccagcacgatggtcctacacattccagacattttcctttttgagccgcctgaaagtacagctggagcccttccctgagaaactcttacaggccaggaagccagtacagatctttgagaggtctgtgtacagtgacaggctccactttgaggctctgatgaacattccagtgctggtgttggatgtcaatgatgatttttctgaggaagtaaccaaacaagaagacctcatgagagaggtaaacacctttgtaaagaatctgtaaccaataccatgaagttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttcttttgtacctgaagcattttgaaaataaagtttacttaagttatgcttgtttttctaa

SEQ ID NO: 8151 - DNA, 981 bp, Homo sapiens
gggatggccgcgggccgcctctttctaagtcggcttcgagcacccttcagttccatggccaagagcccactcgagggcgtttcctcctccagaggcctgcacgcggggcgcgggccccgaaggctctccatcgaaggcaacattggtaacatcctcaagcaaatcagaatgagagcacccattcaggaaaccgcctgcactgcccaaagtcttggaaacttgctggatatgatgtaccgggagccagcacgatggtcctacacattccagacattttcctttttgagccgcctgaaagtacagctggagcccttccctgagaaactcttacaggccaggaagccagtacagatctttgagaggtctgtgtacagtgacaggtatatctttgcaaagaatctttttgaaaatggttccctcagtgacatcgagtggcatatctatcaggactggcattcttttctcctgtgggagtttgccagccggatcacattacatggcttcatctacctccaggcttctccccaggtttgtttgaagagactgtaccagagggccagggaggaggagaaaggaattgagctggcctatctagagcagctgcatggccaacacgaagcctggcttattcacaagacaacgaagctccactttgaggctctgatgaacattccagtgctggtgttggatgtcaatgatgatttttctgaggaagtaaccaaacaagaagacctcatgagagaggtaaacacctttgtaaagaatctgtaaccaataccatgaagttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttcttttgtacctgaagcattttgaaaataaagtttacttaagtta

SEQ ID NO: 8152 - DNA, 1325 bp, Homo sapiens
ctcttgcggagacgcgcgcgtcggggtttaacgcgtttctgggccgccgtaagcccggcctaggggcagctttgactcgagagccggctataggcgcatggaaggttccctggaacgggaggcgccagcgggggcgctggccgccgtgctaaagcacagctcgacgttgccgcccgaaagcacccaggtccggggctacgacttcaaccgcggtgtgaattaccgcgcactgctggaggccttcggcaccaccggcttccaagcaaccaacttcgggcgcgctgtacagcaagtcaatgccatgatcgagaagaagctggaaccactgtcacaggatgaagaccagcacgcggacctgacccagagccgccgcccacttaccagctgcaccattttcctgggatatacatccaacctcatcagttcaggcatccgtgagaccattcgctaccttgtgcagcacaacatggtggacgtattggtgaccacagctggcggcgtggaggaagacctcatcaagtgcctggcgcccacatacttgggcgagtttagcctcagggggaaggagctccgggagaacgggatcaataggatcggaaacctgctggtgcccaatgagaattactgcaagtttgaggactggctgatgcccattctggaccagatggtgatggagcagaacacagagggtgtaaagtggacgccttctaagatgatcgcccggctgggcaaggagatcaacaacccagagtccgtgtattactgggcccagaagaaccacatccctgtgtttagtcccgcacttacagacggctcgctgggcgacatgatcttcttccattcctacaagaacccgggcctggtcctggacatcgttgaggacctgaggctcatcaacacacaggccatctttgccaagtgcactgggatgatcattctgggcgggggcgtggtcaagcaccacattgccaatgccaacctcatgcggaacggggccgactacgctgtttacatcaacacagcccaggagtttgatggctctgactcaggtgcccgaccagacgaggctgtctcctggggcaagatccgggtggatgcacagcccgtcaaggtctatgctgacgcctccctggtcttccccctgcttgtggctgaaacctttgcccagaagatggatgccttcatgcatgagaagaacgaggactgagcggctgcggtcccaggaaggtcttaccccctcttctatttattaatttgcagacccagcccctcccctactttttggtcagctacgtctctagaataagatggtatctgaagtcctt

SEQ ID NO: 8153 - DNA, 1186 bp, Homo sapiens
ctgtgctcttgcggagacgcgcgcgtcggggtttaacgcgtttctgggccgccgtaagcccggcctaggggcagctttgactcgagagccggctataggcgcatggaaggttccctggaacgggaggcgccagcgggggcgctggccgccgtgctaaagcacagctcgacgttgccgcccgaaagcacccaggtccggggctacgacttcaaccgcggtgtgaattaccgcgcactgctggaggccttcggcaccaccggcttccaagcaaccaacttcgggcgcgctgtacagcaagtcaatgccatgatcgagaagaagctggaaccactgtcacaggatgaagaccagcacgcggacctgacccagagccgccgcccacttaccagctgcaccattttcctgggatatacatccaacctcatcagttcaggcatccgtgagaccattcgctaccttgtgcagcacaacatggtggacgtattggtgaccacagctggcggcgtggaggaagacctcatcaagtgcctggcgcccacatacttgggcgagtttagcctcagggggaaggagctccgggagaacgggatcaataggatcggaaacctgctggtgcccaatgagaattactgcaagtttgaggactggctgatgcccattctggaccagatggtgatggagcagaacacagagggtgtaaagtggacgccttctaagatgatcgcccggctgggcaaggagatcaacaacccagagtccgtgtattactgggcccagaagaaccacatccctgtgtttagtcccgcacttacagacggctcgctgggcgacatgatcttcttccattcctacaagaacccgggcctggtcctggacatcgttgaggcccaggagtttgatggctctgactcaggtgcccgaccagacgaggctgtctcctggggcaagatccgggtggatgcacagcccgtcaaggtctatgctgacgcctccctggtcttccccctgcttgtggctgaaacctttgcccagaagatggatgccttcatgcatgagaagaacgaggactgagcggctgcggtcccaggaaggtcttaccccctcttctatttattaatttgcagacccagcccctcccctactttttggtcagctacgtctctagaataagatggtatctgaagtc

SEQ ID NO: 8154 - DNA, 1172 bp, Homo sapiens
agatttgcttttcccagcggggaagggaccggatctgaaaggagatgctctctgattcctaaaagggtgggggctggctgggcgcggtggcgcatgcctataatcccagcattttgggaagccgaggcgggtggatcaagagaagaggagttcgagacaagcctggccaacatgatcgagaagaagctggaaccactgtcacaggatgaagaccagcacgcggacctgacccagagccgccgcccacttaccagctgcaccattttcctgggatatacatccaacctcatcagttcaggcatccgtgagaccattcgctaccttgtgcagcacaacatggtggacgtattggtgaccacagctggcggcgtggaggaagacctcatcaagtgcctggcgcccacatacttgggcgagtttagcctcagggggaaggagctccgggagaacgggatcaataggatcggaaacctgctggtgcccaatgagaattactgcaagtttgaggactggctgatgcccattctggaccagatggtgatggagcagaacacagagggtgtaaagtggacgccttctaagatgatcgcccggctgggcaaggagatcaacaacccagagtccgtgtattactgggcccagaagaaccacatccctgtgtttagtcccgcacttacagacggctcgctgggcgacatgatcttcttccattcctacaagaacccgggcctggtcctggacatcgttgaggacctgaggctcatcaacacacaggccatctttgccaagtgcactgggatgatcattctgggcgggggcgtggtcaagcaccacattgccaatgccaacctcatgcggaacggggccgactacgctgtttacatcaacacagcccaggagtttgatggctctgactcaggtgcccgaccagacgaggctgtctcctggggcaagatccgggtggatgcacagcccgtcaaggtctatgctgacgcctccctggtcttccccctgcttgtggctgaaacctttgcccagaagatggatgccttcatgcatgagaagaacgaggactgagcggctgcggtcccaggaaggtcttaccccctcttctatttattaatttgcagacccagcccctcccctactttttggtcagctacgtctctaga

SEQ ID NO: 8155 - DNA, 1130 bp, Homo sapiens
catgcacagttaaaaatggactttctttcccctgtctttcatgtcacaggcttcatattgatggggaagctgcctattaggggaatagatgacttctcatgtgtattaatgaaagcaatgtattgcaggctgggtagctggtagaaatgttgtgggcgtttgtaagtggaagatttacgccattataaccctaatatattcctgcagagtaacaacacagcctatctaatatacaatgatggagtccctaaacctgtgaattacagcagaaagtatggacacaccaaaggtttactgctgtggaacagagttcaagggttctggctgattcattccatccctcagtttcctccaattccggaagaaggctatgattatccacccacagggagacgaaatggacaaagtggcatctgcataactttcaagtacaaccagtatgaggcaatagattctcagctcttggtctgcaaccccaacgtctatagctgctccatcccagccacctttcaccaggagctcattcacatgccccagctgtgcaccagggccagctcatcagagattcctggcaggctcctcaccacacttcagtcggcccagggacaaaaattcctccattttgcaaagtcggattcttttcttgacgacatctttgcagcctggatggctcaacggctgaagacacacttgttaacagaaacctggcagcgaaaaagacaagagcttccttcaaactgctcccttccttaccatgtctacaatataaaagcaattaaattatcacgacactcttatttcagttcttatcaagatcatgccaagtggtgtatttcccaaaagggcaccaaaaatcgctggacatgtattggagacctaaatcggagtccacaccaagccttcagaagtggaggattcatttgtacccagaattggcaaatttaccaagcatttcaaggattagtattatactatgaaagctgtaagtaaacttggtgaaaggacacaggtactatcattgaaaaccttgacaatgggtcttcttccattacaccttctttatattttaaaggcctgtgaatatacttataacctgcatatcacaaaataaaacatttttctctcatgtt

SEQ ID NO: 8156 - DNA, 1269 bp, Homo sapiens
atggggaaagtgtcctgctgtggcatgaaataaatgaaacagaaaatgatggcaagactgctaagaacatcctttgctttgctcttccttggcctctttggggtgctgggggcagcaacaatttcatgcagaaatgaagaagggaaagctgtggactggtttactttttataagttacctaaaagacaaaacaaggaaagtggagagactgggttagagtacctgtacctagactctacaactagaagctggaggaagagtgagcaactaatgaatgacaccaagagtgttttgggaaggacattacaacagctatatgaagcatatgcctctaagagtaacaacacagcctatctaatatacaatgatggagtccctaaacctgtgaattacagcagaaagtatggacacaccaaaggtttactgctgtggaacagagttcaagggttctggctgattcattccatccctcagtttcctccaattccggaagaaggctatgattatccacccacagggagacgaaatggacaaagtggcatctgcataactttcaagtacaaccagtatgaggcaatagattctcagctcttggtctgcaaccccaacgtctatagctgctccatcccagccacctttcaccaggagctcattcacatgccccagctgtgcaccagggccagctcatcagagattcctggcaggctcctcaccacacttcagtcggcccagggacaaaaattcctccattttgcaaagtcggattcttttcttgacgacatctttgcagcctggatggctcaacggctgaagacacacttgttaacagaaacctggcagcgaaaaagacaagagcttccttcaaactgctcccttccttaccatgtctacaatataaaagcaattaaattatcacgacactcttatttcagttcttatcaagatcatgccaagtggtgtatttcccaaaagggcaccaaaaatcgctggacatgtattggagacctaaatcggagtccacaccaagccttcagaagtggaggattcatttgtacccagaattggcaaatttaccaagcatttcaaggattagtattatactatgaaagctgtaagtaaacttggtgaaaggacacaggtactatcattgaaaaccttgacaatgggtcttcttccattacaccttctttatattttaaaggcctgtgaatatacttataacctgcatatcacaaaataaaacatttttctctcatgtttaccatttaa

SEQ ID NO: 8157 - DNA, 2010 bp, Homo sapiens
gagtctgtaccctcgtgatgtccccgccccggttcccaggcaagtttagggaagtgaaaggcgccaggtgccagtcctggcctctgatgtaacccagcgccccgcagtcccgacacagattcctggatctcagccccatagcagctatgatcccgctgctgctggcagcgctgctgtgcgtccccgccggggccctgacctgctacggggactccgggcagcctgtagactggttcgtggtctacaagctgccagctcttagagggtccggggaggcggcgcagagagggctgcagtacaagtatctggacgagagctccggaggctggcgggacggcagggcactcatcaacagcccggagggggccgtgggccgaagcctgcagccgctgtaccggagcaacaccagccagctcgccttcctgctctacaatgaccaaccgcctcaacccagcaaggctcaggactcttccatgcgtgggcacacgaagggtgtcctgctccttgaccacgatgggggcttctggctggtccacagtgtacctaacttccctccaccggcctcctctgctgcatacagctggcctcatagcgcctgtacctacgggcagaccctgctctgtgtgtcttttcccttcgctcagttctcgaagatgggcaagcagctgacctacacctacccctgggtctataactaccagctggaagggatctttgcccaggaattccccgacttggagaatgtggtcaagggccaccacgttagccaagaaccctggaacagcagcatcacactcacatcccaggccggggctgttttccagagctttgccaagttcagcaaatttggagatgacctgtactccggctggttggcagcagcccttggtaccaacctgcaggtccagttctggcacaaaactgtaggcatcctgccctctaactgctcggatatctggcaggttctgaatgtgaaccagatagctttccctggaccagccggcccaagcttcaacagcacagaggaccactccaaatggtgcgtgtccccaaaagggccctggacctgcgtgggtgacatgaatcggaaccagggagaggagcaacggggtgggggcacactgtgtgcccagctgccagccctctggaaagccttccagccgctggtgaagaactaccagccctgtaatggcatggccaggaagcccagcagagcttataagatctaacccttatggccaggtgcagtggctcacgtatgtaatcccagcactttgggaagccaaggagggaggatcacttgaactcaggaattcgagaccagcctgggctacatagtgagaccacatctctactagaacttaaaaaaagttagccaggcacggtgataaatgcctgtagtcccagccactgaagccagaggatcgattgaaccagggagatcatggtcacagtgaactatgattacgccaacctgggtcacatagcaagactctgtttcaaaaaaaaagggggggcgggggacgggtgggtgcagtggctcacatctgtaaccccagcactttgggaggctgagatgggcagatcacttgaggtcaggagttcgagaccagcctggccaacatggtgaaaccccatatccattaaaaatatttaaaaattagccagacatggtggcacgcgtctgtggtcctagctcctcgggaggctgaggcaggagaatcgcttgaactcgggaggcagaggttgtcatgagctgagctaacaccacggcacttcagcctgggtgacagaatgagactctgtgtcaaaaaaataaaaaataaaaaatctaagggctcaggaaccagtttggacttgattttgaatcccagttcatccccttcctagctgtatgaccttgattgtgtgccttaaccgctctgtgacacagtctacctgtctgcaaaatgggaaacataatacctgccatcaggattgttgaggagtaaataaatggaaattggtgga

SEQ ID NO: 8158 - DNA, 1037 bp, Homo sapiens
agtcctggcctctgatgtaacccagcgccccgcagtcccgacacagattcctggatctcagccccatagcagctatgatcccgctgctgctggcagcgctgctgtgcgtccccgccggggccctgacctgctacggggactccgggcagcctgtagactggttcgtggtctacaagctgccagctcttagagggtccggggaggcggcgcagagagggctgcagtacaagtatctggacgagagctccggaggctggcgggacggcagggcactcatcaacagcccggagggggccgtgggccgaagcctgcagccgctgtaccggagcaacaccagccagctcgccttcctgctctacaatgaccaaccgcctcaacccagcaaggctcaggactcttccatgcgtgggcacacgaagggcaagcagctgacctacacctacccctgggtctataactaccagctggaagggatctttgcccaggaattccccgacttggagaatgtggtcaagggccaccacgttagccaagaaccctggaacagcagcatcacactcacatcccaggccggggctgttttccagagctttgccaagttcagcaaatttggagatgacctgtactccggctggttggcagcagcccttggtaccaacctgcaggtccagttctggcacaaaactgtaggcatcctgccctctaactgctcggatatctggcaggttctgaatgtgaaccagatagctttccctggaccagccggcccaagcttcaacagcacagaggaccactccaaatggtgcgtgtccccaaaagggccctggacctgcgtgggtgacatgaatcggaaccagggagaggagcaacggggtgggggcacactgtgtgcccagctgccagccctctggaaagccttccagccgctggtgaagaactaccagccctgtaatggcatggccaggaagcccagcagagcttataagatctaacccttatggccaggtgcagtggctcacgtatgtaatcccagcact

SEQ ID NO: 8159 - DNA, 2652 bp, Homo sapiens
cttgaacgcctgacctcgtatccacccgcctcagcctcccaaagtgctgggattacaggcatgagccaccacgcccagcccataatttattgattttttaaaatttgtccagccttctattaccacgtcgaatccattagctacagccatcccatgagaagctgagtggattcagccccacctcctgctcacagaccctgtccgagcacctcatttgtcccaacagcattactgcaggacccccaggacgttggactgccagctccctgggtctcctcctctctggggcagatcctcagtcctcccttgacttcacgactgtggccagatcatgtgtggactgtccctctctttgggtctccagagcgcttgcatcaaacacccctaactcagaagtgtgcagccacactgggactcagaacccaacaacagggacagaagactcacgcccttggggtgcccggtctcgtggcatcaggcatgacttccagctcctgcgccttccccagcaactgctgactggggacccagaccgggagctgagcgacgggcctggcgagcgaagctcggggtctcactcaggcaccagcccctccttgccccaggcttgagtgactcacagccctattcaggcaggagctgctcttctggggtatcgcgatccacttaaggatgaggcagacttggtgacaagctggtctgagcagcgcttccagagccagaactgagcccagtgagagcgcaccctggagcagcctggattcctggggtgtccccggcagccacacacagccatgcactacccaactgcactcctcttcctcatcctggccaatggggcccaggcctttcgcatctgcgccttcaatgcccagcggctgacactggccaaggtggccagggagcaggtgatggacaccttagttcggatactggctcgctgtgacatcatggtgctgcaggaggtggtggactcttccggcagcgccatccccctcctgcttcgagaactcaatcgatttgatggctctgggccctacagcaccctgagcagcccccagctggggcgcagcacctacatggagacgtatgtgtacttctatcggtcacacaaaacacaggtcctgagttcctacgtgtacaacgatgaggatgacgtctttgcccgggagccatttgtggcccagttctctttgcccagcaatgtccttcccagcctggtgttggtcccgctgcacaccactcctaaggccgtagagaaggagctgaacgccctctacgatgtgtttctggaggtctcccagcactggcagagcaaggacgtgatcctgcttggggacttcaatgctgactgcgcttcactgaccaaaaagcgcctggacaagctggagctgcggactgagccaggcttccactgggtgattgccgatggggaggacaccacagtgcgggccagcacccactgcacctatgaccgcgtcgtgctgcacggggagcgctgccggagtctgctgcacactgcggctgcctttgacttccccacgagcttccagctcaccgaggaggaggccctcaacatcagtgaccactaccccgtggaggtggagctgaagctgagccaggcgcacagcgtccagcctctcagcctcactgttctgttgctgctatcactcctgtcccctcagctgtgccctgctgcctgagcgtccccctacccccccagggcctgctgccttttgggacttaaaccccagcctcccccgtccatccagccctggggctggggggcttcaactatagttgccctgtgactgtagtccacccctgcctgccttgtttgatttggctcttgttctttggttgggcttgtgcctagattaggagaggaagccaggggccctgcactcatgccacctgccaggtagtgtagtatcaggagtggagacaaagtgggctctgggttggggtaggggaagggagggttcagaaagaggaatgaagatgttgtatgacaagaaggaaagttactgagaacaaaaacccagattggtgagataggacacttgtgcagcagatatgccaatgggccatgtttattgtggattggtaagaatcaccaggaaaccattaagccccaatagctacaaggagggtggttaatctgctatatcaaactccttccctgaaaccagcaaacaccgggaaacattttggctcattataatccggtgaacaatgcagtcaggcctgttataaccgctgagcagccacactcgcacctcctgggtgctgtagtctgtgttggtacaggcttctgcatgcctggtaaagtccagccaaggctggtcaaggcaacatctccacacagaaaatctgcaccagttatgtaagctaaaaagctgtgtgaacccaggtgtcccggaaaggggctgcaggacacagcaaaatgccagcagcgtgccggacccctcccttccatcctcctctccaaagaacagaggtcaggaaaaacactggctgggacgctagaagggtcatgtgttaactataatcacatttatggtttggaaccatcaccccaaggtaaaaaaaaaataaaaggtattcccaggtatgtttggcaaaataaaataaaggtaattaaaaacctaa

SEQ ID NO: 8160 - DNA, 2249 bp, Homo sapiens
tgtgcacggtcaggtggttcatgtactctggcggggaaggagaggtcaggcgctccgggctcgcccgctaggtcggggccgcggcgtcccccaccctaagtcccacctccggccgggcatgggtacccgggcgggcctgcctcggcctgggcccactcactggtccagaagcagctgtaggtgcccaccaagcccatgacgacgctgctggccagggtccagccctattcaggcaggagctgctcttctggggtatcgcgatccacttaaggatgaggcagacttggtgacaagctggtctgagcagcgcttccagagccagaactgagcccagtgagagcgcaccctggagcagcctggattcctggggtgtccccggcagccacacacagccatgcactacccaactgcactcctcttcctcatcctggccaatggggcccaggcctttcgcatctgcgccttcaatgcccagcggctgacactggccaaggtggccagggagcaggtgatggacaccttagttcggatactggctcgctgtgacatcatggtgctgcaggaggtggtggactcttccggcagcgccatccccctcctgcttcgagaactcaatcgatttgatggctctgggccctacagcaccctgagcagcccccagctggggcgcagcacctacatggagacgtatgtgtacttctatcggtcacacaaaacacaggtcctgagttcctacgtgtacaacgatgaggatgacgtctttgcccgggagccatttgtggcccagttctctttgcccagcaatgtccttcccagcctggtgttggtcccgctgcacaccactcctaaggccgtagagaaggagctgaacgccctctacgatgtgtttctggaggtctcccagcactggcagagcaaggacgtgatcctgcttggggacttcaatgctgactgcgcttcactgaccaaaaagcgcctggacaagctggagctgcggactgagccaggcttccactgggtgattgccgatggggaggacaccacagtgcgggccagcacccactgcacctatgaccgcgtcgtgctgcacggggagcgctgccggagtctgctgcacactgcggctgcctttgacttccccacgagcttccagctcaccgaggaggaggccctcaacatcagtgaccactaccccgtggaggtggagctgaagctgagccaggcgcacagcgtccagcctctcagcctcactgttctgttgctgctatcactcctgtcccctcagctgtgccctgctgcctgagcgtccccctacccccccagggcctgctgccttttgggacttaaaccccagcctcccccgtccatccagccctggggctggggggcttcaactatagttgccctgtgactgtagtccacccctgcctgccttgtttgatttggctcttgttctttggttgggcttgtgcctagattaggagaggaagccaggggccctgcactcatgccacctgccaggtagtgtagtatcaggagtggagacaaagtgggctctgggttggggtaggggaagggagggttcagaaagaggaatgaagatgttgtatgacaagaaggaaagttactgagaacaaaaacccagattggtgagataggacacttgtgcagcagatatgccaatgggccatgtttattgtggattggtaagaatcaccaggaaaccattaagccccaatagctacaaggagggtggttaatctgctatatcaaactccttccctgaaaccagcaaacaccgggaaacattttggctcattataatccggtgaacaatgcagtcaggcctgttataaccgctgagcagccacactcgcacctcctgggtgctgtagtctgtgttggtacaggcttctgcatgcctggtaaagtccagccaaggctggtcaaggcaacatctccacacagaaaatctgcaccagttatgtaagctaaaaagctgtgtgaacccaggtgtcccggaaaggggctgcaggacacagcaaaatgccagcagcgtgccggacccctcccttccatcctcctctccaaagaacagaggtcaggaaaaacactggctgggacgctagaagggtcatgtgttaactataatcacatttatggtttggaaccatcaccccaaggtaaaaaaaaaataaaaggtattcccaggtatgtttggcaaaataaaataaaggtaattaaaaacc

SEQ ID NO: 8161 - DNA, 2110 bp, Homo sapiens
ggggcgtccggcccagccaggcccttcctggccgggtggctcaggaacacagcctcttcctcttttttttcccctcctagccctattcaggcaggagctgctcttctggggtatcgcgatccacttaaggatgaggcagacttggtgacaagctggtctgagcagcgcttccagagccagaactgagcccagtgagagcgcaccctggagcagcctggattcctggggtgtccccggcagccacacacagccatgcactacccaactgcactcctcttcctcatcctggccaatggggcccaggcctttcgcatctgcgccttcaatgcccagcggctgacactggccaaggtggccagggagcaggtgatggacaccttagttcggatactggctcgctgtgacatcatggtgctgcaggaggtggtggactcttccggcagcgccatccccctcctgcttcgagaactcaatcgatttgatggctctgggccctacagcaccctgagcagcccccagctggggcgcagcacctacatggagacgtatgtgtacttctatcggtcacacaaaacacaggtcctgagttcctacgtgtacaacgatgaggatgacgtctttgcccgggagccatttgtggcccagttctctttgcccagcaatgtccttcccagcctggtgttggtcccgctgcacaccactcctaaggccgtagagaaggagctgaacgccctctacgatgtgtttctggaggtctcccagcactggcagagcaaggacgtgatcctgcttggggacttcaatgctgactgcgcttcactgaccaaaaagcgcctggacaagctggagctgcggactgagccaggcttccactgggtgattgccgatggggaggacaccacagtgcgggccagcacccactgcacctatgaccgcgtcgtgctgcacggggagcgctgccggagtctgctgcacactgcggctgcctttgacttccccacgagcttccagctcaccgaggaggaggccctcaacatcagtgaccactaccccgtggaggtggagctgaagctgagccaggcgcacagcgtccagcctctcagcctcactgttctgttgctgctatcactcctgtcccctcagctgtgccctgctgcctgagcgtccccctacccccccagggcctgctgccttttgggacttaaaccccagcctcccccgtccatccagccctggggctggggggcttcaactatagttgccctgtgactgtagtccacccctgcctgccttgtttgatttggctcttgttctttggttgggcttgtgcctagattaggagaggaagccaggggccctgcactcatgccacctgccaggtagtgtagtatcaggagtggagacaaagtgggctctgggttggggtaggggaagggagggttcagaaagaggaatgaagatgttgtatgacaagaaggaaagttactgagaacaaaaacccagattggtgagataggacacttgtgcagcagatatgccaatgggccatgtttattgtggattggtaagaatcaccaggaaaccattaagccccaatagctacaaggagggtggttaatctgctatatcaaactccttccctgaaaccagcaaacaccgggaaacattttggctcattataatccggtgaacaatgcagtcaggcctgttataaccgctgagcagccacactcgcacctcctgggtgctgtagtctgtgttggtacaggcttctgcatgcctggtaaagtccagccaaggctggtcaaggcaacatctccacacagaaaatctgcaccagttatgtaagctaaaaagctgtgtgaacccaggtgtcccggaaaggggctgcaggacacagcaaaatgccagcagcgtgccggacccctcccttccatcctcctctccaaagaacagaggtcaggaaaaacactggctgggacgctagaagggtcatgtgttaactataatcacatttatggtttggaaccatcaccccaaggtaaaaaaaaaataaaaggtattcccaggtatgtttggcaaaataaaataaaggtaattaaaaacctaa

SEQ ID NO: 8162 - DNA, 2666 bp, Homo sapiens
gtggggcgtccggcccagccaggcccttcctggccgggtggctcaggaacacagcctcttcctcttttttttcccctcctagccctattcaggcaggagctgctcttctggggtatcgcgatccacttaaggatgaggcagacttggtgacaagctggtctgagcaggtatgggagccccctggggagacggaagaagggaggaagttgccttctgcctggggagggtttgagagggagagggaagcctagggctcccaccaaggctgatattgacagccagggtttggggctgaagccaggaaccgtcactctctctggttcttactggtagccctcatgggggtccctgacgccagagcctccaaggctgcatgtgccagcccagggctgcccacatacccatgtatatcccagaataggcaccagggtagggaacccaaactagcatgagtgacagagcaggtggtcagggagaaacagacatcaaacccagccaggagagagacaccgcaacagagagacagagaagggaaaccagagacgagagggaaagtgagacagagacggacagagcctcagagaggtaggaagtgagcccgaagggaaggtgacaggttgatagagaaaagcaggcagacagagcagaggaactcatgcctcaggatgcaaaagccacatggacagggcgtggagcaaggagccgagccctgcaaggtcagcgcttccagagccagaactgagcccagtgagagcgcaccctggagcagcctggattcctggggtgtccccggcagccacacacagccatgcactacccaactgcactcctcttcctcatcctggccaatggggcccaggcctttcgcatctgcgccttcaatgcccagcggctgacactggccaaggtggccagggagcaggtgatggacaccttagttcggatactggctcgctgtgacatcatggtgctgcaggaggtggtggactcttccggcagcgccatccccctcctgcttcgagaactcaatcgatttgatggctctgggccctacagcaccctgagcagcccccagctggggcgcagcacctacatggagacgtatgtgtacttctatcggtcacacaaaacacaggtcctgagttcctacgtgtacaacgatgaggatgacgtctttgcccgggagccatttgtggcccagttctctttgcccagcaatgtccttcccagcctggtgttggtcccgctgcacaccactcctaaggccgtagagaaggagctgaacgccctctacgatgtgtttctggaggtctcccagcactggcagagcaaggacgtgatcctgcttggggacttcaatgctgactgcgcttcactgaccaaaaagcgcctggacaagctggagctgcggactgagccaggcttccactgggtgattgccgatggggaggacaccacagtgcgggccagcacccactgcacctatgaccgcgtcgtgctgcacggggagcgctgccggagtctgctgcacactgcggctgcctttgacttccccacgagcttccagctcaccgaggaggaggccctcaacatcagtgaccactaccccgtggaggtggagctgaagctgagccaggcgcacagcgtccagcctctcagcctcactgttctgttgctgctatcactcctgtcccctcagctgtgccctgctgcctgagcgtccccctacccccccagggcctgctgccttttgggacttaaaccccagcctcccccgtccatccagccctggggctggggggcttcaactatagttgccctgtgactgtagtccacccctgcctgccttgtttgatttggctcttgttctttggttgggcttgtgcctagattaggagaggaagccaggggccctgcactcatgccacctgccaggtagtgtagtatcaggagtggagacaaagtgggctctgggttggggtaggggaagggagggttcagaaagaggaatgaagatgttgtatgacaagaaggaaagttactgagaacaaaaacccagattggtgagataggacacttgtgcagcagatatgccaatgggccatgtttattgtggattggtaagaatcaccaggaaaccattaagccccaatagctacaaggagggtggttaatctgctatatcaaactccttccctgaaaccagcaaacaccgggaaacattttggctcattataatccggtgaacaatgcagtcaggcctgttataaccgctgagcagccacactcgcacctcctgggtgctgtagtctgtgttggtacaggcttctgcatgcctggtaaagtccagccaaggctggtcaaggcaacatctccacacagaaaatctgcaccagttatgtaagctaaaaagctgtgtgaacccaggtgtcccggaaaggggctgcaggacacagcaaaatgccagcagcgtgccggacccctcccttccatcctcctctccaaagaacagaggtcaggaaaaacactggctgggacgctagaagggtcatgtgttaactataatcacatttatggtttggaaccatcaccccaaggtaaaaaaaaaataaaaggtattcccaggtatgtttggcaaaataaaataaaggtaattaaaaacctaa

SEQ ID NO: 8163 - DNA, 3008 bp, Homo sapiens
gtactctggcggggaaggagaggtcaggcgctccgggctcgcccgctaggtcggggccgcggcgtcccccaccctaagtcccacctccggccgggcatgggtacccgggcgggcctgcctcggcctgggcccactcactggtccagaagcagctgtaggtgcccaccaagcccatgacgacgctgctggccagggtccagagcgcttgcatcaaacacccctaactcagaagtgtgcagccacactgggactcagaacccaacaacagggacagaagactcacgcccttggggtgcccggtctcgtggcatcaggcatgacttccagctcctgcgccttccccagcaactgctgactggggacccagaccgggagctgagcgacgggcctggcgagcgaagctcggggtctcactcaggcaccagcccctccttgccccaggcttgagtgactcacagccctattcaggcaggagctgctcttctggggtatcgcgatccacttaaggatgaggcagacttggtgacaagctggtctgagcagcgcttccagagccagaactgagcccagtgagagcgcaccctggagcagcctggattcctggggtgtccccggcagccacacacagccatgcactacccaactgcactcctcttcctcatcctggccaatggggcccaggcctttcgcatctgcgccttcaatgcccagcggctgacactggccaaggtggccagggagcaggtgatggacaccttagttcggatactggctcgctgtgacatcatggtgctgcaggaggtggtggactcttccggcagcgccatccccctcctgcttcgagaactcaatcgatttgatggctctgggccctacagcaccctgagcagcccccagctggggcgcagcacctacatggagacgtatgtgtacttctatcggtcacacaaaacacaggtcctgagttcctacgtgtacaacgatgaggatgacgtctttgcccgggagccatttgtggcccagttctctttgcccagcaatgtccttcccagcctggtgttggtcccgctgcacaccactcctaaggccgtagagaaggagctgaacgccctctacgatgtgtttctggaggtctcccagcactggcagagcaaggacgtgatcctgcttggggacttcaatgctgactgcgcttcactgaccaaaaagcgcctggacaagctggagctgcggactgagccaggcttccactgggtgattgccgatggggaggacaccacagtgcgggccagcacccactgcacctatgaccgcgtcgtgctgcacggggagcgctgccggagtctgctgcacactgcggctgcctttgacttccccacgagcttccagctcaccgaggaggaggccctcaacatcagtgaccactaccccgtggaggtggagctgaagctgagccaggcgcacagcgtccagcctctcagcctcactgttctgttgctgctatcactcctgtcccctcagctgtgccctgctgcctgagcgtccccctacccccccagggcctgctgccttttgggacttaaaccccagcctcccccgtccatccagccctggggctggggggcttcaactatagttgccctgtgactgtagtccacccctgcctgccttgtttgatttggctcttgttctttggttgggcttgtgcctagattaggagaggaagccaggggccctgcactcatgccacctgccaggtagtgtagtatcaggagtggagacaaagtgggctctgggttggggtaggggaagggagggttcagaaagaggaatgaagatgttgtatgacaagaaggaaagttactgagaacaaaaacccagattggtgagataggacacttgtgcagcagatatgccaatgggccatgtttattgtggattggtaagaatcaccaggaaaccattaagccccaatagctacaaggagggtggttaatctgctatatcaaactccttccctgaaaccagcaaacaccgggaaacattttggctcattataatccggtgaacaatgcagtcaggcctgttataaccgctgagcagccacactcgcacctcctgggtgctgtagtctgtgttggtacaggcttctgcatgcctggtaaagtccagccaaggctggtcaaggcaacatctccacacagaaaatctgcaccagttatgtaagctaaaaagctgtgtgaacccaggtgtcccggaaaggggctgcaggacacagcaaaatgccagcagcgtgccggacccctcccttccatcctcctctccaaagaacagaggtcaggaaaaacactggctgggacgctagaagggtcatgtgttaactataatcacatttatggtttggaaccatcaccccaaggtaaaaaaaaaataaaaggtattcccaggtatgtttggcaaaataaaataaaggtaattaaaaacctaagaaatggctgtaaactgagattacaaaaaaccagaggccttttgggagccacaggctgggggctggggccaacataccccagctctgggaccaaaagcctttggagtcctgtccctggatacagatgctcaggccacccacctagcactcctctcatttttgctgctcccccaaaagccagcgctgttctacaatagttcaggtcagacatctaagatccccaggccaaaccatgccacacacgtgtctgttccgaggtcttgttacaaatgaccaaaggttagcctagacctttggtcaggtggtgaaggccctgggaatgcaggttctagaaggggtgggggcatggggcccaggaggttgctagagataggaaatggggcaaatcgcaggtgacctcagcagtacctggatgattcccaccaaggaggaatggccaaaccagatgggtgagaacaagcccaatgtgatgcacacctacccttgctaaataaacgctgctggtcagcctctagcccac

SEQ ID NO: 8164 - DNA, 2665 bp, Homo sapiens
gtactctggcggggaaggagaggtcaggcgctccgggctcgcccgctaggtcggggccgcggcgtcccccaccctaagtcccacctccggccgggcatgggtacccgggcgggcctgcctcggcctgggcccactcactggtccagaagcagctgtaggtgcccaccaagcccatgacgacgctgctggccagggtccagcgcttccagagccagaactgagcccagtgagagcgcaccctggagcagcctggattcctggggtgtccccggcagccacacacagccatgcactacccaactgcactcctcttcctcatcctggccaatggggcccaggcctttcgcatctgcgccttcaatgcccagcggctgacactggccaaggtggccagggagcaggtgatggacaccttagttcggatactggctcgctgtgacatcatggtgctgcaggaggtggtggactcttccggcagcgccatccccctcctgcttcgagaactcaatcgatttgatggctctgggccctacagcaccctgagcagcccccagctggggcgcagcacctacatggagacgtatgtgtacttctatcggtcacacaaaacacaggtcctgagttcctacgtgtacaacgatgaggatgacgtctttgcccgggagccatttgtggcccagttctctttgcccagcaatgtccttcccagcctggtgttggtcccgctgcacaccactcctaaggccgtagagaaggagctgaacgccctctacgatgtgtttctggaggtctcccagcactggcagagcaaggacgtgatcctgcttggggacttcaatgctgactgcgcttcactgaccaaaaagcgcctggacaagctggagctgcggactgagccaggcttccactgggtgattgccgatggggaggacaccacagtgcgggccagcacccactgcacctatgaccgcgtcgtgctgcacggggagcgctgccggagtctgctgcacactgcggctgcctttgacttccccacgagcttccagctcaccgaggaggaggccctcaacatcagtgaccactaccccgtggaggtggagctgaagctgagccaggcgcacagcgtccagcctctcagcctcactgttctgttgctgctatcactcctgtcccctcagctgtgccctgctgcctgagcgtccccctacccccccagggcctgctgccttttgggacttaaaccccagcctcccccgtccatccagccctggggctggggggcttcaactatagttgccctgtgactgtagtccacccctgcctgccttgtttgatttggctcttgttctttggttgggcttgtgcctagattaggagaggaagccaggggccctgcactcatgccacctgccaggtagtgtagtatcaggagtggagacaaagtgggctctgggttggggtaggggaagggagggttcagaaagaggaatgaagatgttgtatgacaagaaggaaagttactgagaacaaaaacccagattggtgagataggacacttgtgcagcagatatgccaatgggccatgtttattgtggattggtaagaatcaccaggaaaccattaagccccaatagctacaaggagggtggttaatctgctatatcaaactccttccctgaaaccagcaaacaccgggaaacattttggctcattataatccggtgaacaatgcagtcaggcctgttataaccgctgagcagccacactcgcacctcctgggtgctgtagtctgtgttggtacaggcttctgcatgcctggtaaagtccagccaaggctggtcaaggcaacatctccacacagaaaatctgcaccagttatgtaagctaaaaagctgtgtgaacccaggtgtcccggaaaggggctgcaggacacagcaaaatgccagcagcgtgccggacccctcccttccatcctcctctccaaagaacagaggtcaggaaaaacactggctgggacgctagaagggtcatgtgttaactataatcacatttatggtttggaaccatcaccccaaggtaaaaaaaaaataaaaggtattcccaggtatgtttggcaaaataaaataaaggtaattaaaaacctaagaaatggctgtaaactgagattacaaaaaaccagaggccttttgggagccacaggctgggggctggggccaacataccccagctctgggaccaaaagcctttggagtcctgtccctggatacagatgctcaggccacccacctagcactcctctcatttttgctgctcccccaaaagccagcgctgttctacaatagttcaggtcagacatctaagatccccaggccaaaccatgccacacacgtgtctgttccgaggtcttgttacaaatgaccaaaggttagcctagacctttggtcaggtggtgaaggccctgggaatgcaggttctagaaggggtgggggcatggggcccaggaggttgctagagataggaaatggggcaaatcgcaggtgacctcagcagtacctggatgattcccaccaaggaggaatggccaaaccagatgggtgagaacaagcccaatgtgatgcacacctacccttgctaaataaacgctgctggtcagcctctagcccac

SEQ ID NO: 8165 - DNA, 942 bp, Homo sapiens
tgtactctggcggggaaggagaggtcaggcgctccgggctcgcccgctaggtcggggccgcggcgtcccccaccctaagtcccacctccggccgggcatgggtacccgggcgggcctgcctcggcctgggcccactcactggtccagaagcagctgtaggtgcccaccaagcccatgacgacgctgctggccagggtccagagcgcttgcatcaaacacccctaactcagaagtgtgcagccacactgggactcagaacccaacaacagggacagaagactcacgcccttggggtgcccggtctcgtggcatcaggcatgacttccagctcctgcgccttccccagcaactgctgactggggacccagaccgggagctgagcgacgggcctggcgagcgaagctcggggtctcactcaggcaccagcccctccttgccccaggcttgagtgactcacagccctattcaggcaggagctgctcttctggggtatcgcgatccacttaaggatgaggcagacttggtgacaagctggtctgagcagcgcttccagagccagaactgagcccagtgagagcgcaccctggagcagcctggattcctggggtgtccccggcagccacacacagccatgcactacccaactgcactcctcttcctcatcctggccaatggggcccaggcctttcgcatctgcgccttcaatgcccagcggctgacactggccaaggtggccagggagcaggtgatggacaccttagttcggatactggctcgctgtgacatcatggtgctgcaggaggtggtggactcttccggcagcgccatccccctcctgcttcgagaactcaatcgatttgatggctctgggccctacagcaccctgagcagcccccagctggggcgcagcacctacatggagacgtatgtgtacttctatcg

SEQ ID NO: 8166 - DNA, 847 bp, Homo sapiens
tactctggcggggaaggagaggtcaggcgctccgggctcgcccgctaggtcggggccgcggcgtcccccaccctaagtcccacctccggccgggcatgggtacccgggcgggcctgcctcggcctgggcccactcactggtccagaagcagctgtaggtgcccaccaagcccatgacgacgctgctggccagggtccagcattactgcaggacccccaggacgttggactgccagctccctgggtctcctcctctctggggcagatcctcagtcctcccttgacttcacgactgtggccagatcatgtgtggactgtccctctctttgggtctccagagcgcttgcatcaaacacccctaactcagaagtgtgcagccacactgggactcagaacccaacaacagggacagaagactcacgcccttggggtgcccggtctcgtggcatcaggcatgacttccagctcctgcgccttccccagcaactgctgactggggacccagaccgggagctgagcgacgggcctggcgagcgaagctcggggtctcactcaggcaccagcccctccttgccccaggcttgagtgactcacagccctattcaggcaggagctgctcttctggggtatcgcgatccacttaaggatgaggcagacttggtgacaagctggtctgagcagcgcttccagagccagaactgagcccagtgagagcgcaccctggagcagcctggattcctggggtgtccccggcagccacacacagccatgcactacccaactgcactcctcttcctcatcctggccaatggggcccaggcctttcgcatctgcgccttcaatgccca

SEQ ID NO: 8167 - DNA, 904 bp, Homo sapiens
ggcggggaaggagaggtcaggcgctccgggctcgcccgctaggtcggggccgcggcgtcccccaccctaagtcccacctccggccgggcatgggtacccgggcgggcctgcctcggcctgggcccactcactggtccagaagcagctgtaggtgcccaccaagcccatgacgacgctgctggccagggtccagcgcttccagagccagaactgagcccagtgagagcgcaccctggagcagcctggattcctggggtgtccccggcagccacacacagccatgcactacccaactgcactcctcttcctcatcctggccaatggggcccaggcctttcgcatctgcgccttcaatgcccagcggctgacactggccaaggtggccagggagcaggtgatggacaccttagttcggatactggctcgctgtgacatcatggtgctgcaggaggtggtggactcttccggcagcgccatccccctcctgcttcgagaactcaatcgatttgatggctctgggccctacagcaccctgagcagcccccagctggggcgcagcacctacatggagacgtatgtgtacttctatcggtcacacaaaacacaggtcctgagttcctacgtgtacaacgatgaggatgacgtctttgcccgggagccatttgtggcccagttctctttgcccagcaatgtccttcccagcctggtgttggtcccgctgcacaccactcctaaggccgtagagaaggagctgaacgccctctacgatgtgtttctggaggtctcccagcactggcagagcaaggacgtgatcctgcttggggacttcaatgctgactgcgcttcactgaccaaaaagcgcctggacaagctggagctgcggactgagccaggcttccactgg

SEQ ID NO: 8168 - DNA, 1463 bp, Homo sapiens
cagcctatgacacttttgctcctcctgaaatctccatatcttgcttttctcaaattccaaggtagcctttgcgcaacatatcactctccactgactcttgtcccatcagggcccatagtggatggctgtatgggggccatgtgactgaactcctgatcctcgtttcagcccactcatgtgacatgcatggagctcttcagcagggacttactgaccaggacaagagcttgagactttgaggggatctgattgtcactgcacaatcaaggacagtattcccaagagtggatgttgctcaagatagtccaaggaattctatgaagaaaaggactccacagacaataaattttggacaccctgtttcaacacagtgcatcttagagactggtgtttgcaagtatatggagcaggaaacttcatcccgaagatggagaccccggggctgtcagcaggcgttagagtcttgaagccagagcagcgccaggatgtcacgggagctggccccactgctgcttctcctcctctccatccacagcgccctggccatgaggatctgctccttcaacgtcaggtcctttggggaaagcaagcaggaagacaagaatgccatggatgtcattgtgaaggtcatcaaacgctgtgacatcatactcgtgatggaaatcaaggacagcaacaacaggatctgccccatactgatggagaagctgaacagaaattcaaggagaggcataacgtacaactatgtgattagctctcggcttggaagaaacacatataaagaacaatatgcctttctctacaaggaaaagctggtgtctgtgaagaggagttatcactaccatgactatcaggatggagacgcagatgtgttttccagggagccctttgtggtctggttccaatctccccacactgctgtcaaagacttcgtgattatccccctgcacaccaccccagagacatccgttaaggagatcgatgagttggttgaggtctacacggacgtgaaacaccgctggaaggcggagaatttcattttcatgggtgacttcaatgccggctgcagctacgtccccaagaaggcctggaagaacatccgcttgaggactgaccccaggtttgtttggctgatcggggaccaagaggacaccacggtgaagaagagcaccaactgtgcatatgacaggattgtgcttagaggacaagaaatcgtcagttctgttgttcccaagtcaaacagtgtttttgacttccagaaagcttacaagctgactgaagaggaggccctggatgtcagcgaccactttccagttgaatttaaactacagtcttcaagggccttcaccaacagcaaaaaatctgtcactctaaggaagaaaacaaagagcaaacgctcctagacccaagggtctcatcttattaaccatttcttgcctctaaataaaatgtctctaacagat

SEQ ID NO: 8169 - DNA, 1294 bp, Homo sapiens
agatgtcagagctggctcccggttgggatatgagtgactttgtggaggatggcgcctaaatgaggcatgccaatttctgcaccagggtgacgaacataagggctccttaaaggctagcccaatgtatctgtatttccttggggattaaaacccatgatcttcagttcctcagagaactgaaagttgcaaggagaaatccagtaattcctgttatctgcaggctttataagtcagtggagcctgcggaagtggccagaatccagcactccaagcactgctgtcttctcacagagtcttgaagccagagcagcgccaggatgtcacgggagctggccccactgctgcttctcctcctctccatccacagcgccctggccatgaggatctgctccttcaacgtcaggtcctttggggaaagcaagcaggaagacaagaatgccatggatgtcattgtgaaggtcatcaaacgctgtgacatcatactcgtgatggaaatcaaggacagcaacaacaggatctgccccatactgatggagaagctgaacagaaattcaaggagaggcataacgtacaactatgtgattagctctcggcttggaagaaacacatataaagaacaatatgcctttctctacaaggaaaagctggtgtctgtgaagaggagttatcactaccatgactatcaggatggagacgcagatgtgttttccagggagccctttgtggtctggttccaatctccccacactgctgtcaaagacttcgtgattatccccctgcacaccaccccagagacatccgttaaggagatcgatgagttggttgaggtctacacggacgtgaaacaccgctggaaggcggagaatttcattttcatgggtgacttcaatgccggctgcagctacgtccccaagaaggcctggaagaacatccgcttgaggactgaccccaggtttgtttggctgatcggggaccaagaggacaccacggtgaagaagagcaccaactgtgcatatgacaggattgtgcttagaggacaagaaatcgtcagttctgttgttcccaagtcaaacagtgtttttgacttccagaaagcttacaagctgactgaagaggaggccctggatgtcagcgaccactttccagttgaatttaaactacagtcttcaagggccttcaccaacagcaaaaaatctgtcactctaaggaagaaaacaaagagcaaacgctcctagacccaagggtctcatcttattaaccatttcttgcctctaaataaaatgtctctaacaga

SEQ ID NO: 8170 - DNA, 2109 bp, Homo sapiens
gttatgacctgggaaatgtgagcaggtagaggctacattaagaagtttgctctttgaccaataaaagccctggaaagattttaatcagagcaggcctgcccttcagaaagtgactcttgaggtccaggcacagccctgtgtggaagatagtgtgtgaggctgaaacccagagtgtgtcatcatctggaaacaaccctgcaaagcccactcatgtgacatgcatggagctcttcagcagggacttactgaccaggacaagagcttgagactttgaggggatctgattgtcactgcacaatcaaggacagtattcccaagagtggatgttgctcaagatagtccaaggaattctatgaagaaaaggactccacagacaataaattttggacaccctgtttcaacacaggtgcatcttagagactggtgtttgcaagtatatggagcaggaaacttcatcccgaagatggagaccccggggctgtcagcaggcgttaggctttataagtcagtggagcctgcggaagtggccagaatccagcactccaagcactgctgtcttctcacagagtcttgaagccagagcagcgccaggatgtcacgggagctggccccactgctgcttctcctcctctccatccacagcgccctggccatgaggatctgctccttcaacgtcaggtcctttggggaaagcaagcaggaagacaagaatgccatggatgtcattgtgaaggtcatcaaacgctgtgacatcatactcgtgatggaaatcaaggacagcaacaacaggatctgccccatactgatggagaagctgaacagaaattcaaggagaggcataacgtacaactatgtgattagctctcggcttggaagaaacacatataaagaacaatatgcctttctctacaaggaaaagctggtgtctgtgaagaggagttatcactaccatgactatcaggatggagacgcagatgtgttttccagggagccctttgtggtctggttccaatctccccacactgctgtcaaagacttcgtgattatccccctgcacaccaccccagagacatccgttaaggagatcgatgagttggttgaggtctacacggacgtgaaacaccgctggaaggcggagaatttcattttcatgggtgacttcaatgccggctgcagctacgtccccaagaaggcctggaagaacatccgcttgaggactgaccccaggtttgtttggctgatcggggaccaagaggacaccacggtgaagaagagcaccaactgtgcatatgacaggattgtgcttagaggacaagaaatcgtcagttctgttgttcccaagtcaaacagtgtttttgacttccagaaagcttacaagctgactgaagaggaggtaaggttgccatcttgtctttctatgccattgtcctggaaagatgagttagcttgggcaacatgatgagactccatctctatgaaaaattcaaaaaaattagctgggcatggtgatgcatgcctatggtcccagctacttgggaggctgaggtgggaggatcacttgagtccaggaagcggaggttgcagtgagccaagatcgcaccactgcactccaggctgggcaacagagtgagatcctgtctcaaaaaaaaaaaaaaaaaaagatgggttgatgccaccctttgaggtcaccactgaagacacaacattgggcactagaccttgaccctcaatgcctatgattctgtgatttgaggcccctccaaaatttctgatcgagctggtcttggaatgacgcttaccagtaagtgttctgtggggtgacttcgggcatttcctctcccctccctggtcctaaatttgctcatcgctaaaatgaaagcatctcccaggcatctcctaatttccatgtctacctcccctttctccttataggccctggatgtcagcgaccactttccagttgaatttaaactacagtcttcaagggccttcaccaacagcaaaaaatctgtcactctaaggaagaaaacaaagagcaaacgctcctagacccaagggtctcatcttattaaccatttcttgcctctaaataaaatgtctctaacagat

SEQ ID NO: 8171 - DNA, 786 bp, Homo sapiens
cagcctatgacacttttgctcctcctgaaatctccatatcttgcttttctcaaattccaaggtagcctttgcgcaacatatcactctccactgactcttgtcccatcagggcccatagtggatggctgtatgggggccatgtgactgaactcctgatcctcgtttcagcccactcatgtgacatgcatggagctcttcagcagggacttactgaccaggacaagagcttgagactttgaggggatctgattgtcactgcacaatcaaggacagtattcccaagagtggatgttgctcaagatagtccaaggaattctatgaagaaaaggactccacagacaataaattttggacaccctgtttcaacacagtgcatcttagagactggtgtttgcaagtatatggagcaggaaacttcatcccgaagatggagaccccggggctgtcagcaggcgttagagtcttgaagccagagcagcgccaggatgtcacgggagctggccccactgctgcttctcctcctctccatccacagcgccctggccatgaggatctgctccttcaacgtcaggtcctttggggaaagcaagcaggaagacaagaatgccatggatgtcattgtgaaggtcatcaaacgctgtgacatcatactcgtgatggaaatcaaggacagcaacaacaggatctgccccatactgatggagaagctgaacagaaattcaaggagaggcataacgtacaactatgtgattagctctcggcttggaagaaacacatataaagaac

SEQ ID NO: 8172 - DNA, 1321 bp, Homo sapiens
agaatccagcactccaagcactgctgtcttctcacagagtcttgaagccagagcagcgccaggatgtcacgggagctggccccactgctgcttctcctcctctccatccacagcgccctggccatgaggatctgctccttcaacgtcaggtcctttggggaaagcaagcaggaagacaagaatgccatggatgtcattgtgaaggtcatcaaacgctgtgacatcatactcgtgatggaaatcaaggacagcaacaacaggatctgccccatactgatggagaagctgaacagggaaaagctggtgtctgtgaagaggagttatcactaccatgactatcaggatggagacgcagatgtgttttccagggagccctttgtggtctggttccaatctccccacactgctgtcaaagacttcgtgattatccccctgcacaccaccccagagacatccgttaaggagatcgatgagttggttgaggtctacacggacgtgaaacaccgctggaaggcggagaatttcattttcatgggtgacttcaatgccggctgcagctacgtccccaagaaggcctggaagaacatccgcttgaggactgaccccaggtttgtttggctgatcggggaccaagaggacaccacggtgaagaagagcaccaactgtgcatatgacaggattgtgcttagaggacaagaaatcgtcagttctgttgttcccaagtcaaacagtgtttttgacttccagaaagcttacaagctgactgaagaggaggccctggatgtcagcgaccactttccagttgaatttaaactacagtcttcaagggccttcaccaacagcaaaaaatctgtcactctaaggaagaaaacaaagagcaaacgctcctagacccaagggtctcatcttattaaccatttcttgcctctaaataaaatgtctctaacagatatgaactgctccctgtacttaggaaacaagagtgatccaactgctttcattttttgacctgaatttattctgacttgagccaaattggaaggagaatcttttgtatctctcttggtctcatacctcccctgaattgtctaaaagggaaccaggggcatttgtagaccaaaatgatgatcttcatgccctgagccagagccccatccactgtcactggccctgctcaaccctgtcatgcgagaggctgcagggggaggaagagcgtcagctttcagtcctcatgaggggtcctgttccacacgcaatgaccagaaacaccaaggccccagctgcccctgtgatttgggcaattaactgttttaagagtctg

SEQ ID NO: 8173 - DNA, 1170 bp, Homo sapiens
gggcgcgtcttcagggtggaagcctggcgcacgtccggaggtgccgaggacccaaccagcccaaactctgggggaaatgactcccctctgccctcgccccgcgctctgctaccatttccttacgtctctgcttcgctcagcgatgcaaaacgcgcgaacggcagagggccgaagccgcggtactctccgggccaggcccgcccctcggccggccgcgcagcacgggattccccggccgctgtccagcgctggccgcctgagccaaggctgccgcggagccagtacagtcggggccgctggctggaagggcgagcttcctaaggcggggggaagcccggcgccggggccggagacacccgccatttcacccagtaagcgggcccggcctgcggaggtgggcggcatgcagctccgctttgcccggctctccgagcacgccacggcccccacccggggctccgcgcgcgccgcgggctacgacctgtacagtgcctatgattacacaataccacctatggagaaagctgttgtgaaaacggacattcagatagcgctcccttctgggtgttatggaagagtggctccacggtcaggcttggctgcaaaacactttattgatgtaggagctggtgtcatagatgaagattatagaggaaatgttggtgttgtactgtttaattttggcaaagaaaagtttgaagtcaaaaaaggtgatcgaattgcacagctcatttgcgaacggattttttatccagaaatagaagaagttcaagccttggatgacaccgaaaggggttcaggaggttttggttccactggaaagaattaaaatttatgccaagaacagaaaacaagaagtcatacctttttcttaaaaaaaaaaaaaaagtttttgcttcaagtgttttggtgttttgcacttctgtaaacttactagctttaccttctaaaagtactgcattttttacttttttttatgatcaaggaaaagatcattaaaaaaaaacacaaagaagtttttctttgtgtttggatcaaaaagaaactttgtttttccgcaattgaaggttgtatgtaaatctgctttgtggtgacctgatgtaaacagtgtcttcttaaaatcaaatgtaaatcaattacagattaaaaaaaaaagcctgtatttaactc

SEQ ID NO: 8174 - DNA, 2147 bp, Homo sapiens
ggtcatgttcccaggacgggcgcgtcttcagggtggaagcctggcgcacgtccggaggtgccgaggacccaaccagcccaaactctgggggaaatgactcccctctgccctcgccccgcgctctgctaccatttccttacgtctctgcttcgctcagcgatgcaaaacgcgcgaggcgcacggcagagggccgaagccgcggtactctccgggccaggcccgcccctcggccgcgccgcgcagcacgggattccccggccgctgtccagcgctggccgcctgagccaaggctgccgcggagccagtacagtcggggccgctggctggaagggcgagcttcctaaggcggggggaagcccggcgccggggccggagacacccgccatttcacccagtaagcgggcccggcctgcggaggtgggcggcatgcagctccgctttgcccggctctccgagcacgccacggcccccacccggggctccgcgcgcgccgcgggctacgacctgtacagtgcctatgattacacaataccacctatggagaaagctgttgtgaaaacggacattcagatagcgctcccttctgggtgttatggaagagtggctccacggtcaggcttggctgcaaaacactttattgatgtaggagctggtgtcatagatgaagattatagaggaaatgttggtgttgtactgtttaattttggcaaagaaaagtttgaagtcaaaaaaggtgatcgaattgcacagctcatttgcgaacggattttttatccagaaatagaagaagttcaagccttggatgacaccgaaaggggttcaggaggttttggttccactggaaagaattaaaatttatgccaagaacagaaaacaagaagtcatacctttttcttaaaaaaaaaaaaaaagtttttgcttcaagtgttttggtgttttgcacttctgtaaacttactagctttaccttctaaaagtactgcattttttacttttttttatgatcaaggaaaagatcattaaaaaaaaacacaaagaagtttttctttgtgtttggatcaaaaagaaactttgtttttccgcaattgaaggttgtatgtaaatctgctttgtggtgacctgatgtaaacagtgtcttcttaaaatcaaatgtaaatcaattacagattaaaaaaaaaagcctgtatttaactcatatgatctcccttcagcaacttattttgctttaattgctttaaatcttaagcaatattttttattcagtaaacaaattctttcacaaggtacaaaatcttgcataagctgaactaaaataaaaatgaaaaggagagattaaaggtattccttgttcttcccttctcttcactagtctaaaaacttctttttaatcttaagattctttgtgatgagggtgagaaaaagaatcctcagtttatttttccactattaatctttcttttgataaatcctctattgactgggtagaggtatgtttgtgaaagacatgtaacttggggatttgttactttaggtttgttcccttgaatttcatctcatcaggcaaattgtactagttgtagttacgagttttccctcagtgaagtagcaataggctgtaatcaagaaaatatgccatttatagagataagataaatgaaataatacttcagccaccaggtttttctgtctcacatacataagcagcatttcattgcagatatgggactgattctgtggcttaccttgattaacatcttttggaagttttgctagtgtgctttcctttctttactatgtttctcagattcctttgtatcagggttttgggtgtcacttaggttttgtccatcagattctgtgagacaccaggcatcgttttgaggatgtgggttatacacatggagtgcttctggaactatcagcccacttgaccacccagtttgtggaagcacaggcaagagtgttcttttctggtgattctccaggccatttaataccctgcaatgtaattgtccctctgtggctcacatttcattagtgagccatgaaatcaactcagtgggacatagccagcatttttgcataccaggttgggctataaaatatttctgttgtcaataaattttaaatgttttcctgctaaactaa

SEQ ID NO: 8175 - DNA, 1935 bp, Homo sapiens
agccagaactgtggactcgtcccggggaggggcggtgggtggggcggggctggcgggaaatttcggttttggcgcgctccctgcggcgacgctcatcgtgcgctctcctcttcccccggtggtctcctcgctcgccttctggctctgccatgccctgctctgaagagacacccgccatttcacccagtaagcgggcccggcctgcggaggtgggcggcatgcagctccgctttgcccggctctccgagcacgccacggcccccacccggggctccgcgcgcgccgcgggctacgacctgtacagtgcctatgattacacaataccacctatggagaaagctgttgtgaaaacggacattcagatagcgctcccttctgggtgttatggaagagtggctccacggtcaggcttggctgcaaaacactttattgatgtaggagctggtgtcatagatgaagattatagaggaaatgttggtgttgtactgtttaattttggcaaagaaaagtttgaagtcaaaaaaggtgatcgaattgcacagctcatttgcgaacggattttttatccagaaatagaagaagttcaagccttggatgacaccgaaaggggttcaggaggttttggttccactggaaagaattaaaatttatgccaagaacagaaaacaagaagtcatacctttttcttaaaaaaaaaaaaaaagtttttgcttcaagtgttttggtgttttgcacttctgtaaacttactagctttaccttctaaaagtactgcattttttacttttttttatgatcaaggaaaagatcattaaaaaaaaacacaaagaagtttttctttgtgtttggatcaaaaagaaactttgtttttccgcaattgaaggttgtatgtaaatctgctttgtggtgacctgatgtaaacagtgtcttcttaaaatcaaatgtaaatcaattacagattaaaaaaaaaagcctgtatttaactcatatgatctcccttcagcaacttattttgctttaattgctttaaatcttaagcaatattttttattcagtaaacaaattctttcacaaggtacaaaatcttgcataagctgaactaaaataaaaatgaaaaggagagattaaaggtattccttgttcttcccttctcttcactagtctaaaaacttctttttaatcttaagattctttgtgatgagggtgagaaaaagaatcctcagtttatttttccactattaatctttcttttgataaatcctctattgactgggtagaggtatgtttgtgaaagacatgtaacttggggatttgttactttaggtttgttcccttgaatttcatctcatcaggcaaattgtactagttgtagttacgagttttccctcagtgaagtagcaataggctgtaatcaagaaaatatgccatttatagagataagataaatgaaataatacttcagccaccaggtttttctgtctcacatacataagcagcatttcattgcagatatgggactgattctgtggcttaccttgattaacatcttttggaagttttgctagtgtgctttcctttctttactatgtttctcagattcctttgtatcagggttttgggtgtcacttaggttttgtccatcagattctgtgagacaccaggcatcgttttgaggatgtgggttatacacatggagtgcttctggaactatcagcccacttgaccacccagtttgtggaagcacaggcaagagtgttcttttctggtgattctccaggccatttaataccctgcaatgtaattgtccctctgtggctcacatttcattagtgagccatgaaatcaactcagtgggacatagccagcatttttgcataccaggttgggctataaaatatttctgttgtcaataaattttaaatgttttcctgctaaa

SEQ ID NO: 8176 - DNA, 769 bp, Homo sapiens
ggctgcgactgcttccgaggtcatgttcccaggacgggcgcgtcttcagggtggaagcctggcgcacgtccggagagacacccgccatttcacccagtaagcgggcccggcctgcggaggtgggcggcatgcagctccgctttgcccggctctccgagcacgccacggcccccacccggggctccgcgcgcgccgcgggctacgacctgtacagtgcctatgattacacaataccacctatggagaaagctgttgtgaaaacggacattcagatagcgctcccttctgggtgttatggaagagtggctccacggtcaggcttggctgcaaaacactttattgatgtaggagctggtgtcatagatgaagattatagaggaaatgttggtgttgtactgtttaattttggcaaagaaaagtttgaagtcaaaaaaggtgatcgaattgcacagctcatttgcgaacggattttttatccagaaatagaagaagttcaagccttggatgacaccgaaaggggttcaggaggttttggttccactggaaagaattaaaatttatgccaagaacagaaaacaagaagtcatacctttttcttaaaaaaaaaaaaaaagtttttgcttcaagtgttttggtgttttgcacttctgtaaacttactagctttaccttctaaaagtactgcattttttacttttttttatgatcaaggaaaagatcattaaaaaaaaacacaaagaagtttttctttgtgtttggatcaaaaagaa

SEQ ID NO: 8177 - DNA, 1712 bp, Homo sapiens
gtgccgagactcgccactgccgcggccgctgggcctgagtgtcgccttcgccgccatggacgccaccgggcgctgacagacctatggagagtcagggtgtgcctcccgggccttatcgggccaccaagctgtggaatgaagttaccacatcttttcgagcaggaatgcctctaagaaaacacagacaacactttaaaaaatatggcaattgtttcacagcaggagaagcagtggattggctttatgacctattaagaaataatagcaattttggtcctgaagttacaaggcaacagactatccaactgttgaggaaatttcttaagaatcatgtaattgaagatatcaaagggaggtggggatcagaaaatgttgatgataacaaccagctcttcagatttcctgcaacttcgccacttaaaactctaccacgaagaactcctaaaaggcatggattacatttatctcaggaaaatggcgagaaaataaagcatgaaataatcaatgaagatcaagaaaatgcaattgataatagagaactaagccaggaagatgttgaagaagtttggagatatgttattctgatctacctgcaaaccattttaggtgtgccatccctagaagaagtcataaatccaaaacaagtaattccccaatatataatgtacaacatggccaatacaagtaaacgtggagtagttatactacaaaacaaatcagatgacctccctcactgggtattatctgccatgaagtgcctagcaaattggccaagaagcaatgatatgaataatccaacttatgttggatttgaacgagatgtattcagaacaatcgcagattattttctagatctccctgaacctctacttacttttgaatattacgaattatttgtaaacattttgggaaatttcaaggattttaggagctccataccagttgtttgtggctacatcacagtttcagatagatccagtgggatacataaaattcaagatgatccacagtcttcaaaattccttcacttaaacaatttgaattccttcaaatcaactgagtgccttcttctcagtctgcttcatagagaaaaaaacaaagaagaatcagattctactgagagactacagataagcaatccaggatttcaagaaagatgtgctaagaaaatgcagctagttaatttaagaaacagaagagcttgctgcaacctcatttagagagggttgccatcgatgctctacagttatgttgtttgttacttcccccaccaaatcgtagaaagcttcaacttttaatgcgtatgatttcccgaatgagtcaaaatgttgatatgcccaaacttcatgatgcaatgggtacgaggtcactgatgatacataccttttctcgatgtgtgttatgctgtgctgaagaagtggatcttgatgagcttcttgctggaagattagtttctttcttaatggatcatcatcaggaaattcttcaagtaccctcttacttacagactgcagtggaaaaacatcttgactacttaaaaaagggacatattgaaaatcctggagatggactatttgctcctttgccaacttactcatactgtaagcagattagtgctcaggagtttgatgagcaaaaagtttctacctctcaagctgcaattgcagaacttttagaaaatattattaaaaacaggagtttacctctaaagg

SEQ ID NO: 8178 - DNA, 4586 bp, Homo sapiens
agctactggagccccaggacgcagccgagcggccctcgccgactccttcccgagcctggctgtggcgtcacgtgacccgcggcgcggccaatccgcgcagccctctatgctattcaaatcggcggcggggccaacggttgtgccgagactcgccactgccgcggccgctgggcctgagtgtcgccttcgccgccatggacgccaccgggcgctgacagacctatggagagtcagggtgtgcctcccgggccttatcgggccaccaagctgtggaatgaagttaccacatcttttcgagcaggaatgcctctaagaaaacacagacaacactttaaaaaatatggcaattgtttcacagcaggagaagcagtggattggctttatgacctattaagaaataatagcaattttggtcctgaagttacaaggcaacagactatccaactgttgaggaaatttcttaagaatcatgtaattgaagatatcaaagggaggtggggatcagaaaatgttgatgataacaaccagctcttcagatttcctgcaacttcgccacttaaaactctaccacgaaggtatccagaattgagaaaaaacaacatagagaacttttccaaagataaagatagcatttttaaattacgaaacttatctcgtagaactcctaaaaggcatggattacatttatctcaggaaaatggcgagaaaataaagcatgaaataatcaatgaagatcaagaaaatgcaattgataatagagaactaagccaggaagatgttgaagaagtttggagatatgttattctgatctacctgcaaaccattttaggtgtgccatccctagaagaagtcataaatccaaaacaagtaattccccaatatataatgtacaacatggccaatacaagtaaacgtggagtagttatactacaaaacaaatcagatgacctccctcactgggtattatctgccatgaagtgcctagcaaattggccaagaagcaatgatatgaataatccaacttatgttggatttgaacgagatgtattcagaacaatcgcagattattttctagatctccctgaacctctacttacttttgaatattacgaattatttgtaaacattttgggcttgctgcaacctcatttagagagggttgccatcgatgctctacagttatgttgtttgttacttcccccaccaaatcgtagaaagcttcaacttttaatgcgtatgatttcccgaatgagtcaaaatgttgatatgcccaaacttcatgatgcaatgggtacgaggtcactgatgatacataccttttctcgatgtgtgttatgctgtgctgaagaagtggatcttgatgagcttcttgctggaagattagtttctttcttaatggatcatcatcaggaaattcttcaagtaccctcttacttacagactgcagtggaaaaacatcttgactacttaaaaaagggacatattgaaaatcctggagatggactatttgctcctttgccaacttactcatactgtaagcagattagtgctcaggagtttgatgagcaaaaagtttctacctctcaagctgcaattgcagaacttttagaaaatattattaaaaacaggagtttacctctaaaggagaaaagaaaaaaactaaaacagtttcagaaggaatatcctttgatatatcagaaaagatttccaaccacggagagtgaagcagcactttttggtgacaaacctacaatcaagcaaccaatgctgattttaagaaaaccaaagttccgtagtctaagataactaactgaattaaaaattatgtaatacttgtggaactttgataaatgaagccatatctgagaatgtagctactcaaaaggaagtctgtcattaataaggtatttctaaataaacacattatgtaaggaagtgccaaaatagttatcaatgtgagactcttaggaaactaactagatctcaattgagagcacataacaatagatgataccaaatactttttgtttttaacacagctatccagtaaggctatcatgatgtgtgctaaaattttatttacttgaattttgaaaactgagctgtgttagggattaaactataattctgttcttaaaagaaaatttatctgcaaatgtgcaagttctgagatattagctaatgaattagttgtttggggttacttctttgtttctaagtataagaatgtgaagaatatttgaaaactcaatgaaataattctcagctgccaaatgttgcactcttttatatattctttttccacttttgatctatttatatatatgtatgtgtttttaaaatatgtgtatattttatcagatttggttttgccttaaatattatccccaattgcttcagtcattcatttgttcagtatatatattttgaattctagttttcataatctattagaagatggggatataaaagaagtataaggcaatcatatattcattcaaaagatatttatttagcaactgctatgtgcctttcgttgttccagatatgcagagacaatgataaataaaacatataatctcttccataaggtatttattttttaatcaagggagatacacctatcagatgtttaaaataacaacactacccactgaaatcagggcatatagaatcattcagctaaagagtgacttctatgatgatggaacaggtctctaagctagtggttttcaaactggtacacattagactcacccgaggaattttaaaacagcctatatgcccagggcctaacttacactaattaaatctgaattttggggatgttgtatagggattagtattttttttaatctaggtgattccaatattcagccaactgtgagaatcaatggcctaaatgctttttataaacatttttataagtgtcaagataatggcacattgactttattttttcattggaagaaaatgcctgccaagtataaatgactctcatcttaaaacaaggttcttcaggtttctgcttgattgacttggtacaaacttgaagcaagttgccttctaatttttactccaagattgtttcatatctattccttaagtgtaaagaaatatataatgcatggtttgtaataaaatcttaatgtttaatgactgttctcatttctcaatgtaatttcatactgtttctctataaaatgatagtattccatttaacattactgatttttattaaaaacctggacagaaaattataaattataaatatgactttatcctggctataaaattattgaaccaaaatgaattctttctaaggcatttgaatactaaaacgtttattgtttatagatatgtaaaatgtggattatgttgcaaattgagattaaaattatttggggttttgtaacaatataattttgcttttgtattatagacaaatatataaataataaaggcaggcaactttcatttgcactaatgtacatgcaattgagattacaaaatacatggtacaatgctttaataacaaactctgccagtcaggtttgaatcctactgtgctattaactagctagtaaactcagacaagttacttaacttctctaagccccagttttgttatctataaaatgaatattataatagtacctctttttaggattgcgaggattaagcaggataatgcatgtaaagtgttagcacagtgtctcacatagaataagcactctataaatattttactagaatcacctaggattatagcactagaagagatcttagcaaaaatgtggtcctttctgttgctttggacagacatgaaccaaaacaaaattacggacaattgatgagccttattaactatcttttcattatgagacaaaggttctgattatgcctactggttgaaattttttaatctagtcaagaaggaaaatttgatgaggaaggaaggaatggatatcttcagaagggcttcgcctaagctggaacatggatagattccattctaacataaagatctttaagttcaaatatagatgagttgactggtagatttggtggtagttgctttctcgggatataagaagcaaaatcaactgctacaagtaaagaggggatggggaaggtgttgcacatttaaagagagaaagtgtgaaaaagcctaattgtgggaatgcacaggtttcaccagatcagatgatgtctggttattctgtaaattatagttcttatcccagaaattactgcctccaccatccctaatatcttctaattggtatcatataatgacccactcttcttatgttatccaaacagttatgtggcatttagtaatggaatgtacatggaatttcccactgacttacctttctgtccttgggaagcttaaactctgaatcttctcatctgtaaaatgtgaattaaagtatctacctaactgagttgtgattgtagtgaaagaaaggcaatatatttaaatcttgaatttagcaagcccacgcttgatttttatgtcctttcctcttgccttgtattgagtttaagatctctactgattaaaactcttttgctatcaa

SEQ ID NO: 8179 - DNA, 5331 bp, Homo sapiens
tgctattcaaatcggcggcggggccaacggttgtgccgagactcgccactgccgcggccgctgggcctgagtgtcgccttcgccgccatggacgccaccgggcgctgacagacctatggagagtcagggtgtgcctcccgggccttatcgggccaccaagctgtggaatgaagttaccacatcttttcgagcaggaatgcctctaagaaaacacagacaacactttaaaaaatatggcaattgtttcacagcaggagaagcagtggattggctttatgacctattaagaaataatagcaattttggtcctgaagttacaaggcaacagactatccaactgttgaggaaatttcttaagaatcatgtaattgaagatatcaaagggaggtggggatcagaaaatgttgatgataacaaccagctcttcagatttcctgcaacttcgccacttaaaactctaccacgaaggtatccagaattgagaaaaaacaacatagagaacttttccaaagataaagatagcatttttaaattacgaaacttatctcgtagaactcctaaaaggcatggattacatttatctcaggaaaatggcgagaaaataaagcatgaaataatcaatgaagatcaagaaaatgcaattgataatagagaactaagccaggaagatgttgaagaagtttggagatatgttattctgatctacctgcaaaccattttaggtgtgccatccctagaagaagtcataaatccaaaacaagtaattccccaatatataatgtacaacatggccaatacaagtaaacgtggagtagttatactacaaaacaaatcagatgacctccctcactgggtattatctgccatgaagtgcctagcaaattggccaagaagcaatgatatgaataatccaacttatgttggatttgaacgagatgtattcagaacaatcgcagattattttctagatctccctgaacctctacttacttttgaatattacgaattatttgtaaacattttggttgtttgtggctacatcacagtttcagatagatccagtgggatacataaaattcaagatgatccacagtcttcaaaattccttcacttaaacaatttgaattccttcaaatcaactgagtgccttcttctcagtctgcttcatagagaaaaaaacaaagaagaatcagattctactgagagactacagataagcaatccaggatttcaagaaagatgtgctaagaaaatgcagctagttaatttaagaaacagaagagtgagtgctaatgacataatgggaggaagttgtcataatttaatagggttaagtaatatgcatgatctatcctctaacagcaaaccaaggtgctgttctttggaaggaattgtagatgtgccagggaattcaagtaaagaggcatccagtgtctttcatcaatcttttccgaacatagaaggacaaaataataaactgtttttagagtctaagcccaaacaggaattcctgttgaatcttcattcagaggaaaatattcaaaagccattcagtgctggttttaagagaacctctactttgactgttcaagaccaagaggagttgtgtaatgggaaatgcaagtcaaaacagctttgtaggtctcagagtttgcttttaagaagtagtacaagaaggaatagttatatcaatacaccagtggctgaaattatcatgaaaccaaatgttggacaaggcagcacaagtgtgcaaacagctatggaaagtgaactcggagagtctagtgccacaatcaataaaagactctgcaaaagtacaatagaactttcagaaaattctttacttccagcttcttctatgttgactggcacacaaagcttgctgcaacctcatttagagagggttgccatcgatgctctacagttatgttgtttgttacttcccccaccaaatcgtagaaagcttcaacttttaatgcgtatgatttcccgaatgagtcaaaatgttgatatgcccaaacttcatgatgcaatgggtacgaggtcactgatgatacataccttttctcgatgtgtgttatgctgtgctgaagaagtggatcttgatgagcttcttgctggaagattagtttctttcttaatggatcatcatcaggaaattcttcaagtaccctcttacttacagactgcagtggaaaaacatcttgactacttaaaaaagggacatattgaaaatcctggagatggactatttgctcctttgccaacttactcatactgtaagcagattagtgctcaggagtttgatgagcaaaaagtttctacctctcaagctgcaattgcagaacttttagaaaatattattaaaaacaggagtttacctctaaaggagaaaagaaaaaaactaaaacagtttcagaaggaatatcctttgatatatcagaaaagatttccaaccacggagagtgaagcagcactttttggtgacaaacctacaatcaagcaaccaatgctgattttaagaaaaccaaagttccgtagtctaagataactaactgaattaaaaattatgtaatacttgtggaactttgataaatgaagccatatctgagaatgtagctactcaaaaggaagtctgtcattaataaggtatttctaaataaacacattatgtaaggaagtgccaaaatagttatcaatgtgagactcttaggaaactaactagatctcaattgagagcacataacaatagatgataccaaatactttttgtttttaacacagctatccagtaaggctatcatgatgtgtgctaaaattttatttacttgaattttgaaaactgagctgtgttagggattaaactataattctgttcttaaaagaaaatttatctgcaaatgtgcaagttctgagatattagctaatgaattagttgtttggggttacttctttgtttctaagtataagaatgtgaagaatatttgaaaactcaatgaaataattctcagctgccaaatgttgcactcttttatatattctttttccacttttgatctatttatatatatgtatgtgtttttaaaatatgtgtatattttatcagatttggttttgccttaaatattatccccaattgcttcagtcattcatttgttcagtatatatattttgaattctagttttcataatctattagaagatggggatataaaagaagtataaggcaatcatatattcattcaaaagatatttatttagcaactgctatgtgcctttcgttgttccagatatgcagagacaatgataaataaaacatataatctcttccataaggtatttattttttaatcaagggagatacacctatcagatgtttaaaataacaacactacccactgaaatcagggcatatagaatcattcagctaaagagtgacttctatgatgatggaacaggtctctaagctagtggttttcaaactggtacacattagactcacccgaggaattttaaaacagcctatatgcccagggcctaacttacactaattaaatctgaattttggggatgttgtatagggattagtattttttttaatctaggtgattccaatattcagccaactgtgagaatcaatggcctaaatgctttttataaacatttttataagtgtcaagataatggcacattgactttattttttcattggaagaaaatgcctgccaagtataaatgactctcatcttaaaacaaggttcttcaggtttctgcttgattgacttggtacaaacttgaagcaagttgccttctaatttttactccaagattgtttcatatctattccttaagtgtaaagaaatatataatgcatggtttgtaataaaatcttaatgtttaatgactgttctcatttctcaatgtaatttcatactgtttctctataaaatgatagtattccatttaacattactgatttttattaaaaacctggacagaaaattataaattataaatatgactttatcctggctataaaattattgaaccaaaatgaattctttctaaggcatttgaatactaaaacgtttattgtttatagatatgtaaaatgtggattatgttgcaaattgagattaaaattatttggggttttgtaacaatataattttgcttttgtattatagacaaatatataaataataaaggcaggcaactttcatttgcactaatgtacatgcaattgagattacaaaatacatggtacaatgctttaataacaaactctgccagtcaggtttgaatcctactgtgctattaactagctagtaaactcagacaagttacttaacttctctaagccccagttttgttatctataaaatgaatattataatagtacctctttttaggattgcgaggattaagcaggataatgcatgtaaagtgttagcacagtgtctcacatagaataagcactctataaatattttactagaatcacctaggattatagcactagaagagatcttagcaaaaatgtggtcctttctgttgctttggacagacatgaaccaaaacaaaattacggacaattgatgagccttattaactatcttttcattatgagacaaaggttctgattatgcctactggttgaaattttttaatctagtcaagaaggaaaatttgatgaggaaggaaggaatggatatcttcagaagggcttcgcctaagctggaacatggatagattccattctaacataaagatctttaagttcaaatatagatgagttgactggtagatttggtggtagttgctttctcgggatataagaagcaaaatcaactgctacaagtaaagaggggatggggaaggtgttgcacatttaaagagagaaagtgtgaaaaagcctaattgtgggaatgcacaggtttcaccagatcagatgatgtctggttattctgtaaattatagttcttatcccagaaattactgcctccaccatccctaatatcttctaattggtatcatataatgacccactcttcttatgttatccaaacagttatgtggcatttagtaatggaatgtacatggaatttcccactgacttacctttctgtccttgggaagcttaaactctgaatcttctcatctgtaaaatgtgaattaaagtatctacctaactgagttgtgattgtagtgaaagaaaggcaatatatttaaatcttgaatttagcaagcccacgcttgatttttatgtcctttcctcttgccttgtattgagtttaagatctctactgattaaaactcttttgctatcaa

SEQ ID NO: 8180 - DNA, 2499 bp, Homo sapiens
aaactgctgctcctccggctggcggggatcagcgctggcgcggctgcggccgctgctgcctacgcgccatggagcatcgcatcgtggggcccgggccgtaccgagctaccaggctgtggaatgagaccgtggagctttttcgtgctaagatgccgttacggaaacatcgctgtcgtttcaagagctatgagcattgtttcacagcggccgaagctgtggattggctgcatgagctgctgaggtgcagtcaaaacttcggccctgaagtgacccgcaaacaaacggtccagctgctaaaaaaattcctgaagaatcacgttattgaagacatcaagggaaaatggggtgaggaagattttgaagacaatcgtcacttatacagatttcctccttcttcacccctgaaaccatatccaaagaagcccccaaaccaaaaggatgttattaaatttccagaatggaatgatctcccaccaggcacttcacaagagaacatcccagtgaggccagttgtgatgaattctgagatgtggtacaagcgtcacagtattgcaattggagaggtgccagcttgccgtcttgtccaccgcagacagctgacagaggccaatgtagaagagatatggaagtctatgacattatcatacttacagaaaattcttggcctggattccttagaagaagttttagacgtcaaacttgtcaattcgaagttcatcatccataatgtatatagtgttagcaagcagggagttgttattcttgatgacaagtcaaaagaacttcctcattgggtgctgtcagctatgaagtgtttggcaaattggcccaactgttctgatttgaagcagcctatgtacttgggatttgaaaaagatgtctttaaaaccatagctgattactatggtcacttgaaagagcctctacttacatttcatctttttgatgcttttgtcagtgtactgggtttgttacagaaggagaaagtggcagttgaagcatttcagatttgctgccttctcctacctcctgaaaataggagaaagttacagctattgatgaggatgatggcaaggatttgcttaaacaaagagatgccacccctgtgtgatggctttggtacccgaacactgatggttcagacattttcccgttgcatcttgtgttccaaggatgaagtggacttggatgagttattagctgctagattggtaacgtttctgatggacaattaccaggaaattctgaaagtccctttggccttgcagacctctatagaggagcgtgtggctcatctacgaagagtccagataaaatacccaggagctgatatggatatcactttatctgctccatcattttgccgtcaaattagtccagaggaatttgaatatcaaagatcatatggctctcaggaacctctggcagccttgttggaggaagtcataacagatgccaaactctccaacaaagagaaaaagaagaaactgaagcagtttcagaaatcctatcctgaagtctatcaagaacgatttcctacaccagaaagtgcagcacttctgtttcctgaaaaacccaaaccgaaaccacagctgctaatgtgggcactaaagaagcctttccaaccatttcaaagaactagaagttttcgaatgtaataatacttccacagcaacaggtgctagagaccactgttgttgttttgagtgaatggtggttaggagaaagactttggtggtggaagaaagaaaagcataaaacaaagactactgaaatatagataaagattgccttagtttttaaaaatgtttggccattagtatttttataaaactcaatgctagttttaaagtgtataaattggttaaaatttatgagtcaaatatatagtgataatgttaacatgtttgtaattgctacagaatttaagggtatttttatctctgtgctttctttttcatggtgtttattaaataattgtgtatatacatcctagctactgatatctttattatagccttaagacttaattttaagtcttaaaaatagcgtgtatacttgaataagaaagacactgggtactgttactgtgatgctattgacttagtagccaattatcatttctcctgtataaattccagtttttattgctgcacataaattttttaatgtcttatattgtgatagctatgtcttttattgcagatttattggatgttatgacagattttactaaagctagtgtttttataacatatatattagttgatgtttacctataagtggagtagattttcatctgcctgcaatggtataatttcagtcttagctaaaaatggaaagttgaactggataaattctttgggtacccttagacctctgattctaagtcaaatgcaaatgggttaaataaaatgagactacttcctttataaatatattttcatccttttgaaagtaagtgaaatgtaaataaacttattttttttaaaaatgcca

SEQ ID NO: 8181 - DNA, 1569 bp, Homo sapiens
atcagcgctggcgcggctgcggccgctgctgcctacgcgccatggagcatcgcatcgtggggcccgggccgtaccgagctaccaggctgtggaatgagaccgtggagctttttcgtgctaagatgccgttacggaaacatcgctgtcgtttcaagagctatgagcattgtttcacagcggccgaagctgtggattggctgcatgagctgctgaggtgcagtcaaaacttcggccctgaagtgacccgcaaacaaacggtccagctgctaaaaaaattcctgaagaatcacgttattgaagacatcaagggaaaatggggtgaggaagattttgaagacaatcgtcacttatacagatttcctccttcttcacccctgaaaccatatccaaagaagcccccaaaccaaaaggatgttattaaatttccagaatggaatgatctcccaccaggcacttcacaagagaacatcccagtgaggccagttgtgatgaattctgagatgtggtacaagcgtcacagtattgcaattggagaggtgccagcttgccgtcttgtccaccgcagacagctgacagaggccaatgtagaagagatatggaagtctatgacattatcatacttacagaaaattcttggcctggattccttagaagaagttttagacgtcaaacttgtcaattcgaagttcatcatccataatgtatatagtgttagcaagcagggagttgttattcttgatgacaagtcaaaagaacttcctcattgggtgctgtcagctatgaagtgtttggcaaattggcccaactgttctgatttgaagcagcctatgtacttgggatttgaaaaagatgtctttaaaaccatagctgattactatggtcacttgaaagagcctctacttacatttcatctttttgatgcttttgtcagtgtactgggtttgttacagaaggagaaagtggcagttgaagcatttcagatttgctgccttctcctacctcctgaaaataggagaaagttacagctattgatgaggatgatggcaaggatttgcttaaacaaagagatgccacccctgtgtgatggctttggtacccgaacactgatggttcagacattttcccgttgcatcttgtgttccaaggatgaagtggacttggatgagttattagctgctagattggtaacgtttctgatggacaattaccaggaaattctgaaagtccctttggccttgcagacctctatagaggagcgtgtggctcatctacgaagagtccagtttcagaaatcctatcctgaagtctatcaagaacgatttcctacaccagaaagtgcagcacttctgtttcctgaaaaacccaaaccgaaaccacagctgctaatgtgggcactaaagaagcctttccaaccatttcaaagaactagaagttttcgaatgtaataatacttccacagcaacaggtgctagagaccactgttgttgttttgagtgaatggtggttaggagaaagactttggtggtggaagaaagaaaagcataaaacaaagactactgaaatatagat

SEQ ID NO: 8182 - DNA, 1596 bp, Homo sapiens
atcagcgctggcgcggctgcggccgctgctgcctacgcgccatggagcatcgcatcgtggggcccgggccgtaccgagctaccaggctgggattgattctgttatcctgaagtggtccagtgtttcttatacttgaagattaggatcattgtgtgtggaatgagaccgtggagctttttcgtgctaagatgccgttacggaaacatcgctgtcgtttcaagagctatgagcattgtttcacagcggccgaagctgtggattggctgcatgagctgctgaggtgcagtcaaaacttcggccctgaagtgacccgcaaacaaacggtccagctgctaaaaaaattcctgaagaatcacgttattgaagacatcaagggaaaatggggtgaggaagattttgaagacaatcgtcacttatacagatttcctccttcttcacccctgaaaccatatccaaagaagcccccaaaccaaaaggatgttattaaatttccagaatggaatgatctcccaccaggcacttcacaagagaacatcccagtgaggccagttgtgatgaattctgagatgtggtacaagcgtcacagtattgcaattggagaggtgccagcttgccgtcttgtccaccgcagacagctgacagaggccaatgtagaagagatatggaagtctatgacattatcatacttacagaaaattcttggcctggattccttagaagaagttttagacgtcaaacttgtcaattcgaagttcatcatccataatgtatatagtgttagcaagcagggagttgttattcttgatgacaagtcaaaagaacttcctcattgggtgctgtcagctatgaagtgtttggcaaattggcccaactgttctgatttgaagcagcctatgtacttgggatttgaaaaagatgtctttaaaaccatagctgattactatggtcacttgaaagagcctctacttacatttcatctttttgatgcttttgtcagtgtactgggtttgttacagaaggagaaagtggcagttgaagcatttcagatttgctgccttctcctacctcctgaaaataggagaaagttacagctattgatgaggatgatggcaaggatttgcttaaacaaagagatgccacccctgtgtgatggctttggtacccgaacactgatggttcagacattttcccgttgcatcttgtgttccaaggatgaagtggacttggatgagttattagctgctagattggtaacgtttctgatggacaattaccaggaaattctgaaagtccctttggccttgcagacctctatagaggagcgtgtggctcatctacgaagagtccagtttcagaaatcctatcctgaagtctatcaagaacgatttcctacaccagaaagtgcagcacttctgtttcctgaaaaacccaaaccgaaaccacagctgctaatgtgggcactaaagaagcctttccaaccatttcaaagaactagaagttttcgaatgtaataatacttccacagcaacaggtgctagagaccactgttgttgttttgagtgaatggtggttaggagaaagactttggtggtggaa

SEQ ID NO: 8183 - DNA, 5405 bp, Homo sapiens
atctggaggaggcgcagggaacctggagagggtccagccctcagtgccccggccagaggcgggaaggggctctagagcttcgggaggcaagatgacttctctgccccaagcttggaacagctaaagggaaaaacagtgcaagatgagaacaacaaaggtctacaaactcgtcatccacaagaagggctttgggggcagtgatgatgagctagttgtgaaccccaaagtgttccctcacatcaagcttggagacattgtagagattgcacaccccaacgatgaatacagccctctgcttttgcaggtcaagtctcttaaggaagatttacagaaggaaactatcagtgtggaccagactgtgactcaagtgttccggctgagaccttatcaggatgtctatgttaatgtcgtagaccctaaggatgtgacccttgacctagtggaattaacttttaaggatcagtatattggccgtggggatatgtggcgactaaagaaaagtttggtcagcacatgtgcctatatcacccagaaggtggagtttgctggcatcagagcacaggctggtgaactgtgggttaagaatgagaaggtcatgtgtggctacatcagtgaagataccagggtggtgtttcgttctacgtcggctatggtttacatatttattcagatgagctgtgaaatgtgggattttgatatttatggggatttgtattttgagaaagctgtgaatggtttccttgctgatctatttaccaagtggaaggagaagaactgtagtcatgaagtgacagtggtcctgttttctagaactttctatgatgcaaaatctgttgatgaatttcctgaaataaaccgagcctcaattcgacaggatcacaaggggagattctatgaagacttttacaaagtggtggtgcagaatgagagaagagaagaatggacttcacttctcgtaaccattaaaaaactcttcatccagtatccagtgttggtgcgactggaacaggcagagggctttcctcaaggagataattctacctcagcacaaggaaactacctggaggccatcaatctgtcattcaatgtgtttgataagcactacatcaaccgcaactttgaccgaactgggcagatgtcagtggtgatcacgcccggggtgggtgtctttgaagtggaccgcctactcatgatcctgaccaagcagcggatgatagataatggaattggtgtggatttggtgtgcatgggagagcaaccgttacatgctgtcccattgttcaagctccataatcggagtgctccccgtgattctcgtctgggcgatgactataatatccctcactggataaaccacagtttctacacatccaaaagccagctcttttgtaatagtttcaccccacgaataaaactggcaggaaagaagcccgcctctgagaaagcaaaaaatggccgtgatacatctctcgggagtccaaaagaatctgagaacgcccttcccatccaagtagattatgacgcctatgacgctcaagtgttcaggctgcccggcccatcccgggcccagtgcctcaccacctgcagatctgtgcgagagcgagagagtcacagtcgaaagagtgccagctcctgtgatgtttcatccagcccttccctaccaagccgcacactgcccactgaggaagtgaggagccaggcttctgacgacagctccctaggcaagagtgccaacatcctgatgatcccacacccccacctgcaccagtatgaagtcagcagctccttgggatacaccagcactcgagatgtcctggagaacatgatggagccaccacagcgagactccagtgcaccagggaggtttcacgttggcagtgcagaatccatgctgcatgttcgacctggtggatacacgccccagagagcactgattaaccccttcgctccctctcggatgcccatgaagcttacgtccaacagaaggcgctggatgcacacttttcctgtggggccatccggagaagccatccagatccaccaccagacccgacagaatatggcggagctacaaggcagcgggcagagggatccaactcactcctctgcagagctgctggagttagcatatcatgaagctgctggaaggcacagcaattcccgccagcctggtgacggcatgtccttcttgaacttcagtggaacagaggagctttctgtcggcctgcttagcaacagtggtgcaggtatgaatcctaggacccagaataaggattctctagaggacagtgtttctacctctccagacccaattctgacactgtctgctccccctgtagtgccaggcttctgttgcacagttggagtggactggaagtctctcactactccggcgtgcctcccccttaccaccgactacttccctgaccgccagggcctgcagaatgactacacagagggctgttatgatctccttccagaagcagacatcgacaggagggacgaagatggtgtgcagatgacagcccagcaggtatttgaagagtttatttgccaacgtctcatgcagggctaccaaatcatagtgcagcccaagacacagaaacccaatcctgctgtcccgcccccgctgagcagtagcccactctatagccgaggccttgtgtcccgaaaccgccctgaggaggaggaccagtattggctgagtatgggcagaacgttccacaaagtgacgctgaaggataagatgatcacagtgacgcgataccttcccaagtatccttatgaatctgcccagatccactacacctacagcctctgtccttcccactcagactcagagttcgtctcctgctgggtggaattctcccacgaacggctggaggagtacaagtggaattacttagatcagtatatctgttctgccggctctgaagacttcagcttaattgagtccctgaagttctggaggacccgcttcctgctgctgccagcctgtgtcaccgccaccaagcgcatcacggagggggaggcccactgcgacatctatggggacaggccccgtgcagacgaggacgagtggcaactcctggatggttttgtccgctttgtggagggcttgaatcgcattcgcaggcggcatcgctcggatcgcatgatgcggaaagggaccgccatgaaaggcttgcagatgactgggcccatttccacgcattctctggagtcaactgcacccccagtggggaagaagggaacctcagctctctctgccctgttggagatggaggccagtcagaagtgcctgggagaacagcaggcagctgtgcatggtgggaagagctccgcccagtcagccgagagcagcagcgttgccatgactcccacctacatggacagcccacgaaaggtatctgtggaccaaacagccactcctatgttggacggcaccagtttgggcatatgcacaggccaatccatggacagaggcaacagccagacctttgggaactcccagaacataggagaacagggctactcctccacaaactccagtgacagcagctctcagcagctggtggcaagctccttgacctcatcctctaccctgacagagatcctggaagccatgaagcacccctcgacaggagtccagctgctctctgaacagaagggcctctcaccgtactgcttcatcagcgcggaggtggtacactggttggtgaaccacgtggaggggatccagacacaggcgatggccattgacatcatgcagaaaatgctggaagagcagctcatcacacatgcatctggcgaagcctggcggaccttcatctacggcttctatttctacaagatagtaacggacaaagagcccgaccgagtggccatgcagcagcccgccaccacctggcacacagcaggagtggacgacttcgccagcttccagcgcaagtggtttgaggtggcctttgtggcagaagagctcgtgcactctgagattcctgcctttctcctgccctggctgcctagccggccagcctcctatgcaagtaggcacagctcctttagccgaagttttggaggacggagccaggcggcagcacttttagctgccactgtcccagagcagaggactgtgaccctggatgttgacgtgaacaaccgcacagaccggctggagtggtgcagctgttattaccatggcaacttttctctgaatgcagcctttgagatcaagctgcactggatggcggtgaccgcagcagtactcttcgagatggtccaaggttggcatcggaaagccacctcctgtggcttcttgttagtcccagttttggaggggccttttgcactgcccagttacctgtatggcgacccccttcgtgcccagctcttcatcccactcaacatcagctgcttgctcaaggagggcagcgagcacctgtttgatagctttgaacccgaaacgtactgggatcgaatgcacctcttccaggaagccattgcacacaggtttgggtttgtacaagataaatattctgcctctgcttttaacttccctgctgagaacaagcctcagtatatccacgttacaggaacagtgtttctgcagctgccctactccaagcgcaagttctcagggcagcagcggcggcggcggaactccaccagctccaccaaccagaacatgttctgcgaggagcgggtcggctacaactgggcctacaacaccatgctcaccaaaacatggcgctccagcgccacaggggatgaaaagtttgctgatcggctgctgaaggacttcacggacttctgcatcaaccgtgacaaccggctggtcacgttctggacaagttgcctggagaagatgcatgccagtgccccgtgaggccaggctgcacctgtgctgggggaaggtgggtgagccactgccctcaaacccggggcggaggattccaggcaggctctaggagtcaggtgtccgtttgctgctatcagtgagtgggggccattgttttttgtttgtttgtttgtttgtttgtttgtttttggcccccacgacaagtcttctactctagaagaaagactttggaagcagctgctgctgctgccaccactcctgtcagcaagtgctcagagcaggtgggaggcacagattgtccgtgggagggctccagtgtctgggaagagggcaggcggcccccatgaatgtcctcggaagggggtggctcctggtagcatccttttccttcaccatctatgggatattaggggcagaatctgccacttcttgcccaggagtgtgcacagatgtaagataattttgtgaaataatgtaccatagactctcaccaactgtatatacctgtacatatcagaagcaaataaagagctccacgtgcatc

SEQ ID NO: 8184 - DNA, 5128 bp, Homo sapiens
atctggaggaggcgcagggaacctggagagggtccagccctcagtgccccggccagaggcgggaaggggctctagagcttcgggaggcaagatgacttctctgccccaagcttggaacagctaaagggaaaaacagtgcaagatgagaacaacaaaggtctacaaactcgtcatccacaagaagggctttgggggcagtgatgatgagctagttgtgaaccccaaagtgttccctcacatcaagcttggagacattgtagagattgcacaccccaacgatgaatacagccctctgcttttgcaggtcaagtctcttaaggaagatttacagaaggaaactatcagtgtggaccagactgtgactcaagtgttccggctgagaccttatcaggatgtctatgttaatgtcgtagaccctaaggatgtgacccttgacctagtggaattaacttttaaggatcagtatattggccgtggggatatgtggcgactaaagaaaagtttggtcagcacatgtgcctatatcacccagaaggtggagtttgctggcatcagagcacaggctggtgaactgtgggttaagaatgagaaggtcatgtgtggctacatcagtgaagataccagggtggtgtttcgttctacgtcggctatggtttacatatttattcagatgagctgtgaaatgtgggattttgatatttatggggatttgtattttgagaaagctgtgaatggtttccttgctgatctatttaccaagtggaaggagaagaactgtagtcatgaagtgacagtggtcctgttttctagaactttctatgatgcaaaatctgttgatgaatttcctgaaataaaccgagcctcaattcgacaggatcacaaggggagattctatgaagacttttacaaagtggtggtgcagaatgagagaagagaagaatggacttcacttctcgtaaccattaaaaaactcttcatccagtatccagtgttggtgcgactggaacaggcagagggctttcctcaaggagataattctacctcagcacaaggaaactacctggaggccatcaatctgtcattcaatgtgtttgataagcactacatcaaccgcaactttgaccgaactgggcagatgtcagtggtgatcacgcccggggtgggtgtctttgaagtggaccgcctactcatgatcctgaccaagcagcggatgatagataatggaattggtgtggatttggtgtgcatgggagagcaaccgttacatgctgtcccattgttcaagctccataatcggagtgctccccgtgattctcgtctgggcgatgactataatatccctcactggataaaccacagtttctacacatccaaaagccagctcttttgtaatagtttcaccccacgaataaaactggcaggaaagaagcccgcctctgagaaagcaaaaaatggccgtgatacatctctcgggagtccaaaagaatctgagaacgcccttcccatccaagtagattatgacgcctatgacgctcaagtgttcaggctgcccggcccatcccgggcccagtgcctcaccacctgcagatctgtgcgagagcgagagagtcacagtcgaaagagtgccagctcctgtgatgtttcatccagcccttccctaccaagccgcacactgcccactgaggaagtgaggagccaggcttctgacgacagctccctaggcaagagtgccaacatcctgatgatcccacacccccacctgcaccagtatgaagtcagcagctccttgggatacaccagcactcgagatgtcctggagaacatgatggagccaccacagcgagactccagtgcaccagggaggtttcacgttggcagtgcagaatccatgctgcatgttcgacctggtggatacacgccccagagagcactgattaaccccttcgctccctctcggatgcccatgaagcttacgtccaacagaaggcgctggatgcacacttttcctgtgggtatgaatcctaggacccagaataaggattctctagaggacagtgtttctacctctccagacccaattctgacactgtctgctccccctgtagtgccaggcttctgttgcacagttggagtggactggaagtctctcactactccggcgtgcctcccccttaccaccgactacttccctgaccgccagggcctgcagaatgactacacagagggctgttatgatctccttccagaagcagacatcgacaggagggacgaagatggtgtgcagatgacagcccagcaggtatttgaagagtttatttgccaacgtctcatgcagggctaccaaatcatagtgcagcccaagacacagaaacccaatcctgctgtcccgcccccgctgagcagtagcccactctatagccgaggccttgtgtcccgaaaccgccctgaggaggaggaccagtattggctgagtatgggcagaacgttccacaaagtgacgctgaaggataagatgatcacagtgacgcgataccttcccaagtatccttatgaatctgcccagatccactacacctacagcctctgtccttcccactcagactcagagttcgtctcctgctgggtggaattctcccacgaacggctggaggagtacaagtggaattacttagatcagtatatctgttctgccggctctgaagacttcagcttaattgagtccctgaagttctggaggacccgcttcctgctgctgccagcctgtgtcaccgccaccaagcgcatcacggagggggaggcccactgcgacatctatggggacaggccccgtgcagacgaggacgagtggcaactcctggatggttttgtccgctttgtggagggcttgaatcgcattcgcaggcggcatcgctcggatcgcatgatgcggaaagggaccgccatgaaaggcttgcagatgactgggcccatttccacgcattctctggagtcaactgcacccccagtggggaagaagggaacctcagctctctctgccctgttggagatggaggccagtcagaagtgcctgggagaacagcaggcagctgtgcatggtgggaagagctccgcccagtcagccgagagcagcagcgttgccatgactcccacctacatggacagcccacgaaaggacggggccttctttatggagtttgtccgcagcccacgcacagcatcgtccgccttctaccctcaggtatctgtggaccaaacagccactcctatgttggacggcaccagtttgggcatatgcacaggccaatccatggacagaggcaacagccagacctttgggaactcccagaacataggagaacagggctactcctccacaaactccagtgacagcagctctcagcagctggtggcaagctccttgacctcatcctctaccctgacagagatcctggaagccatgaagcacccctcgacaggagtccagctgctctctgaacagaagggcctctcaccgtactgcttcatcagcgcggaggtggtacactggttggtgaaccacgtggaggggatccagacacaggcgatggccattgacatcatgcagtggccatgcagcagcccgccaccacctggcacacagcaggagtggacgacttcgccagcttccagcgcaagtggtttgaggtggcctttgtggcagaagagctcgtgcactctgagattcctgcctttctcctgccctggctgcctagccggccagcctcctatgcaagtaggcacagctcctttagccgaagttttggaggacggagccaggcggcagcacttttagctgccactgtcccagagcagaggactgtgaccctggatgttgacgtgaacaaccgcacagaccggctggagtggtgcagctgttattaccatggcaacttttctctgaatgcagcctttgagatcaagctgcactggatggcggtgaccgcagcagtactcttcgagatggtccaaggttggcatcggaaagccacctcctgtggcttcttgttagtcccagttttggaggggccttttgcactgcccagttacctgtatggcgacccccttcgtgcccagctcttcatcccactcaacatcagctgcttgctcaaggagggcagcgagcacctgtttgatagctttgaacccgaaacgtactgggatcgaatgcacctcttccaggaagccattgcacacaggtttgggtttgtacaagataaatattctgcctctgcttttaacttccctgctgagaacaagcctcagtatatccacgttacaggaacagtgtttctgcagctgccctactccaagcgcaagttctcagggcagcagcggcggcggcggaactccaccagctccaccaaccagaacatgttctgcgaggagcgggtcggctacaactgggcctacaacaccatgctcaccaaaacatggcgctccagcgccacaggggatgaaaagtttgctgatcggctgctgaaggacttcacggacttctgcatcaaccgtgacaaccggctggtcacgttctggacaagttgcctggagaagatgcatgccagtgccccgtgaggccaggctgcacctgtgctgggggaaggtgggtgagccactgccctcaaacccggggcggaggattccaggcaggctctaggagtcaggtgtccgtttgctgctatcagtgagtgggggccattgttttttgtttgtttgtttgtttgtttgtttgtttttggcccccacgacaagtcttctactctagaagaaagactttggaagcagctgctgctgctgccaccactcctgtcagcaagtgctcagagcaggtgggaggcacagattgtccgtgggagggctccagtgtctgggaagagggcaggcggcccccatgaatgtcctcggaagggggtggctcctggtagcatccttttccttcaccatctatgggatattaggggcagaatctgccacttcttgcccaggagtgtgcacagatgtaagataattttgtgaaataatgtaccatagactctcaccaactgtatatacctgtacatatcagaagcaaataaagagctccacgtgcatc

SEQ ID NO: 8185 - DNA, 5171 bp, Homo sapiens
atctggaggaggcgcagggaacctggagagggtccagccctcagtgccccggccagaggcgggaaggggctctagagcttcgggaggcaagatgacttctctgccccaagcttggaacagctaaagggaaaaacagtgcaagatgagaacaacaaaggtctacaaactcgtcatccacaagaagggctttgggggcagtgatgatgagctagttgtgaaccccaaagtgttccctcacatcaagcttggagacattgtagagattgcacaccccaacgatgaatacagccctctgcttttgcaggtcaagtctcttaaggaagatttacagaaggaaactatcagtgtggaccagactgtgactcaagtgttccggctgagaccttatcaggatgtctatgttaatgtcgtagaccctaaggatgtgacccttgacctagtggaattaacttttaaggatcagtatattggccgtggggatatgtggcgactaaagaaaagtttggtcagcacatgtgcctatatcacccagaaggtggagtttgctggcatcagagcacaggctggtgaactgtgggttaagaatgagaaggtcatgtgtggctacatcagtgaagataccagggtggtgtttcgttctacgtcggctatggtttacatatttattcagatgagctgtgaaatgtgggattttgatatttatggggatttgtattttgagaaagctgtgaatggtttccttgctgatctatttaccaagtggaaggagaagaactgtagtcatgaagtgacagtggtcctgttttctagaactttctatgatgcaaaatctgttgatgaatttcctgaaataaaccgagcctcaattcgacaggatcacaaggggagattctatgaagacttttacaaagtggtggtgcagaatgagagaagagaagaatggacttcacttctcgtaaccattaaaaaactcttcatccagtatccagtgttggtgcgactggaacaggcagagggctttcctcaaggagataattctacctcagcacaaggaaactacctggaggccatcaatctgtcattcaatgtgtttgataagcactacatcaaccgcaactttgaccgaactgggcagatgtcagtggtgatcacgcccggggtgggtgtctttgaagtggaccgcctactcatgatcctgaccaagcagcggatgatagataatggaattggtgtggatttggtgtgcatgggagagcaaccgttacatgctgtcccattgttcaagctccataatcggagtgctccccgtgattctcgtctgggcgatgactataatatccctcactggataaaccacagtttctacacatccaaaagccagctcttttgtaatagtttcaccccacgaataaaactggcaggaaagaagcccgcctctgagaaagcaaaaaatggccgtgatacatctctcgggagtccaaaagaatctgagaacgcccttcccatccaagtagattatgacgcctatgacgctcaagtgttcaggctgcccggcccatcccgggcccagtgcctcaccacctgcagatctgtgcgagagcgagagagtcacagtcgaaagagtgccagctcctgtgatgtttcatccagcccttccctaccaagccgcacactgcccactgaggaagtgaggagccaggcttctgacgacagctccctaggcaagagtgccaacatcctgatgatcccacacccccacctgcaccagtatgaagtcagcagctccttgggatacaccagcactcgagatgtcctggagaacatgatggagccaccacagcgagactccagtgcaccagggaggtttcacgttggcagtgcagaatccatgctgcatgttcgacctggtggatacacgccccagagagcactgattaaccccttcgctccctctcggatgcccatgaagcttacgtccaacagaaggcgctggatgcacacttttcctgtggagacaagctgtttttatctttccataggtatgaatcctaggacccagaataaggattctctagaggacagtgtttctacctctccagacccaatgccaggcttctgttgcacagttggagtggactggaagtctctcactactccggcgtgcctcccccttaccaccgactacttccctgaccgccagggcctgcagaatgactacacagagggctgttatgatctccttccagaagcagacatcgacaggagggacgaagatggtgtgcagatgacagcccagcaggtatttgaagagtttatttgccaacgtctcatgcagggctaccaaatcatagtgcagcccaagacacagaaacccaatcctgctgtcccgcccccgctgagcagtagcccactctatagccgaggccttgtgtcccgaaaccgccctgaggaggaggaccagtattggctgagtatgggcagaacgttccacaaagtgacgctgaaggataagatgatcacagtgacgcgataccttcccaagtatccttatgaatctgcccagatccactacacctacagcctctgtccttcccactcagactcagagttcgtctcctgctgggtggaattctcccacgaacggctggaggagtacaagtggaattacttagatcagtatatctgttctgccggctctgaagacttcagcttaattgagtccctgaagttctggaggacccgcttcctgctgctgccagcctgtgtcaccgccaccaagcgcatcacggagggggaggcccactgcgacatctatggggacaggccccgtgcagacgaggacgagtggcaactcctggatggttttgtccgctttgtggagggcttgaatcgcattcgcaggcggcatcgctcggatcgcatgatgcggaaagggaccgccatgaaaggcttgcagatgactgggcccatttccacgcattctctggagtcaactgcacccccagtggggaagaagggaacctcagctctctctgccctgttggagatggaggccagtcagaagtgcctgggagaacagcaggcagctgtgcatggtgggaagagctccgcccagtcagccgagagcagcagcgttgccatgactcccacctacatggacagcccacgaaaggtatctgtggaccaaacagccactcctatgttggacggcaccagtttgggcatatgcacaggccaatccatggacagaggcaacagccagacctttgggaactcccagaacataggagaacagggctactcctccacaaactccagtgacagcagctctcagcagctggtggcaagctccttgacctcatcctctaccctgacagagatcctggaagccatgaagcacccctcgacaggagtccagctgctctctgaacagaagggcctctcaccgtactgcttcatcagcgcggaggtggtacactggttggtgaaccacgtggaggggatccagacacaggcgatggccattgacatcatgcagaaaatgctggaagagcagctcatcacacatgcatctggcgaagcctggcggaccttcatctacggcttctatttctacaagatagtaacggacaaagagcccgaccgagtggccatgcagcagcccgccaccacctggcacacagcaggagtggacgacttcgccagcttccagcgcaagtggtttgaggtggcctttgtggcagaagagctcgtgcactctgagattcctgcctttctcctgccctggctgcctagccggccagcctcctatgcaagtaggcacagctcctttagccgaagttttggaggacggagccaggcggcagcacttttagctgccactgtcccagagcagaggactgtgaccctggatgttgacgtgaacaaccgcacagaccggctggagtggtgcagctgttattaccatggcaacttttctctgaatgcagcctttgagatcaagctgcactggatggcggtgaccgcagcagtactcttcgagatggtccaaggttggcatcggaaagccacctcctgtggcttcttgttagtcccagttttggaggggccttttgcactgcccagttacctgtatggcgacccccttcgtgcccagctcttcatcccactcaacatcagctgcttgctcaaggagggcagcgagcacctgtttgatagctttgaacccgaaacgtactgggatcgaatgcacctcttccaggaagccattgcacacaggtttgggtttgtacaagataaatattctgcctctgcttttaacttccctgctgagaacaagcctcagtatatccacgttacaggaacagtgtttctgcagctgccctactccaagcgcaagttctcagggcagcagcggcggcggcggaactccaccagctccaccaaccagaacatgttctgcgaggagcgggtcggctacaactgggcctacaacaccatgctcaccaaaacatggcgctccagcgccacaggggatgaaaagtttgctgatcggctgctgaaggacttcacggacttctgcatcaaccgtgacaaccggctggtcacgttctggacaagttgcctggagaagatgcatgccagtgccccgtgaggccaggctgcacctgtgctgggggaaggtgggtgagccactgccctcaaacccggggcggaggattccaggcaggctctaggagtcaggtgtccgtttgctgctatcagtgagtgggggccattgttttttgtttgtttgtttgtttgtttgtttgtttttggcccccacgacaagtcttctactctagaagaaagactttggaagcagctgctgctgctgccaccactcctgtcagcaagtgctcagagcaggtgggaggcacagattgtccgtgggagggctccagtgtctgggaagagggcaggcggcccccatgaatgtcctcggaagggggtggctcctggtagcatccttttccttcaccatctatgggatattaggggcagaatctgccacttcttgcccaggagtgtgcacagatgtaagataattttgtgaaataatgtaccatagactctcaccaactgtatatacctgtacatatcagaagcaaataaagagctccacgtgcatc

SEQ ID NO: 8186 - DNA, 2395 bp, Homo sapiens
ggcgtaggcggggtatctggaggaggcgcagggaacctggagagggtccagccctcagtgccccggccagaggcgggaaggggctctagagcttcgggaggcaagatgacttctctgccccaagcttggaacagctaaagggaaaaacagtgcaagatgagaacaacaaaggtctacaaactcgtcatccacaagaagggctttgggggcagtgatgatgagctagttgtgaaccccaaagtgttccctcacatcaagcttggagacattgtagagattgcacaccccaacgatgaatacagccctctgcttttgcaggtcaagtctcttaaggaagatttacagaaggaaactatcagtgtggaccagactgtgactcaagtgttccggctgagaccttatcaggatgtctatgttaatgtcgtagaccctaaggatgtgacccttgacctagtggaattaacttttaaggatcagtatattggccgtggggatatgtggcgactaaagaaaagtttggtcagcacatgtgcctatatcacccagaaggtggagtttgctggcatcagagcacaggctggtgaactgtgggttaagaatgagaaggtcatgtgtggctacatcagtgaagataccagggtggtgtttcgttctacgtcggctatggtttacatatttattcagatgagctgtgaaatgtgggattttgatatttatggggatttgtattttgagaaagctgtgaatggtttccttgctgatctatttaccaagtggaaggagaagaactgtagtcatgaagtgacagtggtcctgttttctagaactttctatgatgcaaaatctgttgatgaatttcctgaaataaaccgagcctcaattcgacaggatcacaaggggagattctatgaagacttttacaaagtggtggtgcagaatgagagaagagaagaatggacttcacttctcgtaaccattaaaaaactcttcatccagtatccagtgttggtgcgactggaacaggcagagggctttcctcaaggagataattctacctcagcacaaggaaactacctggaggccatcaatctgtcattcaatgtgtttgataagcactacatcaaccgcaactttgaccgaactgggcagatgtcagtggtgatcacgcccggggtgggtgtctttgaagtggaccgcctactcatgatcctgaccaagcagcggatgatagataatggaattggtgtggatttggtgtgcatgggagagcaaccgttacatgctgtcccattgttcaagctccataatcggagtgctccccgtgattctcgtctgggcgatgactataatatccctcactggataaaccacagtttctacacatccaaaagccagctcttttgtaatagtttcaccccacgaataaaactggcaggaaagaagcccgcctctgagaaagcaaaaaatggccgtgatacatctctcgggagtccaaaagaatctgagaacgcccttcccatccaagtagattatgacgcctatgacgctcaagtgttcaggctgcccggcccatcccgggcccagtgcctcaccacctgcagatctgtgcgagagcgagagagtcacagtcgaaagagtgccagctcctgtgatgtttcatccagcccttccctaccaagccgcacactgcccactgaggaagtgaggagccaggcttctgacgacagctccctaggcaagagtgccaacatcctgatgatcccacacccccacctgcaccagtatgaagtcagcagctccttgggatacaccagcactcgagagcacctaggataaagtgcagtgatgcaatcacagctcacctcagtgcggccttgaactcctggactcaatcgatcctcccacctctgcctcccaagtaactgggactatagcatgccaccacacccagctgattatcatatttttttttgtagaggtggggaagtgcagtgatgcaatcacagctcacctcagtgcggccttgaactcctggactcaattgatcctcccacttctgcctcccaagtaactgggactatagcatgccaccacacccagctgattatcatatttttttttgtagaggtggggttttaccattcccaggctggtcttgaactcctggactcgagggatccacccattggcctccaaaagtgctgagattacaggcatgaaccaatgttaccgcaccctgcctctattatactattttttgtttagcctttcttcatccatcatttaactgtatgcctttccatatgttaatggaaagcttttcttaggcctagggtcaaaagggtttatttccttatgatttccatttgtgccatatataaaacaacctctgtct

SEQ ID NO: 8187 - DNA, 5410 bp, Homo sapiens
atctggaggaggcgcagggaacctggagagggtccagccctcagtgccccggccagaggcgggaaggggctctagagcttcgggaggcaagatgacttctctgccccaagcttggaacagctaaagggaaaaacagtgcaagatgagaacaacaaaggtctacaaactcgtcatccacaagaagggctttgggggcagtgatgatgagctagttgtgaaccccaaagtgttccctcacatcaagcttggagacattgtagagattgcacaccccaacgatgaatacagccctctgcttttgcaggtcaagtctcttaaggaagatttacagaaggaaactatcagtgtggaccagactgtgactcaagtgttccggctgagaccttatcaggatgtctatgttaatgtcgtagaccctaaggatgtgacccttgacctagtggaattaacttttaaggatcagtatattggccgtggggatatgtggcgactaaagaaaagtttggtcagcacatgtgcctatatcacccagaaggtggagtttgctggcatcagagcacaggctggtgaactgtgggttaagaatgagaaggtcatgtgtggctacatcagtgaagataccagggtggtgtttcgttctacgtcggctatggtttacatatttattcagatgagctgtgaaatgtgggattttgatatttatggggatttgtattttgagaaagctgtgaatggtttccttgctgatctatttaccaagtggaaggagaagaactgtagtcatgaagtgacagtggtcctgttttctagaactttctatgatgcaaaatctgttgatgaatttcctgaaataaaccgagcctcaattcgacaggatcacaaggggagattctatgaagacttttacaaagtggtggtgcagaatgagagaagagaagaatggacttcacttctcgtaaccattaaaaaactcttcatccagtatccagtgttggtgcgactggaacaggcagagggctttcctcaaggagataattctacctcagcacaaggaaactacctggaggccatcaatctgtcattcaatgtgtttgataagcactacatcaaccgcaactttgaccgaactgggcagatgtcagtggtgatcacgcccggggtgggtgtctttgaagtggaccgcctactcatgatcctgaccaagcagcggatgatagataatggaattggtgtggatttggtgtgcatgggagagcaaccgttacatgctgtcccattgttcaagctccataatcggagtgctccccgtgattctcgtctgggcgatgactataatatccctcactggataaaccacagtttctacacatccaaaagccagctcttttgtaatagtttcaccccacgaataaaactggcaggaaagaagcccgcctctgagaaagcaaaaaatggccgtgatacatctctcgggagtccaaaagaatctgagaacgcccttcccatccaagtagattatgacgcctatgacgctcaagtgttcaggctgcccggcccatcccgggcccagtgcctcaccacctgcagatctgtgcgagagcgagagagtcacagtcgaaagagtgccagctcctgtgatgtttcatccagcccttccctaccaagccgcacactgcccactgaggaagtgaggagccaggcttctgacgacagctccctaggcaagagtgccaacatcctgatgatcccacacccccacctgcaccagtatgaagtcagcagctccttgggatacaccagcactcgagatgtcctggagaacatgatggagccaccacagcgagactccagtgcaccagggaggtttcacgttggcagtgcagaatccatgctgcatgttcgacctggtggatacacgccccagagagcactgattaaccccttcgctccctctcggatgcccatgaagcttacgtccaacagaaggcgctggatgcacacttttcctgtggggccatccggagaagccatccagatccaccaccagacccgacagaatatggcggagctacaaggcagcgggcagagggatccaactcactcctctgcagagctgctggagttagcatatcatgaagctgctggaaggcacagcaattcccgccagcctggtgacggcatgtccttcttgaacttcagtggaacagaggagctttctgtcggcctgcttagcaacagtggtgcaggtatgaatcctaggacccagaataaggattctctagaggacagtgtttctacctctccagacccaattctgacactgtctgctccccctgtagtgccaggcttctgttgcacagttggagtggactggaagtctctcactactccggcgtgcctcccccttaccaccgactacttccctgaccgccagggcctgcagaatgactacacagagggctgttatgatctccttccagaagcagacatcgacaggagggacgaagatggtgtgcagatgacagcccagcaggtatttgaagagtttatttgccaacgtctcatgcagggctaccaaatcatagtgcagcccaagacacagaaacccaatcctgctgtcccgcccccgctgagcagtagcccactctatagccgaggccttgtgtcccgaaaccgccctgaggaggaggaccagtattggctgagtatgggcagaacgttccacaaagtgacgctgaaggataagatgatcacagtgacgcgataccttcccaagtatccttatgaatctgcccagatccactacacctacagcctctgtccttcccactcagactcagagttcgtctcctgctgggtggaattctcccacgaacggctggaggagtacaagtggaattacttagatcagtatatctgttctgccggctctgaagacttcagcttaattgagtccctgaagttctggaggacccgcttcctgctgctgccagcctgtgtcaccgccaccaagcgcatcacggagggggaggcccactgcgacatctatggggacaggccccgtgcagacgaggacgagtggcaactcctggatggttttgtccgctttgtggagggcttgaatcgcattcgcaggcggcatcgctcggatcgcatgatgcggaaagggaccgccatgaaaggcttgcagatgactgggcccatttccacgcattctctggagtcaactgcacccccagtggggaagaagggaacctcagctctctctgccctgttggagatggaggccagtcagaagtgcctgggagaacagcaggcagctgtgcatggtgggaagagctccgcccagtcagccgagagcagcagcgttgccatgactcccacctacatggacagcccacgaaaggacggggccttctttatggagtttgtccgcagcccacgcacagcatcgtccgccttctaccctcaggtatctgtggaccaaacagccactcctatgttggacggcaccagtttgggcatatgcacaggccaatccatggacagaggcaacagccagacctttgggaactcccagaacataggagaacagggctactcctccacaaactccagtgacagcagctctcagcagctggtggcaagctccttgacctcatcctctaccctgacagagatcctggaagccatgaagcacccctcgacaggagtccagctgctctctgaacagaagggcctctcaccgtactgcttcatcagcgcggaggtggtacactggttggtgaaccacgtggaggggatccagacacaggcgatggccattgacatcatgcagaaaatgctggaagagcagctcatcacacatgcatctggcgaagcctggcggaccttcatctacggcttctatttctacaagatagtaacggacaaagagcccgaccgagtggccatgcagcagcccgccaccacctggcacacagcaggagtggacgacttcgccagcttccagcgcaagtggtttgaggtggcctttgtggcagaagagctcgtgcactctgagattcctgcctttctcctgccctggctgcctagccggccagcctcctatgcaagtaggcacagctcctttagccgaagttttggaggacggagccaggcggcagcacttttagctgccactgtcccagagcagaggactgtgaccctggatgttgacgtgaacaaccgcacagaccggctggagtggtgcagctgttattaccatggcaacttttctctgaatgcagcctttgagatcaagctgcactggatggcggtgaccgcagcagtactcttcgagatggtccaaggttggcatcggaaagccacctcctgtggcttcttgttagtcccagttttggaggggccttttgcactgcccagttacctgtatggcgacccccttcgtgcccagctcttcatcccactcaacatcagctgcttgctcaaggagggcagcgagcacctgtttgatagtttgggtttgtacaagataaatattctgcctctgcttttaacttccctgctgagaacaagcctcagtatatccacgttacaggaacagtgtttctgcagctgccctactccaagcgcaagttctcagggcagcagcggcggcggcggaactccaccagctccaccaaccagaacatgttctgcgaggagcgggtcggctacaactgggcctacaacaccatgctcaccaaaacatggcgctccagcgccacaggggatgaaaagtttgctgatcggctgctgaaggacttcacggacttctgcatcaaccgtgacaaccggctggtcacgttctggacaagttgcctggagaagatgcatgccagtgccccgtgaggccaggctgcacctgtgctgggggaaggtgggtgagccactgccctcaaacccggggcggaggattccaggcaggctctaggagtcaggtgtccgtttgctgctatcagtgagtgggggccattgttttttgtttgtttgtttgtttgtttgtttgtttttggcccccacgacaagtcttctactctagaagaaagactttggaagcagctgctgctgctgccaccactcctgtcagcaagtgctcagagcaggtgggaggcacagattgtccgtgggagggctccagtgtctgggaagagggcaggcggcccccatgaatgtcctcggaagggggtggctcctggtagcatccttttccttcaccatctatgggatattaggggcagaatctgccacttcttgcccaggagtgtgcacagatgtaagataattttgtgaaataatgtaccatagactctcaccaactgtatatacctgtacatatcagaagcaaataaagagctccacgtgcatc

SEQ ID NO: 8188 - DNA, 5296 bp, Homo sapiens
gaggcaagatgacttctctgccccaagcttggaacagctaaagggaaaaacagtgcaagatgagaacaacaaaggtctacaaactcgtcatccacaagaagggctttgggggcagtgatgatgagctagttgtgaaccccaaagtgttccctcacatcaagcttggagacattgtagagattgcacaccccaacgatgaatacagccctctgcttttgcaggtcaagtctcttaaggaagatttacagaaggaaactatcagtgtggaccagactgtgactcaagtgttccggctgagaccttatcaggatgtctatgttaatgtcgtagaccctaaggatgtgacccttgacctagtggaattaacttttaaggatcagtatattggccgtggggatatgtggcgactaaagaaaagtttggtcagcacatgtgcctatatcacccagaaggtggagtttgctggcatcagagcacaggctggtgaactgtgggttaagaatgagaaggtcatgtgtggctacatcagtgaagataccagggtggtgtttcgttctacgtcggctatggtttacatatttattcagatgagctgtgaaatgtgggattttgatatttatggggatttgtattttgagaaagctgtgaatggtttccttgctgatctatttaccaagtggaaggagaagaactgtagtcatgaagtgacagtggtcctgttttctagaactttctatgatgcaaaatctgttgatgaatttcctgaaataaaccgagcctcaattcgacaggatcacaaggggagattctatgaagacttttacaaagtggtggtgcagaatgagagaagagaagaatggacttcacttctcgtaaccattaaaaaactcttcatccagtatccagtgttggtgcgactggaacaggcagagggctttcctcaaggagataattctacctcagcacaaggaaactacctggaggccatcaatctgtcattcaatgtgtttgataagcactacatcaaccgcaactttgaccgaactgggcagatgtcagtggtgatcacgcccggggtgggtgtctttgaagtggaccgcctactcatgatcctgaccaagcagcggatgatagataatggaattggtgtggatttggtgtgcatgggagagcaaccgttacatgctgtcccattgttcaagctccataatcggagtgctccccgtgattctcgtctgggcgatgactataatatccctcactggataaaccacagtttctacacatccaaaagccagctcttttgtaatagtttcaccccacgaataaaactggcaggaaagaagcccgcctctgagaaagcaaaaaatggccgtgatacatctctcgggagtccaaaagaatctgagaacgcccttcccatccaagtagattatgacgcctatgacgctcaagtgttcaggctgcccggcccatcccgggcccagtgcctcaccacctgcagatctgtgcgagagcgagagagtcacagtcgaaagagtgccagctcctgtgatgtttcatccagcccttccctaccaagccgcacactgcccactgaggaagtgaggagccaggcttctgacgacagctccctaggcaagagtgccaacatcctgatgatcccacacccccacctgcaccagtatgaagtcagcagctccttgggatacaccagcactcgagatgtcctggagaacatgatggagccaccacagcgagactccagtgcaccagggaggtttcacgttggcagtgcagaatccatgctgcatgttcgacctggtggatacacgccccagagagcactgattaaccccttcgctccctctcggatgcccatgaagcttacgtccaacagaaggcgctggatgcacacttttcctgtggggccatccggagaagccatccagatccaccaccagacccgacagaatatggcggagctacaaggcagcgggcagagggatccaactcactcctctgcagagctgctggagttagcatatcatgaagctgctggaaggcacagcaattcccgccagcctggtgacggcatgtccttcttgaacttcagtggaacagaggagctttctgtcggcctgcttagcaacagtggtgcaggtatgaatcctaggacccagaataaggattctctagaggacagtgtttctacctctccagacccaatgccaggcttctgttgcacagttggagtggactggaagtctctcactactccggcgtgcctcccccttaccaccgactacttccctgaccgccagggcctgcagaatgactacacagagggctgttatgatctccttccagaagcagacatcgacaggagggacgaagatggtgtgcagatgacagcccagcaggtatttgaagagtttatttgccaacgtctcatgcagggctaccaaatcatagtgcagcccaagacacagaaacccaatcctgctgtcccgcccccgctgagcagtagcccactctatagccgaggccttgtgtcccgaaaccgccctgaggaggaggaccagtattggctgagtatgggcagaacgttccacaaagtgacgctgaaggataagatgatcacagtgacgcgataccttcccaagtatccttatgaatctgcccagatccactacacctacagcctctgtccttcccactcagactcagagttcgtctcctgctgggtggaattctcccacgaacggctggaggagtacaagtggaattacttagatcagtatatctgttctgccggctctgaagacttcagcttaattgagtccctgaagttctggaggacccgcttcctgctgctgccagcctgtgtcaccgccaccaagcgcatcacggagggggaggcccactgcgacatctatggggacaggccccgtgcagacgaggacgagtggcaactcctggatggttttgtccgctttgtggagggcttgaatcgcattcgcaggcggcatcgctcggatcgcatgatgcggaaagggaccgccatgaaaggcttgcagatgactgggcccatttccacgcattctctggagtcaactgcacccccagtggggaagaagggaacctcagctctctctgccctgttggagatggaggccagtcagaagtgcctgggagaacagcaggcagctgtgcatggtgggaagagctccgcccagtcagccgagagcagcagcgttgccatgactcccacctacatggacagcccacgaaaggtatctgtggaccaaacagccactcctatgttggacggcaccagtttgggcatatgcacaggccaatccatggacagaggcaacagccagacctttgggaactcccagaacataggagaacagggctactcctccacaaactccagtgacagcagctctcagcagctggtggcaagctccttgacctcatcctctaccctgacagagatcctggaagccatgaagcacccctcgacaggagtccagctgctctctgaacagaagggcctctcaccgtactgcttcatcagcgcggaggtggtacactggttggtgaaccacgtggaggggatccagacacaggcgatggccattgacatcatgcagaaaatgctggaagagcagctcatcacacatgcatctggcgaagcctggcggaccttcatctacggcttctatttctacaagatagtaacggacaaagagcccgaccgagtggccatgcagcagcccgccaccacctggcacacagcaggagtggacgacttcgccagcttccagcgcaagtggtttgaggtggcctttgtggcagaagagctcgtgcactctgagattcctgcctttctcctgccctggctgcctagccggccagcctcctatgcaagtaggcacagctcctttagccgaagttttggaggacggagccaggcggcagcacttttagctgccactgtcccagagcagaggactgtgaccctggatgttgacgtgaacaaccgcacagaccggctggagtggtgcagctgttattaccatggcaacttttctctgaatgcagcctttgagatcaagctgcactggatggcggtgaccgcagcagtactcttcgagatggtccaaggttggcatcggaaagccacctcctgtggcttcttgttagtcccagttttggaggggccttttgcactgcccagttacctgtatggcgacccccttcgtgcccagctcttcatcccactcaacatcagctgcttgctcaaggagggcagcgagcacctgtttgatagctttgaacccgaaacgtactgggatcgaatgcacctcttccaggaagccattgcacacaggtttgggtttgtacaagataaatattctgcctctgcttttaacttccctgctgagaacaagcctcagtatatccacgttacaggaacagtgtttctgcagctgccctactccaagcgcaagttctcagggcagcagcggcggcggcggaactccaccagctccaccaaccagaacatgttctgcgaggagcgggtcggctacaactgggcctacaacaccatgctcaccaaaacatggcgctccagcgccacaggggatgaaaagtttgctgatcggctgctgaaggacttcacggacttctgcatcaaccgtgacaaccggctggtcacgttctggacaagttgcctggagaagatgcatgccagtgccccgtgaggccaggctgcacctgtgctgggggaaggtgggtgagccactgccctcaaacccggggcggaggattccaggcaggctctaggagtcaggtgtccgtttgctgctatcagtgagtgggggccattgttttttgtttgtttgtttgtttgtttgtttgtttttggcccccacgacaagtcttctactctagaagaaagactttggaagcagctgctgctgctgccaccactcctgtcagcaagtgctcagagcaggtgggaggcacagattgtccgtgggagggctccagtgtctgggaagagggcaggcggcccccatgaatgtcctcggaagggggtggctcctggtagcatccttttccttcaccatctatgggatattaggggcagaatctgccacttcttgcccaggagtgtgcacagatgtaagataattttgtgaaataatgtaccatagactctcaccaactgtatatacctgtacatatcagaagcaaataaagagctccacgtgcatca

SEQ ID NO: 8189 - DNA, 5378 bp, Homo sapiens
atctggaggaggcgcagggaacctggagagggtccagccctcagtgccccggccagaggcgggaaggggctctagagcttcgggaggcaagatgacttctctgccccaagcttggaacagctaaagggaaaaacagtgcaagatgagaacaacaaaggtctacaaactcgtcatccacaagaagggctttgggggcagtgatgatgagctagttgtgaaccccaaagtgttccctcacatcaagcttggagacattgtagagattgcacaccccaacgatgaatacagccctctgcttttgcaggtcaagtctcttaaggaagatttacagaaggaaactatcagtgtggaccagactgtgactcaagtgttccggctgagaccttatcaggatgtctatgttaatgtcgtagaccctaaggatgtgacccttgacctagtggaattaacttttaaggatcagtatattggccgtggggatatgtggcgactaaagaaaagtttggtcagcacatgtgcctatatcacccagaaggtggagtttgctggcatcagagcacaggctggtgaactgtgggttaagaatgagaaggtcatgtgtggctacatcagtgaagataccagggtggtgtttcgttctacgtcggctatggtttacatatttattcagatgagctgtgaaatgtgggattttgatatttatggggatttgtattttgagaaagctgtgaatggtttccttgctgatctatttaccaagtggaaggagaagaactgtagtcatgaagtgacagtggtcctgttttctagaactttctatgatgcaaaatctgttgatgaatttcctgaaataaaccgagcctcaattcgacaggatcacaaggggagattctatgaagacttttacaaagtggtggtgcagaatgagagaagagaagaatggacttcacttctcgtaaccattaaaaaactcttcatccagtatccagtgttggtgcgactggaacaggcagagggctttcctcaaggagataattctacctcagcacaaggaaactacctggaggccatcaatctgtcattcaatgtgtttgataagcactacatcaaccgcaactttgaccgaactgggcagatgtcagtggtgatcacgcccggggtgggtgtctttgaagtggaccgcctactcatgatcctgaccaagcagcggatgatagataatggaattggtgtggatttggtgtgcatgggagagcaaccgttacatgctgtcccattgttcaagctccataatcggagtgctccccgtgattctcgtctgggcgatgactataatatccctcactggataaaccacagtttctacacatccaaaagccagctcttttgtaatagtttcaccccacgaataaaactggcaggaaagaagcccgcctctgagaaagcaaaaaatggccgtgatacatctctcgggagtccaaaagaatctgagaacgcccttcccatccaagtagattatgacgcctatgacgctcaagtgttcaggctgcccggcccatcccgggcccagtgcctcaccacctgcagatctgtgcgagagcgagagagtcacagtcgaaagagtgccagctcctgtgatgtttcatccagcccttccctaccaagccgcacactgcccactgaggaagtgaggagccaggcttctgacgacagctccctaggcaagagtgccaacatcctgatgatcccacacccccacctgcaccagtatgaagtcagcagctccttgggatacaccagcactcgagatgtcctggagaacatgatggagccaccacagcgagactccagtgcaccagggaggtttcacgttggcagtgcagaatccatgctgcatgttcgacctggtggatacacgccccagagagcactgattaaccccttcgctccctctcggatgcccatgaagcttacgtccaacagaaggcgctggatgcacacttttcctgtggggccatccggagaagccatccagatccaccaccagacccgacagaatatggcggagctacaaggcagcgggcagagggatccaactcactcctctgcagagctgctggagttagcatatcatgaagctgctggaaggcacagcaattcccgccagcctggtgacggcatgtccttcttgaacttcagtggaacagaggagctttctgtcggcctgcttagcaacagtggtgcaggtatgaatcctaggacccagaataaggattctctagaggacagtgtttctacctctccagacccaatgccaggcttctgttgcacagttggagtggactggaagtctctcactactccggcgtgcctcccccttaccaccgactacttccctgaccgccagggcctgcagaatgactacacagagggctgttatgatctccttccagaagcagacatcgacaggagggacgaagatggtgtgcagatgacagcccagcaggtatttgaagagtttatttgccaacgtctcatgcagggctaccaaatcatagtgcagcccaagacacagaaacccaatcctgctgtcccgcccccgctgagcagtagcccactctatagccgaggccttgtgtcccgaaaccgccctgaggaggaggaccagtattggctgagtatgggcagaacgttccacaaagtgacgctgaaggataagatgatcacagtgacgcgataccttcccaagtatccttatgaatctgcccagatccactacacctacagcctctgtccttcccactcagactcagagttcgtctcctgctgggtggaattctcccacgaacggctggaggagtacaagtggaattacttagatcagtatatctgttctgccggctctgaagacttcagcttaattgagtccctgaagttctggaggacccgcttcctgctgctgccagcctgtgtcaccgccaccaagcgcatcacggagggggaggcccactgcgacatctatggggacaggccccgtgcagacgaggacgagtggcaactcctggatggttttgtccgctttgtggagggcttgaatcgcattcgcaggcggcatcgctcggatcgcatgatgcggaaagggaccgccatgaaaggcttgcagatgactgggcccatttccacgcattctctggagtcaactgcacccccagtggggaagaagggaacctcagctctctctgccctgttggagatggaggccagtcagaagtgcctgggagaacagcaggcagctgtgcatggtgggaagagctccgcccagtcagccgagagcagcagcgttgccatgactcccacctacatggacagcccacgaaaggtatctgtggaccaaacagccactcctatgttggacggcaccagtttgggcatatgcacaggccaatccatggacagaggcaacagccagacctttgggaactcccagaacataggagaacagggctactcctccacaaactccagtgacagcagctctcagcagctggtggcaagctccttgacctcatcctctaccctgacagagatcctggaagccatgaagcacccctcgacaggagtccagctgctctctgaacagaagggcctctcaccgtactgcttcatcagcgcggaggtggtacactggttggtgaaccacgtggaggggatccagacacaggcgatggccattgacatcatgcagaaaatgctggaagagcagctcatcacacatgcatctggcgaagcctggcggaccttcatctacggcttctatttctacaagatagtaacggacaaagagcccgaccgagtggccatgcagcagcccgccaccacctggcacacagcaggagtggacgacttcgccagcttccagcgcaagtggtttgaggtggcctttgtggcagaagagctcgtgcactctgagattcctgcctttctcctgccctggctgcctagccggccagcctcctatgcaagtaggcacagctcctttagccgaagttttggaggacggagccaggcggcagcacttttagctgccactgtcccagagcagaggactgtgaccctggatgttgacgtgaacaaccgcacagaccggctggagtggtgcagctgttattaccatggcaacttttctctgaatgcagcctttgagatcaagctgcactggatggcggtgaccgcagcagtactcttcgagatggtccaaggttggcatcggaaagccacctcctgtggcttcttgttagtcccagttttggaggggccttttgcactgcccagttacctgtatggcgacccccttcgtgcccagctcttcatcccactcaacatcagctgcttgctcaaggagggcagcgagcacctgtttgatagctttgaacccgaaacgtactgggatcgaatgcacctcttccaggaagccattgcacacaggtttgggtttgtacaagataaatattctgcctctgcttttaacttccctgctgagaacaagcctcagtatatccacgttacaggaacagtgtttctgcagctgccctactccaagcgcaagttctcagggcagcagcggcggcggcggaactccaccagctccaccaaccagaacatgttctgcgaggagcgggtcggctacaactgggcctacaacaccatgctcaccaaaacatggcgctccagcgccacaggggatgaaaagtttgctgatcggctgctgaaggacttcacggacttctgcatcaaccgtgacaaccggctggtcacgttctggacaagttgcctggagaagatgcatgccagtgccccgtgaggccaggctgcacctgtgctgggggaaggtgggtgagccactgccctcaaacccggggcggaggattccaggcaggctctaggagtcaggtgtccgtttgctgctatcagtgagtgggggccattgttttttgtttgtttgtttgtttgtttgtttgtttttggcccccacgacaagtcttctactctagaagaaagactttggaagcagctgctgctgctgccaccactcctgtcagcaagtgctcagagcaggtgggaggcacagattgtccgtgggagggctccagtgtctgggaagagggcaggcggcccccatgaatgtcctcggaagggggtggctcctggtagcatccttttccttcaccatctatgggatattaggggcagaatctgccacttcttgcccaggagtgtgcacagatgtaagataattttgtgaaataatgtaccatagactctcaccaactgtatatacctgtacatatcagaagcaaataaagagctccacgtgcatc

SEQ ID NO: 8190 - DNA, 236 bp, Homo sapiens
gccccggggcggagccaccggagcggcgcgggttctcagggaggcaagatgacttctctgccccaagcttggaacagctaaagggaaaaacagtgcaagatgagaacaacaaaggtctacaaactcgtcatccacaagaagggctttgggggcagtgatgatgagctagttgtgaaccccaaagtgttccctcacatcaagcttggagacattgtagagattgcacaccccaacga

SEQ ID NO: 8191 - DNA, 4843 bp, Homo sapiens
agcggcgcgggttctcagggaggcaagatgacttctctgccccaagcttggaacagctaaagggaaaaacagtgcaagatgagaacaacaaaggtctacaaactcgtcatccacaagaagggctttgggggcagtgatgatgagctagttgtgaaccccaaagtgttccctcacatcaagcttggagacattgtagagattgcacaccccaacgatgaatacagccctctgcttttgcaggtcaagtctcttaaggaagatttacagaaggaaactatcagtgtggaccagactgtgactcaagtgttccggctgagaccttatcaggatgtctatgttaatgtcgtagaccctaaggatgtgacccttgacctagtggaattaacttttaaggatcagtatattggccgtggggatatgtggcgactaaagaaaagtttggtcagcacatgtgcctatatcacccagaaggtggagtttgctggcatcagagcacaggctggtgaactgtgggttaagaatgagaaggtcatgtgtggctacatcagtgaagataccagggtggtgtttcgttctacgtcggctatggtttacatatttattcagatgagctgtgaaatgtgggattttgatatttatggggatttgtattttgagaaagctgtgaatggtttccttgctgatctatttaccaagtggaaggagaagaactgtagtcatgaagtgacagtggtcctgttttctagaactttctatgatgcaaaatctgttgatgaatttcctgaaataaaccgagcctcaattcgacaggatcacaaggggagattctatgaagacttttacaaagtggtggtgcagaatgagagaagagaagaatggacttcacttctcgtaaccattaaaaaactcttcatccagtatccagtgttggtgcgactggaacaggcagagggctttcctcaaggagataattctacctcagcacaaggaaactacctggaggccatcaatctgtcattcaatgtgtttgataagcactacatcaaccgcaactttgaccgaactgggcagatgtcagtggtgatcacgcccggggtgggtgtctttgaagtggaccgcctactcatgatcctgaccaagcagcggatgatagataatggaattggtgtggatttggtgtgcatgggagagcaaccgttacatgctgtcccattgttcaagctccataatcggagtgctccccgtgattctcgtctgggcgatgactataatatccctcactggataaaccacagtttctacacatccaaaagccagctcttttgtaatagtttcaccccacgaataaaactggcaggaaagaagcccgcctctgagaaagcaaaaaatggccgtgatacatctctcgggagtccaaaagaatctgagaacgcccttcccatccaagtagattatgacgcctatgacgctcaagtgttcaggctgcccggcccatcccgggcccagtgcctcaccacctgcagatctgtgcgagagcgagagagtcacagtcgaaagagtgccagctcctgtgatgtttcatccagcccttccctaccaagccgcacactgcccactgaggaagtgaggagccaggcttctgacgacagctccctaggcaagagtgccaacatcctgatgatcccacacccccacctgcaccagtatgaagtcagcagctccttgggatacaccagcactcgagatgtcctggagaacatgatggagccaccacagcgagactccagtgcaccagggaggtttcacgttggcagtgcagaatccatgctgcatgttcgacctggtggatacacgccccagagagcactgattaaccccttcgctccctctcggatgcccatgaagcttacgtccaacagaaggcgctggatgcacacttttcctgtgggtatgaatcctaggacccagaataaggattctctagaggacagtgtttctacctctccagacccaattctgacactgtctgctccccctgtagtgccaggcttctgttgcacagttggagtggactggaagtctctcactactccggcgtgcctcccccttaccaccgactacttccctgaccgccagggcctgcagaatgactacacagagggctgttatgatctccttccagaagcagacatcgacaggagggacgaagatggtgtgcagatgacagcccagcaggtatttgaagagtttatttgccaacgtctcatgcagggctaccaaatcatagtgcagcccaagacacagaaacccaatcctgctgtcccgcccccgctgagcagtagcccactctatagccgaggccttgtgtcccgaaaccgccctgaggaggaggaccagtattggctgagtatgggcagaacgttccacaaagtgacgctgaaggataagatgatcacagtgacgcgataccttcccaagtatccttatgaatctgcccagatccactacacctacagcctctgtccttcccactcagactcagagttcgtctcctgctgggtggaattctcccacgaacggctggaggagtacaagtggaattacttagatcagtatatctgttctgccggctctgaagacttcagcttaattgagtccctgaagttctggaggacccgcttcctgctgctgccagcctgtgtcaccgccaccaagcgcatcacggagggggaggcccactgcgacatctatggggacaggccccgtgcagacgaggacgagtggcaactcctggatggttttgtccgctttgtggagggcttgaatcgcattcgcaggcggcatcgctcggatcgcatgatgcggaaagggaccgccatgaaaggcttgcagatgactgggcccatttccacgcattctctggagtcaactgcacccccagtggggaagaagggaacctcagctctctctgccctgttggagatggaggccagtcagaagtgcctgggagaacagcaggcagctgtgcatggtgggaagagctccgcccagtcagccgagagcagcagcgttgccatgactcccacctacatggacagcccacgaaaggtatctgtggaccaaacagccactcctatgttggacggcaccagtttgggcatatgcacaggccaatccatggacagaggcaacagccagacctttgggaactcccagaacataggagaacagggctactcctccacaaactccagtgacagcagctctcagcagctggtggcaagctccttgacctcatcctctaccctgacagagatcctggaagccatgaagcacccctcgacaggagtccagctgctctctgaacagaagggcctctcaccgtactgcttcatcagcgcggaggtggtacactggttggtgaaccacgtggaggggatccagacacaggcgatggccattgacatcatgcagaaaatgctggaagagcagctcatcacacatgcatctggcgaagcctggcggaccttcatctacggcttctatttctacaagatagtaacggacaaagagcccgaccgagtggccatgcagcagcccgccaccacctggcacacagcaggagtggacgacttcgccagcttccagcgcaagtggtttgaggtggcctttgtggcagaagagctcgtgcactctgagattcctgcctttctcctgccctggctgcctagccggccagcctcctatgcaagtaggcacagctcctttagccgaagttttggaggacggagccaggcggcagcacttttagctgccactgtcccagagcagaggactgtgaccctggatgttgacgtgaacaaccgcacagaccggctggagtggtgcagctgttattaccatggcaacttttctctgaatgcagcctttgagatcaagctgcactggatggcggtgaccgcagcagtactcttcgagatggtccaaggttggcatcggaaagccacctcctgtggcttcttgttagtcccagttttggaggggccttttgcactgcccagttacctgtatggcgacccccttcgtgcccagctcttcatcccactcaacatcagctgcttgctcaaggagggcagcgagcacctgtttgatagctttgaacccgaaacgtactgggatcgaatgcacctcttccaggaagccattgcacacaggtttgggtttgtacaagataaatattctgcctctgcttttaacttccctgctgagaacaagcctcagtatatccacgttacaggaacagtgtttctgcagctgccctactccaagcgcaagttctcagggcagcagcggcggcggcggaactccaccagctccaccaaccagaacatgttctgcgaggagcgggtcggctacaactgggcctacaacaccatgctcaccaaaacatggcgctccagcgccacaggggatgaaaagtttgctgatcggctgctgaaggacttcacggacttctgcatcaaccgtgacaaccggctggtcacgttctggacaagttgcctggagaagatgcatgccagtgccccgtgaggccaggctgcacctgtgctgggggaaggtgggtgagccactgccctcaaacccggggcggaggattccaggcaggctctaggagtcaggtgtccgtttgctgctatcagtgagtgggggccattgttttttgtttgtttgtttgtttgtttgtttgtttttggcccccacgacaagtcttctactctagaagaaagactttggaagcagctgctgctgctgccaccactcctgtcagcaagtgctcagagca

SEQ ID NO: 8192 - DNA, 2300 bp, Homo sapiens
agcgcgggccgcgcgggcgtaggcggggtatctggaggaggcgcagggaacctggagagggtccagccctcagtgccccggccagaggcgggaaggggctctagagcttcgggaggcaagatgacttctctgccccaagcttggaacagctaaagggaaaaacagtgcaagatgagaacaacaaaggtctacaaactcgtcatccacaagaagggctttgggggcagtgatgatgagctagttgtgaaccccaaagtgttccctcacatcaagcttggagacattgtagagattgcacaccccaacgatgaatacagccctctgcttttgcaggtcaagtctcttaaggaagatttacagaaggaaactatcagtgtggaccagactgtgactcaagtgttccggctgagaccttatcaggatgtctatgttaatgtcgtagaccctaaggtcagcacatgtgcctatatcacccagaaggtggagtttgctggcatcagagcacaggctggtgaactgtgggttaagaatgagaaggtcatgtgtggctacatcagtgaagataccagggtggtgtttcgttctacgtcggctatggtttacatatttattcagatgagctgtgaaatgtgggattttgatatttatggggatttgtattttgagaaagctgtgaatggtttccttgctgatctatttaccaagtggaaggagaagaactgtagtcatgaagtgacagtggtcctgttttctagaactttctatgatgcaaaatctgttgatgaatttcctgaaataaaccgagcctcaattcgacaggatcacaaggggagattctatgaagacttttacaaagtggtggtgcagaatgagagaagagaagaatggacttcacttctcgtaaccattaaaaaactcttcatccagtatccagtgttggtgcgactggaacaggcagagggctttcctcaaggagataattctacctcagcacaaggaaactacctggaggccatcaatctgtcattcaatgtgtttgataagcactacatcaaccgcaactttgaccgaactgggcagatgtcagtggtgatcacgcccggggtgggtgtctttgaagtggaccgcctactcatgatcctgaccaagcagcggatgatagataatggaattggtgtggatttggtgtgcatgggagagcaaccgttacatgctgtcccattgttcaagctccataatcggagtgctccccgtgattctcgtctgggcgatgactataatatccctcactggataaaccacagtttctacacatccaaaagccagctcttttgtaatagtttcaccccacgaataaaactggcaggaaagaagcccgcctctgagaaagcaaaaaatggccgtgatacatctctcgggagtccaaaagaatctgagaacgcccttcccatccaagtagattatgacgcctatgacgctcaagtgttcaggctgcccggcccatcccgggcccagtgcctcaccacctgcagatctgtgcgagagcgagagagtcacagtcgaaagagtgccagctcctgtgatgtttcatccagcccttccctaccaagccgcacactgcccactgaggaagtgaggagccaggcttctgacgacagctccctaggcaagagtgccaacatcctgatgatcccacacccccacctgcaccagtatgaagtcagcagctccttgggatacaccagcactcgagatgtcctggagaacatgatggagccaccacagcgagactccagtgcaccagggaggtttcacgttggcagtgcagaatccatgctgcatgttcgacctggtggatacacgccccagagagcactgattaaccccttcgctccctctcggatgcccatgaagcttacgtccaacagaaggcgctggatgcacacttttcctgtgggtatgaatcctaggacccagaataaggattctctagaggacagtgtttctacctctccagacccaagtaagagggggcagctgactggggaaaggggtagacagggagtgtggggtggtcagagcatgaggaaacaagaggaagccctgtgggaagtgagtggtcctgaggtacacatacctctggggtatgggaaggcgatgtggtgagggaggactctctggactctgtgatggaaagtgagggggtgtgtgactgaatgacctgttttggaaggtgattcaggggcacctgggaaaggtagcagattccctataaggcccccatgctggtccagagctgg

SEQ ID NO: 8193 - DNA, 2052 bp, Homo sapiens
aagaggcagctgaagctggatggagggtgatgatgagatgaaaaggaagggatgaagaacacggcagggtgcctacggtgcctgggagaacagcaggcagctgtgcatggtgggaagagctccgcccagtcagccgagagcagcagcgttgccatgactcccacctacatggacagcccacgaaaggtatctgtggaccaaacagccactcctatgttggacggcaccagtttgggcatatgcacaggccaatccatggacagaggcaacagccagacctttgggaactcccagaacataggagaacagggctactcctccacaaactccagtgacagcaggaagtggagactgttcctaatattcgtgctcttgactgcatacgtgccatcttgctttgctgacctgacaccctgtgttacagctctcagcagctggtggcaagctccttgacctcatcctctaccctgacagagatcctggaagccatgaagcacccctcgacaggagtccagctgctctctgaacagaagggcctctcaccgtactgcttcatcagcgcggaggtggtacactggttggtgaaccacgtggaggggatccagacacaggcgatggccattgacatcatgcagaaaatgctggaagagcagctcatcacacatgcatctggcgaagcctggcggaccttcatctacggcttctatttctacaagatagtaacggacaaagagcccgaccgagtggccatgcagcagcccgccaccacctggcacacagcaggagtggacgacttcgccagcttccagcgcaagtggtttgaggtggcctttgtggcagaagagctcgtgcactctgagattcctgcctttctcctgccctggctgcctagccggccagcctcctatgcaagtaggcacagctcctttagccgaagttttggaggacggagccaggcggcagcacttttagctgccactgtcccagagcagaggactgtgaccctggatgttgacgtgaacaaccgcacagaccggctggagtggtgcagctgttattaccatggcaacttttctctgaatgcagcctttgagatcaagctgcactggatggcggtgaccgcagcagtactcttcgagatggtccaaggttggcatcggaaagccacctcctgtggcttcttgttagtcccagttttggaggggccttttgcactgcccagttacctgtatggcgacccccttcgtgcccagctcttcatcccactcaacatcagctgcttgctcaaggagggcagcgagcacctgtttgatagctttgaacccgaaacgtactgggatcgaatgcacctcttccaggaagccattgcacacaggtttgggtttgtacaagataaatattctgcctctgcttttaacttccctgctgagaacaagcctcagtatatccacgttacaggaacagtgtttctgcagctgccctactccaagcgcaagttctcagggcagcagcggcggcggcggaactccaccagctccaccaaccagaacatgttctgcgaggagcgggtcggctacaactgggcctacaacaccatgctcaccaaaacatggcgctccagcgccacaggggatgaaaagtttgctgatcggctgctgaaggacttcacggacttctgcatcaaccgtgacaaccggctggtcacgttctggacaagttgcctggagaagatgcatgccagtgccccgtgaggccaggctgcacctgtgctgggggaaggtgggtgagccactgccctcaaacccggggcggaggattccaggcaggctctaggagtcaggtgtccgtttgctgctatcagtgagtgggggccattgttttttgtttgtttgtttgtttgtttgtttgtttttggcccccacgacaagtcttctactctagaagaaagactttggaagcagctgctgctgctgccaccactcctgtcagcaagtgctcagagcaggtgggaggcacagattgtccgtgggagggctccagtgtctgggaaga

SEQ ID NO: 8194 - DNA, 5363 bp, Homo sapiens
tctgtggcagggaggcaagatgacttctctgccccaagcttggaacagctaaagggaaaaacagtgcaagatgagaacaacaaaggtctacaaactcgtcatccacaagaagggctttgggggcagtgatgatgagctagttgtgaaccccaaagtgttccctcacatcaagcttggagacattgtagagattgcacaccccaacgatgaatacagccctctgcttttgcaggtcaagtctcttaaggaagatttacagaaggaaactatcagtgtggaccagactgtgactcaagtgttccggctgagaccttatcaggatgtctatgttaatgtcgtagaccctaaggatgtgacccttgacctagtggaattaacttttaaggatcagtatattggccgtggggatatgtggcgactaaagaaaagtttggtcagcacatgtgcctatatcacccagaaggtggagtttgctggcatcagagcacaggctggtgaactgtgggttaagaatgagaaggtcatgtgtggctacatcagtgaagataccagggtggtgtttcgttctacgtcggctatggtttacatatttattcagatgagctgtgaaatgtgggattttgatatttatggggatttgtattttgagaaagctgtgaatggtttccttgctgatctatttaccaagtggaaggagaagaactgtagtcatgaagtgacagtggtcctgttttctagaactttctatgatgcaaaatctgttgatgaatttcctgaaataaaccgagcctcaattcgacaggatcacaaggggagattctatgaagacttttacaaagtggtggtgcagaatgagagaagagaagaatggacttcacttctcgtaaccattaaaaaactcttcatccagtatccagtgttggtgcgactggaacaggcagagggctttcctcaaggagataattctacctcagcacaaggaaactacctggaggccatcaatctgtcattcaatgtgtttgataagcactacatcaaccgcaactttgaccgaactgggcagatgtcagtggtgatcacgcccggggtgggtgtctttgaagtggaccgcctactcatgatcctgaccaagcagcggatgatagataatggaattggtgtggatttggtgtgcatgggagagcaaccgttacatgctgtcccattgttcaagctccataatcggagtgctccccgtgattctcgtctgggcgatgactataatatccctcactggataaaccacagtttctacacatccaaaagccagctcttttgtaatagtttcaccccacgaataaaactggcaggaaagaagcccgcctctgagaaagcaaaaaatggccgtgatacatctctcgggagtccaaaagaatctgagaacgcccttcccatccaagtagattatgacgcctatgacgctcaagtgttcaggctgcccggcccatcccgggcccagtgcctcaccacctgcagatctgtgcgagagcgagagagtcacagtcgaaagagtgccagctcctgtgatgtttcatccagcccttccctaccaagccgcacactgcccactgaggaagtgaggagccaggcttctgacgacagctccctaggcaagagtgccaacatcctgatgatcccacacccccacctgcaccagtatgaagtcagcagctccttgggatacaccagcactcgagatgtcctggagaacatgatggagccaccacagcgagactccagtgcaccagggaggtttcacgttggcagtgcagaatccatgctgcatgttcgacctggtggatacacgccccagagagcactgattaaccccttcgctccctctcggatgcccatgaagcttacgtccaacagaaggcgctggatgcacacttttcctgtggggccatccggagaagccatccagatccaccaccagacccgacagaatatggcggagctacaaggcagcgggcagagggatccaactcactcctctgcagagctgctggagttagcatatcatgaagctgctggaaggcacagcaattcccgccagcctggtgacggcatgtccttcttgaacttcagtggaacagaggagctttctgtcggcctgcttagcaacagtggtgcaggtatgaatcctaggacccagaataaggattctctagaggacagtgtttctacctctccagacccaatgccaggcttctgttgcacagttggagtggactggaagtctctcactactccggcgtgcctcccccttaccaccgactacttccctgaccgccagggcctgcagaatgactacacagagggctgttatgatctccttccagaagcagacatcgacaggagggacgaagatggtgtgcagatgacagcccagcaggtatttgaagagtttatttgccaacgtctcatgcagggctaccaaatcatagtgcagcccaagacacagaaacccaatcctgctgtcccgcccccgctgagcagtagcccactctatagccgaggccttgtgtcccgaaaccgccctgaggaggaggaccagtattggctgagtatgggcagaacgttccacaaagtgacgctgaaggataagatgatcacagtgacgcgataccttcccaagtatccttatgaatctgcccagatccactacacctacagcctctgtccttcccactcagactcagagttcgtctcctgctgggtggaattctcccacgaacggctggaggagtacaagtggaattacttagatcagtatatctgttctgccggctctgaagacttcagcttaattgagtccctgaagttctggaggacccgcttcctgctgctgccagcctgtgtcaccgccaccaagcgcatcacggagggggaggcccactgcgacatctatggggacaggccccgtgcagacgaggacgagtggcaactcctggatggttttgtccgctttgtggagggcttgaatcgcattcgcaggcggcatcgctcggatcgcatgatgcggaaagggaccgccatgaaaggcttgcagatgactgggcccatttccacgcattctctggagtcaactgcacccccagtggggaagaagggaacctcagctctctctgccctgttggagatggaggccagtcagaagtgcctgggagaacagcaggcagctgtgcatggtgggaagagctccgcccagtcagccgagagcagcagcgttgccatgactcccacctacatggacagcccacgaaaggacggggccttctttatggagtttgtccgcagcccacgcacagcatcgtccgccttctaccctcaggtatctgtggaccaaacagccactcctatgttggacggcaccagtttgggcatatgcacaggccaatccatggacagaggcaacagccagacctttgggaactcccagaacataggagaacagggctactcctccacaaactccagtgacagcagctctcagcagctggtggcaagctccttgacctcatcctctaccctgacagagatcctggaagccatgaagcacccctcgacaggagtccagctgctctctgaacagaagggcctctcaccgtactgcttcatcagcgcggaggtggtacactggttggtgaaccacgtggaggggatccagacacaggcgatggccattgacatcatgcagaaaatgctggaagagcagctcatcacacatgcatctggcgaagcctggcggaccttcatctacggcttctatttctacaagatagtaacggacaaagagcccgaccgagtggccatgcagcagcccgccaccacctggcacacagcaggagtggacgacttcgccagcttccagcgcaagtggtttgaggtggcctttgtggcagaagagctcgtgcactctgagattcctgcctttctcctgccctggctgcctagccggccagcctcctatgcaagtaggcacagctcctttagccgaagttttggaggacggagccaggcggcagcacttttagctgccactgtcccagagcagaggactgtgaccctggatgttgacgtgaacaaccgcacagaccggctggagtggtgcagctgttattaccatggcaacttttctctgaatgcagcctttgagatcaagctgcactggatggcggtgaccgcagcagtactcttcgagatggtccaaggttggcatcggaaagccacctcctgtggcttcttgttagtcccagttttggaggggccttttgcactgcccagttacctgtatggcgacccccttcgtgcccagctcttcatcccactcaacatcagctgcttgctcaaggagggcagcgagcacctgtttgatagctttgaacccgaaacgtactgggatcgaatgcacctcttccaggaagccattgcacacaggtttgggtttgtacaagataaatattctgcctctgcttttaacttccctgctgagaacaagcctcagtatatccacgttacaggaacagtgtttctgcagctgccctactccaagcgcaagttctcagggcagcagcggcggcggcggaactccaccagctccaccaaccagaacatgttctgcgaggagcgggtcggctacaactgggcctacaacaccatgctcaccaaaacatggcgctccagcgccacaggggatgaaaagtttgctgatcggctgctgaaggacttcacggacttctgcatcaaccgtgacaaccggctggtcacgttctggacaagttgcctggagaagatgcatgccagtgccccgtgaggccaggctgcacctgtgctgggggaaggtgggtgagccactgccctcaaacccggggcggaggattccaggcaggctctaggagtcaggtgtccgtttgctgctatcagtgagtgggggccattgttttttgtttgtttgtttgtttgtttgtttgtttttggcccccacgacaagtcttctactctagaagaaagactttggaagcagctgctgctgctgccaccactcctgtcagcaagtgctcagagcaggtgggaggcacagattgtccgtgggagggctccagtgtctgggaagagggcaggcggcccccatgaatgtcctcggaagggggtggctcctggtagcatccttttccttcaccatctatgggatattaggggcagaatctgccacttcttgcccaggagtgtgcacagatgtaagataattttgtgaaataatgtaccatagactctcaccaactgtatatacctgtacatatcagaagcaaataaagagctcc

SEQ ID NO: 8195 - DNA, 1755 bp, Homo sapiens
gagccacgccccgcacagttaacagacgggcgctcagggagctagggagctgtgaagctgctggaggagttggcgtccggggagcaagggccatggccaccgtgcaggagaaggctgctgcgctgaacctctcggctctccacagccccgcgcacaggcctccgggtttcagtgtagctcagaagccatttggagccacgtatgtatggagcagcatcataaacactcttcaaacacaagtggaagtgaaaaaacgaaggcaccgtttaaaacgacataatgactgctttgttggttcagaagctgtggatgtcattttttctcacctaattcagaataagtattttggtgatgtagatattcctcgagccaaagtggtgagagtgtgtcaagcgcttatggactacaaagtatttgaagcagttccaaccaaagtctttggaaaagacaaaaaacctacatttgaagatagtagttgcagcctttatagattcaccacaatacctaaccaagacagtcagttaggcaaagagaacaaactatattcacctgccaggtatgcagatgcattatttaagtcatccgatatcagatcagccagtttagaggacctgtgggaaaatctgagtttaaagcctgccaactcccctcatgtaaatatctctgcaaccttgtctccacaagttattaatgaagtgtggcaagaagaaacaattgggcgtctactacaacttgtagaccttccacttcttgactccttactgaaacagcaagaggctgtacctaaaattcctcaacctaagaggcagtccaccatggtcaacagcagtaactatctggatcgagggattctcaaggcttatagtgactctcaggaagatgagtggctctcggcagcaattgactgtttagaataccttccagaccaaatggtggtggaaataagcagaagctttcctgagcaaccagaccgaacagacttagtgaaagaacttctgtttgatgccattggcagatattacagtagtagggaacctctgttaaatcacttatctgacgttcataatggaattgcagaactcttagtgaatgggaagacggaaatagctttagaagctacccagctccttctaaagcttttagatttccaaaatagagaagaatttagaagactactgtatttcatggctgttgcagcaaatccttctgagtttaaattacagaaagaaagtgacaaccgaatggttgtgaaaaggatattctcaaaagctattgttgacaataaaaatttatccaaaggcaaaacagatcttctggtactctttttaatggatcatcagaaagatgtttttaagattcctggaactctacataaaattgtaagtgttaagcttatggccatacagaacggaagagatccaaatagagatgcaggatatatttattgccagagaattgatcaacgtgactattccaacaatacagagaagacaaccaaagatgagctgttgaatttactaaaaactcttgatgaggattcaaaactttctgccaaagagaagaaaaaattgctaggtcaattctataagtgtcacccagacatctttattgagcattttggagactgagtttttaatatctgtatataagttgtgtattttaagaataaattatgtatcctaaatatccaatcacatttgtaagcgtggaagctctaaatttgaaactgtacttaataaaaatttttttgtataa

SEQ ID NO: 8196 - DNA, 2012 bp, Homo sapiens
agctgcgaccacttggccaacgcccccgccgagcgggcggatcgagttcctctctggctggtgggctgcaagcggcagagcccgcccgcacagcccagcttttttctttctacccagactctcaacttgaccgcgcgttggtctgtgcgcccgctaacgtgccaggcacgcgccggggagctccgggatatgctccgcggtgctaccggtgacaagtgtggtatctggaatttgtgtagttctttgccccctgtctcaaccacaaaccttgacgacacagtatggccaggggccgagctcctcccttgcccactttgttctccagactgctaggagtcaagagtcagcttgtctccccagactcttcctgggagggatgagaggtttatgtgagttctactggcaggaatttggcataaaaggtttcagtgtagctcagaagccatttggagccacgtatgtatggagcagcatcataaacactcttcaaacacaagtggaagtgaaaaaacgaaggcaccgtttaaaacgacataatgactgctttgttggttcagaagctgtggatgtcattttttctcacctaattcagaataagtattttggtgatgtagatattcctcgagccaaagtggtgagagtgtgtcaagcgcttatggactacaaagtatttgaagcagttccaaccaaagtctttggaaaagacaaaaaacctacatttgaagatagtagttgcagcctttatagattcaccacaatacctaaccaagacagtcagttaggcaaagagaacaaactatattcacctgccaggtatgcagatgcattatttaagtcatccgatatcagatcagccagtttagaggacctgtgggaaaatctgagtttaaagcctgccaactcccctcatgtaaatatctctgcaaccttgtctccacaagttattaatgaagtgtggcaagaagaaacaattgggcgtctactacaacttgtagaccttccacttcttgactccttactgaaacagcaagaggctgtacctaaaattcctcaacctaagaggcagtccaccatggtcaacagcagtaactatctggatcgagggattctcaaggcttatagtgactctcaggaagatgagtggctctcggcagcaattgactgtttagaataccttccagaccaaatggtggtggaaataagcagaagctttcctgagcaaccagaccgaacagacttagtgaaagaacttctgtttgatgccattggcagatattacagtagtagggaacctctgttaaatcacttatctgacgttcataatggaattgcagaactcttagtgaatgggaagacggaaatagctttagaagctacccagctccttctaaagcttttagatttccaaaatagagaagaatttagaagactactgtatttcatggctgttgcagcaaatccttctgagtttaaattacagaaagaaagtgacaaccgaatggttgtgaaaaggatattctcaaaagctattgttgacaataaaaatttatccaaaggcaaaacagatcttctggtactctttttaatggatcatcagaaagatgtttttaagattcctggaactctacataaaattgtaagtgttaagcttatggccatacagaacggaagagatccaaatagagatgcaggatatatttattgccagagaattgatcaacgtgactattccaacaatacagagaagacaaccaaagatgagctgttgaatttactaaaaactcttgatgaggattcaaaactttctgccaaagagaagaaaaaattgctaggtcaattctataagtgtcacccagacatctttattgagcattttggagactgagtttttaatatctgtatataagttgtgtattttaagaataaattatgtatcctaaatatccaatcacatttgtaagcgtggaagctctaaatttgaaactgtacttaataaaaatttttttgtataa

SEQ ID NO: 8197 - DNA, 2569 bp, Homo sapiens
aatccagtcagagcagcggagctgccccgaacaaagatggcgcgggaagcgtctgtgagggcagactgatccgagcacccaaaccctcggcggacagcggagccagtggtagccgcacggccctaaaaccatggaggagggcggcagcactggcagtgctggcagtgacagcagcaccagcgggagtggcggggcgcagcaaagggagctggagcgcatggctgaggtcttggtcaccggggaacagctacggctcaggctgcacgaagaaaaggttattaaagatagacgtcatcatctcaagacctacccaaactgttttgtcgcaaaagaactgattgactggctgattgaacacaaagaggcttctgacagagagacggcaattaaactcatgcagaaattagcagaccggggcattattcaccatgtgtgtgatgagcataaggaattcaaggatgtcaaactcttctaccgctttagaaaggatgacggcaccttcccattggataatgaagtgaaggcctttatgagaggacagaggctatatgaaaagctgatgagccctgaaaacacactcctgcagcccagggaggaggaaggggtcaagtatgagcgcaccttcatggcatctgaattcctggactggctggttcaggaaggtgaggccaccacgaggaaagaggcagagcagctttgccaccggcttatggagcatggcatcatccagcatgtgtccaacaagcacccatttgtggacagcaatcttctctaccagttcagaatgaacttccggcggaggcgaagactgatggagctgctcaatgaaaagtccccctcctcccaggaaactcatgacagtcccttctgcctgaggaagcagagccatgacaatcggaaatctaccagctttatgtcagtgagccccagcaaggagatcaagatcgtgtctgcagtgaggagaagcagcatgagcagctgtggcagcagcggctacttcagcagcagccccaccctcagcagcagcccccctgtgctctgcaaccccaagtccgtgctgaagagacctgtcacctctgaggaactccttactcccggggctccgtatgcaaggaagacattcacgattgttggtgacgcggttggctggggttttgtggtgcgaggaagtaagccatgccacatccaggctgtagaccccagtggccctgcagccgcagcaggaatgaaggtctgtcagtttgtcgtctctgtcaacgggctcaatgtcctgcatgtagactaccggaccgtgagcaatctgattctgacgggcccacggacgattgtcatggaagtcatggaggagttagagtgctgagctcctgggcctcccagccctccagtggcctgtgggtgagggaagccagaatgacacaaagcaatgcaaagacaagattgccatgcaaatggatggttttggacatacgagtcttctccgcacatacatgtctaaagttgagttttatacactgaatgtggaagaaccgggtatcatatcttttttaaaaaatgtcagtgtagaaaacatttgggaaaccattttcctacatgatagaactgccttactagatttctatttgtagctctcattcattgttttttatcttagtttgcagaaaggtgttgaaatgcttctctagcccaaacagcgacatgctaaagtccccttcttcagagtcaatagagtagttgttaaaggttttaaattgtactttctccaaaattagcatgcagctatttaatagggaatctagatttcaccaagattcaaatcaaagcaacatttaaaggaataagacctgttcactagcattttcaagggggttctaaagcattcaagtgcttaaaagccataaaaaatgacttcttaattcctgcctttagtgtcaacttttaagttaatacaggtttcaattgtggcattaggaaaaaaaaaaaccttgtgatgctatggttgggggtagttagggagagactacatgaaattgtgtgcccctattttctttctgatcctaaatcattttgttttataaatcagctatagcatctttctagaattaatcctgaatatgttgaatgttaaaatagagaagtttgtatatacacataattaaaaatcaacccttctggcaagatttcactttgaaggtgtctgtttttaagggaaggctaaaactttgctgatatgtgataaaacttgaactctaaattgcctccttagcctgaatttttactagctttctagtgtaacatattctaaggacatgacatgctgcttatttggggggattatttttcaccaaaatgatcatcttgtgttgtaacttttcagctcacttgtatatacgcacgttttcatttttggtctagaaaatagtgcattttggggctcagcgtgcagaggaaattcctcaaagtgccaaattaggcagtcaggaaatactaaattcttcattccaaataatggatctgaatgatgacgttaattttttatcatgcattaacaaaataaaatatgagaattgta

SEQ ID NO: 8198 - DNA, 4255 bp, Homo sapiens
ctgcttctctataggtgacccccgccccaaagtcccccctcccactaacttctctttgagaagagagtaaaaccgaattcgagagaaaagaggcagtaactattcgggaggaggcagactggagtgggcaccagtcccgcggagcctcagcgcccgccgcgtccctccctccgcccctttcgcccacacctacccgcccccgccggcccggctctcagtagcgtcgcccgaggctgcagcagcgcatcccggggcatggcgcggcgggggcgcggagggctcggttcggagggggccgggagcccgggcgccctggagtgaggaggaccgggagctggctctggaggctgcggaggcgacgccggagagaacgaagcctcggctgggagcggatctttcgaagatggtttggctgccttggagatttggagatctgatgccacgatgaggactcacacacggggggctcccagtgtgtttttcatatatttgctttgctttgtgtcagcctacatcaccgacgagaacccagaagttatgattcccttcaccaatgccaactacgacagccatcccatgctgtacttctccagggcagaagtggcggagctgcagctcagggctgccagctcgcacgagcacattgcagcccgcctcacggaggctgtgcacacgatgctgtccagccccttggaatacctccctccctgggatcccaaggactacagtgcccgctggaatgaaatttttggaaacaacttgggtgccttggcaatgttctgtgtgctgtatcctgagaacattgaagcccgagacatggccaaagactacatggagaggatggcagcgcagcctagttggttggtgaaagatgctccttgggatgaggtcccgcttgctcactccctggttggttttgccactgcttatgacttcttgtacaactacctgagcaagacacaacaggagaagtttcttgaagtgattgccaatgcctcagggtatatgtatgaaacttcatacaggagaggatggggatttcaatacctgcacaatcatcagcccaccaactgtatggctttgctcacgggaagcctagtcctgatgaatcaaggatatcttcaagaagcctacttatggaccaaacaagttctgaccatcatggagaaatctctggtcttgctcagggaggtgacggatggctccctctatgaaggagttgcgtatggcagctacaccactagatcactcttccaatacatgtttctcgtccagaggcacttcaacatcaaccactttggccatccgtggcttaaacaacactttgcatttatgtatagaaccatcctgccagggtttcaaaggactgtggctattgcggactcaaattacaactggttttatggtccagaaagccaattagtgttccttgataaatttgtcatgcgtaatggcagtggtaactggctagctgaccaaatcagaaggaaccgtgtggtggaaggtccaggaacaccatccaaagggcagcgctggtgcactctgcacacagaatttctctggtatgatggcagcttgaaatcggttcctcctccagactttggcacccctacactgcattattttgaagactggggtgtcgtgacttatggaagtgcactacctgcagaaatcaatagatctttcctttccttcaagtctggaaaactggggggacgtgcaatatatgacattgtccacagaaacaaatacaaagattggatcaaaggatggagaaattttaatgcagggcatgaacatcctgatcaaaactcatttacttttgctcccaatggtgtgcctttcattactgaggctctgtacgggccaaagtacaccttcttcaacaatgttttgatgttttccccagctgtgtcaaagagctgcttttctccctgggtgggtcaggtcacagaagactgctcatcaaaatggtctaaatacaagcatgacctggcagctagttgtcaggggagggtggttgcagcagaggagaaaaatggggtggttttcatccgaggagaaggtgtgggagcttataacccccagctcaacctgaagaatgttcagaggaatctcatcctcctacatccacagctgcttctccttgtagaccaaatacacctgggagaggagagtcccttggagacagcagcgagcttcttccataatgtggatgttccttttgaggagactgtggtagatggtgtccatggggctttcatcaggcagagagatggtctctataaaatgtactggatggacgatactggctacagcgagaaagcaacctttgcctcagtgacatatcctcggggctatccctacaatgggacaaactatgtgaatgtcaccatgcacctccgaagtcccatcaccagggcagcttacctcttcatagggccatctatagatgttcagagcttcactgtccacggagactctcagcaactggatgtgttcatagccaccagcaaacatgcctacgccacatacctgtggacaggtgaggccacaggacagtctgcctttgcacaggtcattgctgatcgtcacaaaattctgtttgaccggaattcagccatcaagagcagcattgtccctgaggtgaaggactatgctgctattgtggaacagaacttgcagcattttaaaccagtgtttcagctgctggagaagcagatactgtcccgagtccggaacacagctagctttaggaagactgctgaacgcctgctgagattttcagataagagacagactgaggaggccattgacaggatttttgccatatcacagcaacagcagcagcaaagcaagtcaaagaaaaaccgaagggcaggcaaacgctataaatttgtggatgctgtccctgatatttttgcacagattgaagtcaatgagaaaaagattagacagaaagctcagattttggcacagaaagaactacccatagatgaagatgaagaaatgaaagaccttttagattttgcagatgtaacatacgagaaacataaaaatgggggcttgattaaaggccggtttggacaggcacggatggtgacaactacacacagcagggccccatcactgtctgcttcctataccaggttgttcctgattctgaacattgctattttctttgtcatgttggcaatgcaactgacttatttccagagggcccagagcctacatggccaaagatgtctttatgcagttcttctcatagatagctgtattttattatggttgtactcttcttgttcccaatcacagtgttagcactgaagctataaattacctggtcattttgtgatcacaagagtctatgcaaaaaaaaaaatttctttaccccagattatcagatttttttccctcagattcattttaacaaattaagggaagatattttgacacaagaaagcaggaacgtggagaaattggagcaggaaaagaaattatcaaagcaatagaaatagcttggtggtcctatggtgtttttggaagtatttggcattgctaattgagcagtccatatagtactacttttagaagaaacaaaaagtctattttttaaagtaatgttttttcttatgagaaaaaggtttagatagaattgggttttattaatattaatttaatgctattagcaatttccatatactatattgtggaaaagactgaagaatacaattctgagaaatataaaaaaattttaatggtatactcatgttgaaagataaatgttgctaagtcctggtatgatggtgtgagcttccttggggaagtacttcttgagttatgtaactaacaggatgttttactacagatctggatggctattcagataacatggcaaaaaatgatagcagaagatcattaaaaacttaaaatatattttattagaaaacatttatctatgaatgaatatttccttgatgctggtctctgcacacatatgcttggttacttgcatgcattcattggttgttcaataagtgagatgattacagataatactgtattttccttatatggaaaaccgttatagacccaataacaactaaacctttcaaaagaaaatattttctattatgaatgttgattttcataccaaagaagatggagagtctaaaatttggatatgattcttatgtttttttaatagaaaaccttcttcaagtttattttcctaaataaacatcataattgtgaa

SEQ ID NO: 8199 - DNA, 4037 bp, Homo sapiens
agtagcgtcgcccgaggctgcagcagcgcatcccggggcatggcgcggcgggggcgcggagggctcggttcggagggggccgggagcccgggcgccctggagtgaggaggaccgggagctggctctggaggctgcggaggcgacgccggagagaacgaagcctcggctgggagcggatctttcgaagatggtttggctgccttggagatttggagatctgatgccacgatgaggactcacacacggggggctcccagtgtgtttttcatatatttgctttgctttgtgtcagcctacatcaccgacgagaacccagaagttatgattcccttcaccaatgccaactacgacagccatcccatgctgtacttctccagggcagaagtggcggagctgcagctcagggctgccagctcgcacgagcacattgcagcccgcctcacggaggctgtgcacacgatgctgtccagccccttggaatacctccctccctgggatcccaaggactacagtgcccgctggaatgaaatttttggaaacaacttgggtgccttggcaatgttctgtgtgctgtatcctgagaacattgaagcccgagacatggccaaagactacatggagaggatggcagcgcagcctagttggttggtgaaagatgctccttgggatgaggtcccgcttgctcactccctggttggttttgccactgcttatgacttcttgtacaactacctgagcaagacacaacaggagaagtttcttgaagtgattgccaatgcctcagggtatatgtatgaaacttcatacaggagaggatggggatttcaatacctgcacaatcatcagcccaccaactgtatggctttgctcacgggaagcctagtcctgatgaatcaaggatatcttcaagaagcctacttatggaccaaacaagttctgaccatcatggagaaatctctggtcttgctcagggaggtgacggatggctccctctatgaaggagttgcgtatggcagctacaccactagatcactcttccaatacatgtttctcgtccagaggcacttcaacatcaaccactttggccatccgtggcttaaacaacactttgcatttatgtatagaaccatcctgccagggtttcaaaggactgtggctattgcggactcaaattacaactggttttatggtccagaaagccaattagtgttccttgataaatttgtcatgcgtaatggcagtggtaactggctagctgaccaaatcagaaggaaccgtgtggtggaaggtccaggaacaccatccaaagggcagcgctggtgcactctgcacacagaatttctctggtatgatggcagcttgaaatcggttcctcctccagactttggcacccctacactgcattattttgaagactggggtgtcgtgacttatggaagtgcactacctgcagaaatcaatagatctttcctttccttcaagtctggaaaactggggggacgtgcaatatatgacattgtccacagaaacaaatacaaagattggatcaaaggatggagaaattttaatgcagggcatgaacatcctgatcaaaactcatttacttttgctcccaatggtgtgcctttcattactgaggctctgtacgggccaaagtacaccttcttcaacaatgttttgatgttttccccagctgtgtcaaagagctgcttttctccctgggtgggtcaggtcacagaagactgctcatcaaaatggtctaaatacaagcatgacctggcagctagttgtcaggggagggtggttgcagcagaggagaaaaatggggtggttttcatccgaggagaaggtgtgggagcttataacccccagctcaacctgaagaatgttcagaggaatctcatcctcctacatccacagctgcttctccttgtagaccaaatacacctgggagaggagagtcccttggagacagcagcgagcttcttccataatgtggatgttccttttgaggagactgtggtagatggtgtccatggggctttcatcaggcagagagatggtctctataaaatgtactggatggacgatactggctacagcgagaaagcaacctttgcctcagtgacatatcctcggggctatccctacaatgggacaaactatgtgaatgtcaccatgcacctccgaagtcccatcaccagggcagcttacctcttcatagggccatctatagatgttcagagcttcactgtccacggagactctcagcaactggatgtgttcatagccaccagcaaacatgcctacgccacatacctgtggacaggtgaggccacaggacagtctgcctttgcacaggtcattgctgatcgtcacaaaattctgtttgaccggaattcagccatcaagagcagcattgtccctgaggtgaaggactatgctgctattgtggaacagaacttgcagcattttaaaccagtgtttcagctgctggagaagcagatactgtcccgagtccggaacacagctagctttaggaagactgctgaacgcctgctgagattttcagataagagacagactgaggaggccattgacaggatttttgccatatcacagcaacagcagcagcaaagcaagtcaaagaaaaaccgaagggcaggcaaacgctataaatttgtggatgctgtccctgatatttttgcacagattgaagtcaatgagaaaaagattagacagaaagctcagattttggcacagaaagaactacccatagatgaagatgaagaaatgaaagaccttttagattttgcagatgtaacatacgagaaacataaaaatgggggcttgattaaaggccggtttggacaggcacggatggtgacaactacacacagcagggccccatcactgtctgcttcctataccaggttgttcctgattctgaacattgctattttctttgtcatgttggcaatgcaactgacttatttccagagggcccagagcctacatggccaaagatgtctttatgcagttcttctcatagatagctgtattttattatggttgtactcttcttgttcccaatcacagtgttagcactgaagctataaattacctggtcattttgtgatcacaagagtctatgcaaaaaaaaaaatttctttaccccagattatcagatttttttccctcagattcattttaacaaattaagggaagatattttgacacaagaaagcaggaacgtggagaaattggagcaggaaaagaaattatcaaagcaatagaaatagcttggtggtcctatggtgtttttggaagtatttggcattgctaattgagcagtccatatagtactacttttagaagaaacaaaaagtctattttttaaagtaatgttttttcttatgagaaaaaggtttagatagaattgggttttattaatattaatttaatgctattagcaatttccatatactatattgtggaaaagactgaagaatacaattctgagaaatataaaaaaattttaatggtatactcatgttgaaagataaatgttgctaagtcctggtatgatggtgtgagcttccttggggaagtacttcttgagttatgtaactaacaggatgttttactacagatctggatggctattcagataacatggcaaaaaatgatagcagaagatcattaaaaacttaaaatatattttattagaaaacatttatctatgaatgaatatttccttgatgctggtctctgcacacatatgcttggttacttgcatgcattcattggttgttcaataagtgagatgattacagataatactgtattttccttatatggaaaaccgttatagacccaataacaactaaacctttcaaaagaaaatattttctattatgaatgttgattttcataccaaagaagatggagagtctaaaatttggatatgattcttatgtttttttaatagaaaaccttcttcaagtttattttcctaaataaacatcataattgtg

SEQ ID NO: 8200 - DNA, 694 bp, Homo sapiens
gcggacgacccaccttgagatgcatctagcgactgctcccagcatgtaggagcagttgtaaaatcacagccgtaacagtgcctgctctccagtgtctgaaaacaaatgtttttctggtcttcacttttttgaggcaggaaggatctttcgaagatggtttggctgccttggagatttggagatctgatgccacgatgaggactcacacacggggggctcccagtgtgtttttcatatatttgctttgctttgtgtcagcctacatcaccgacgagaacccagaagttatgattcccttcaccaatgccaactacgacagccatcccatgctgtacttctccagggcagaagtggcggagctgcagctcagggctgccagctcgcacgagcacattgcagcccgcctcacggaggctgtgcacacgatgctgtccagccccttggaatacctccctccctgggatcccaaggactacagtgcccgctggaatgaaatttttggaaacaacttgggtgccttggcaatgttctgtgtgctgtatcctgagaacattgaagcccgagacatggccaaagactacatggagaggatggcagcgcagcctagttggttggtgaaagatgctccttgggatgaggtcccgcttgctcactccctggttggttttgccactgcttatgacttcttgtacaa

SEQ ID NO: 8201 - DNA, 4003 bp, Homo sapiens
gcggacgacccaccttgagatgcatctagcgactgctcccagcatgtaggagcagttgtaaaatcacagccgtaacagtgcctgctctccagtgtctgaaaacaaatgtttttctggtcttcacttttttgaggcaggaaggatctttcgaagatggtttggctgccttggagatttggagatctgatgccacgatgaggactcacacacggggggctcccagtgtgtttttcatatatttgctttgctttgtgtcagcctacatcaccgacgagaacccagaagttatgattcccttcaccaatgccaactacgacagccatcccatgctgtacttctccagggcagaagtggcggagctgcagctcagggctgccagctcgcacgagcacattgcagcccgcctcacggaggctgtgcacacgatgctgtccagccccttggaatacctccctccctgggatcccaaggactacagtgcccgctggaatgaaatttttggaaacaacttgggtgccttggcaatgttctgtgtgctgtatcctgagaacattgaagcccgagacatggccaaagactacatggagaggatggcagcgcagcctagttggttggtgaaagatgctccttgggatgaggtcccgcttgctcactccctggttggttttgccactgcttatgacttcttgtacaactacctgagcaagacacaacaggagaagtttcttgaagtgattgccaatgcctcagggtatatgtatgaaacttcatacaggagaggatggggatttcaatacctgcacaatcatcagcccaccaactgtatggctttgctcacgggaagcctagtcctgatgaatcaaggatatcttcaagaagcctacttatggaccaaacaagttctgaccatcatggagaaatctctggtcttgctcagggaggtgacggatggctccctctatgaaggagttgcgtatggcagctacaccactagatcactcttccaatacatgtttctcgtccagaggcacttcaacatcaaccactttggccatccgtggcttaaacaacactttgcatttatgtatagaaccatcctgccagggtttcaaaggactgtggctattgcggactcaaattacaactggttttatggtccagaaagccaattagtgttccttgataaatttgtcatgcgtaatggcagtggtaactggctagctgaccaaatcagaaggaaccgtgtggtggaaggtccaggaacaccatccaaagggcagcgctggtgcactctgcacacagaatttctctggtatgatggcagcttgaaatcggttcctcctccagactttggcacccctacactgcattattttgaagactggggtgtcgtgacttatggaagtgcactacctgcagaaatcaatagatctttcctttccttcaagtctggaaaactggggggacgtgcaatatatgacattgtccacagaaacaaatacaaagattggatcaaaggatggagaaattttaatgcagggcatgaacatcctgatcaaaactcatttacttttgctcccaatggtgtgcctttcattactgaggctctgtacgggccaaagtacaccttcttcaacaatgttttgatgttttccccagctgtgtcaaagagctgcttttctccctgggtgggtcaggtcacagaagactgctcatcaaaatggtctaaatacaagcatgacctggcagctagttgtcaggggagggtggttgcagcagaggagaaaaatggggtggttttcatccgaggagaaggtgtgggagcttataacccccagctcaacctgaagaatgttcagaggaatctcatcctcctacatccacagctgcttctccttgtagaccaaatacacctgggagaggagagtcccttggagacagcagcgagcttcttccataatgtggatgttccttttgaggagactgtggtagatggtgtccatggggctttcatcaggcagagagatggtctctataaaatgtactggatggacgatactggctacagcgagaaagcaacctttgcctcagtgacatatcctcggggctatccctacaatgggacaaactatgtgaatgtcaccatgcacctccgaagtcccatcaccagggcagcttacctcttcatagggccatctatagatgttcagagcttcactgtccacggagactctcagcaactggatgtgttcatagccaccagcaaacatgcctacgccacatacctgtggacaggtgaggccacaggacagtctgcctttgcacaggtcattgctgatcgtcacaaaattctgtttgaccggaattcagccatcaagagcagcattgtccctgaggtgaaggactatgctgctattgtggaacagaacttgcagcattttaaaccagtgtttcagctgctggagaagcagatactgtcccgagtccggaacacagctagctttaggaagactgctgaacgcctgctgagattttcagataagagacagactgaggaggccattgacaggatttttgccatatcacagcaacagcagcagcaaagcaagtcaaagaaaaaccgaagggcaggcaaacgctataaatttgtggatgctgtccctgatatttttgcacagattgaagtcaatgagaaaaagattagacagaaagctcagattttggcacagaaagaactacccatagatgaagatgaagaaatgaaagaccttttagattttgcagatgtaacatacgagaaacataaaaatgggggcttgattaaaggccggtttggacaggcacggatggtgacaactacacacagcagggccccatcactgtctgcttcctataccaggttgttcctgattctgaacattgctattttctttgtcatgttggcaatgcaactgacttatttccagagggcccagagcctacatggccaaagatgtctttatgcagttcttctcatagatagctgtattttattatggttgtactcttcttgttcccaatcacagtgttagcactgaagctataaattacctggtcattttgtgatcacaagagtctatgcaaaaaaaaaaatttctttaccccagattatcagatttttttccctcagattcattttaacaaattaagggaagatattttgacacaagaaagcaggaacgtggagaaattggagcaggaaaagaaattatcaaagcaatagaaatagcttggtggtcctatggtgtttttggaagtatttggcattgctaattgagcagtccatatagtactacttttagaagaaacaaaaagtctattttttaaagtaatgttttttcttatgagaaaaaggtttagatagaattgggttttattaatattaatttaatgctattagcaatttccatatactatattgtggaaaagactgaagaatacaattctgagaaatataaaaaaattttaatggtatactcatgttgaaagataaatgttgctaagtcctggtatgatggtgtgagcttccttggggaagtacttcttgagttatgtaactaacaggatgttttactacagatctggatggctattcagataacatggcaaaaaatgatagcagaagatcattaaaaacttaaaatatattttattagaaaacatttatctatgaatgaatatttccttgatgctggtctctgcacacatatgcttggttacttgcatgcattcattggttgttcaataagtgagatgattacagataatactgtattttccttatatggaaaaccgttatagacccaataacaactaaacctttcaaaagaaaatattttctattatgaatgttgattttcataccaaagaagatggagagtctaaaatttggatatgattcttatgtttttttaatagaaaaccttcttcaagtttattttcctaaataaacatcataattgtg

SEQ ID NO: 8202 - DNA, 3487 bp, Homo sapiens
aggaattggatggaggtgcccttcagaactcatggagaaaagcactgctcccagtaaaatatctctcattctaatgaatgggatctttcgaagatggtttggctgccttggagatttggagatctgatgccacgatgaggactcacacacggggggctcccagtgtgtttttcatatatttgctttgctttgtgtcagcctacatcaccgacgagaacccagaagttatgattcccttcaccaatgccaactacgacagccatcccatgctgtacttctccagggcagaagtggcggagctgcagctcagggctgccagctcgcacgagcacattgcagcccgcctcacggaggctgtgcacacgatgctgtccagccccttggaatacctccctccctgggatcccaaggactacagtgcccgctggaatgaaatttttggaaacaacttgggtgccttggcaatgttctgtgtgctgtatcctgagaacattgaagcccgagacatggccaaagactacatggagaggatggcagcgcagcctagttggttggtgaaagatgctccttgggatgaggtcccgcttgctcactccctggttggttttgccactgcttatgacttcttgtacaactacctgagcaagacacaacaggagaagtttcttgaagtgattgccaatgcctcagggtatatgtatgaaacttcatacaggagaggatggggatttcaatacctgcacaatcatcagcccaccaactgtatggctttgctcacgggaagcctagtcctgatgaatcaaggatatcttcaagaagcctacttatggaccaaacaagttctgaccatcatggagaaatctctggtcttgctcagggaggtgacggatggctccctctatgaaggagttgcgtatggcagctacaccactagatcactcttccaatacatgtttctcgtccagaggcacttcaacatcaaccactttggccatccgtggcttaaacaacactttgcatttatgtatagaaccatcctgccagggtttcaaaggactgtggctattgcggactcaaattacaactggttttatggtccagaaagccaattagtgttccttgataaatttgtcatgcgtaatggcagtggtaactggctagctgaccaaatcagaaggaaccgtgtggtggaaggtccaggaacaccatccaaagggcagcgctggtgcactctgcacacagaatttctctggtatgatggcagcttgaaatcggttcctcctccagactttggcacccctacactgcattattttgaagactggggtgtcgtgacttatggaagtgcactacctgcagaaatcaatagatctttcctttccttcaagtctggaaaactggggggacgtgcaatatatgacattgtccacagaaacaaatacaaagattggatcaaaggatggagaaattttaatgcagggcatgaacatcctgatcaaaactcatttacttttgctcccaatggtgtgcctttcattactgaggctctgtacgggccaaagtacaccttcttcaacaatgttttgatgttttccccagctgtgtcaaagagctgcttttctccctgggtgggtcaggtcacagaagactgctcatcaaaatggtctaaatacaagcatgacctggcagctagttgtcaggggagggtggttgcagcagaggagaaaaatggggtggttttcatccgaggagaaggtgtgggagcttataacccccagctcaacctgaagaatgttcagaggaatctcatcctcctacatccacagctgcttctccttgtagaccaaatacacctgggagaggagagtcccttggagacagcagcgagcttcttccataatgtggatgttccttttgaggagactgtggtagatggtgtccatggggctttcatcaggcagagagatggtctctataaaatgtactggatggacgatactggctacagcgagaaagcaacctttgcctcagtgacatatcctcggggctatccctacaatgggacaaactatgtgaatgtcaccatgcacctccgaagtcccatcaccagggcagcttacctcttcatagggccatctatagatgttcagagcttcactgtccacggagactctcagcaactggatgtgttcatagccaccagcaaacatgcctacgccacatacctgtggacaggtgaggccacaggacagtctgcctttgcacaggtcattgctgatcgtcacaaaattctgtttgaccggaattcagccatcaagagcagcattgtccctgaggtgaaggactatgctgctattgtggaacagaacttgcagcattttaaaccagtgtttcagctgctggagaagcagatactgtcccgagtccggaacacagctagctttaggaagactgctgaacgcctgctgagattttcagataagagacagactgaggaggccattgacaggatttttgccatatcacagcaacagcagcagcaaagcaagtcaaagaaaaaccgaagggcaggcaaacgctataaatttgtggatgctgtccctgatatttttgcacagattgaagtcaatgagaaaaagattagacagaaagctcagattttggcacagaaagaactacccatagatgaagatgaagaaatgaaagaccttttagattttgcagatgtaacatacgagaaacataaaaatgggggcttgattaaaggccggtttggacaggcacggatggtgacaactacacacagcagggccccatcactgtctgcttcctataccaggttgttcctgattctgaacattgctattttctttgtcatgttggcaatgcaactgacttatttccagagggcccagagcctacatggccaaagatgtctttatgcagttcttctcatagatagctgtattttattatggttgtactcttcttgttcccaatcacagtgttagcactgaagctataaattacctggtcattttgtgatcacaagagtctatgcaaaaaaaaaaatttctttaccccagattatcagatttttttccctcagattcattttaacaaattaagggaagatattttgacacaagaaagcaggaacgtggagaaattggagcaggaaaagaaattatcaaagcaatagaaatagcttggtggtcctatggtgtttttggaagtatttggcattgctaattgagcagtccatatagtactacttttagaagaaacaaaaagtctattttttaaagtaatgttttttcttatgagaaaaaggtttagatagaattgggttttattaatattaatttaatgctattagcaatttccatatactatattgtggaaaagactgaagaatacaattctgagaaatataaaaaaattttaatggtatactcatgttgaaagataaatgttgctaagtcct

SEQ ID NO: 8203 - DNA, 1130 bp, Homo sapiens
ctgcgcggttgactacgcttatcaatccatcgtattcctttgtcttcttgtcacaaaaagaatttcgtcagtctggaaggggagttttacttacgtaaatggatgtagaccagactcaagcatggctgccctgaagggcagacaggtttattgggcaacagctgggaaaatcagcggttggacttggccacatgctccaagaaggccacacgtccttcttcttaatggcataggagttggaggagcccttggcagcattgatgagctcctctgccaggcactcagcaatggtcttaatgttccggaaggcagcctcacgagcacctgtgcacagcagccagatggcctgattcacacggcgaagtggggacacgtccacagcctgtcgtctcacagtcccggcgcacccaatgcgtgtggagtcctcccggggaccactgttgatgatggcgttcaccaggacctgcagagggttctcgcctgtgagcaggtgtatgacctcgaaggcatgcttgacgatgcacacagtcatgagcttcttgccgttgttgcagccgtgcatcatcatggagttagtaaggcgctccacaatgggacactgagctttgtggaagcatttggcggcataccaccctgcactgtgaggatctttcgaagatggtttggctgccttggagatttggagatctgatgccacgatgaggactcacacacggggggctcccagtgtgtttttcatatatttgctttgctttgtgtcagcctacatcaccgacgagaacccagaagttatgattcccttcaccaatgccaactacgacagccatcccatgctgtacttctccagggcagaagtggcggagctgcagctcagggctgccagctcgcacgagcacattgcagcccgcctcacggaggctgtgcacacgatgctgtccagccccttggaatacctccctccctgggatcccaaggactacagtgcccgctggaatgaaatttttggaaacaacttgggtgccttggcaatgttctgtgtgctgtatcctgagaacattgaagcccgagacatggccaaagactacatggagaggatggcagcgcagcctagttggttggtgaaagatgct

SEQ ID NO: 8204 - DNA, 9531 bp, Homo sapiens
acctgctttcggccccgccccgcccgccgccggcctgctcacggctcctcccgtcctccccgaagccccgcctctgaccccgccctgtcctgtctccgtcccgccccacgcccgccagccagcgtcgctgtctctcgccttccctgaggccccgccttcagccccgccttcaaccccgccccgtcctgcctccgccccgcccccgcttgccggcccgcgtcgccgtctcaccctccccgggctgcgcggccggagctggcacagaggatcctcggccgcggcgacatcaccgcctgggcacgcgggcgctgctctggatacggcgccaccgagagaacccgccgcccgcgggtctctgtcctgcggtccgtggttgcccccacaagcgtccggcgtttcctgagggcgggcgtgtccgggccgtgcgggtcgcggggaccgagcgcggctgaggagaccgagctggggcagcgcctgccgtagcgcgggagacgacgcgggggtcttgcggagccccgcgggagcctggcccgccgtgcagagcagttttctggaactctccacctccgtctcccttggggcccagtgcggcgccgagcccccgtcgggatctgcctgagaaaagtgtcatgaaaaaagagcagaagagagacctcactgttgctgaaaggggaattttctttccccgttggcggttacttcatgatcggacgagaagtatctaggtgactgaagatattccatttttatgtttgtacacatgaagctgataaaagaagatgtgaacatgatttctctttgtcataataggctgatgagtaagtaagcctgaaaaatatttgaaatgaaggcaagaattttgaatttttaaaaaccaactaagactttgatcacttgttgaggatgtttctctctcataaatgaaagaaaaacgtattcacaagacaagaagtataaaaagttgagaggaatgacaactgagtccactcactcgaagaatgtcagtacttcatcatcttctttgggcaaacatacacaaatgcatcatacatgtgtggtgagcttatcaccagtgatggttttctgtgctagaaatgactcttaatttgaattttggagtgctttttctctttttttacaatgtgtgttccaactctttgtgttaaatagatttaagtaaaggaggtaaatgctaaattcatagtgttttttacctgtatcacttccctgtgtattatggaaaaattagagattttaacgttattcaaagttttactggaagcaaaactgtgccagggacagagatatacaatttaagttttctctttttggcaactgcacttgcttaaaatgtactgaatgtcagctggatttcacagcatatcagatttacagtctttgtcttatcaaggcctttactgtatgttttatactaaccagatgggaaacacattgagcatcatatctgacatgtatgcctaagggaggagctcccccatggatcatggcgttaatgtttacaggacatttactattcttagcattattgatgtttgctttctctacttttgaggaatctgtgagcaattattccgaatgggcagttttcacagatgatatagatcagtttaaaacacagaaagtgcaagatttcagacccaaccaaaagctgaagaaaagtatgcttcatccaagtttatattttgatgctggagaaatccaagcaatgagacaaaagtctcgtgcaagccatttgcatctttttagagctatcagaagtgcagtgacagttatgctgtccaacccaacatactacctacctccaccaaagcatgctgattttgctgccaagtggaatgaaatttatggtaacaatctgcctcctttagcattgtactgtttgttatgcccagaagacaaagttgcctttgaatttgtcttggaatatatggacaggatggttggctacaaagactggctagtagagaatgcaccaggagatgaggttccaattggccattccttaacaggttttgccactgcctttgactttttatataacttattagataatcatcgaagacaaaaatacctggaaaaaatatgggttattactgaggaaatgtacgagtattccaaggtccgctcatggggcaaacagcttctccataaccaccaagccactaatatgatagcattactcacaggggccttggtgactggagtagataaaggatctaaagcaaatatatggaaacaggctgtagtggatgtcatggaaaagacaatgtttctattgaatcatattgttgatggttctttggatgaaggtgtggcctatggaagctacacagctaaatccgtcacacagtatgtttttctggcccagcgccattttaatatcaacaacttggataataactggttaaagatgcacttttggttctattatgccacccttttacctggcttccaaagaactgtgggtatagcagattccaattataattggttttatggtccagaaagccagctagttttcttggataagttcatcttaaagaatggagctggaaattggttagctcagcaaattagaaagcaccgacctaaagatggaccgatggttccttcaactgcccaaaggtggagtactcttcacactgaatacatctggtatgatccccagctcacaccacagccacctgctgattatggtactgcaaaaatacacacattccctaactggggtgtggttacttatggggctgggttgccaaacacacagaccaacacctttgtgtcttttaaatctgggaagctggggggacgagctgtgtatgacatagttcattttcagccatattcctggattgatgggtggagaagttttaacccaggacatgagcatccagatcagaactcatttacttttgcccccaatggacaagtatttgtttctgaagctctctatggacccaagttgagccaccttaacaatgtattggtgtttgctccatcaccctcaagccagtgtaataagccctgggaaggtcaactgggagaatgtgcgcagtggcttaagtggactggcgaggaggttggtgatgcagctggggaaataatcactgcctctcaacatggggaaatggtatttgtgagtggggaagccgtgtctgcttattcttcagcaatgagactgaaaagtgtatatcgtgctttgcttctcttaaattcccaaactctgctagttgttgatcatattgagaggcaagaagattccccaataaattctgtcagtgccttctttcataatttggatattgattttaaatatatcccatataagtttatgaataggtataatggtgccatgatggatgtgtgggatgcacattacaaaatgttttggtttgatcatcatggcaatagtcccatggccagtatacaggaagcagagcaagctgctgaatttaaaaaacgatggactcaatttgttaatgttacttttcagatggaacccacaatcacaagaattgcatatgtcttttatgggccatatatcaatgtctccagctgcagatttattgatagttccaatcctggacttcagatttctctcaatgtcaataatactgaacatgttgtttctattgtaactgattaccataacctgaagacaagattcaattatctgggattcggtggctttgccagtgtggctgatcaaggccaaataacccgatttggtttgggcactcaagcaatagtaaagcctgtaagacatgataggattattttcccctttggatttaaatttaatatagcagttggattaattttgtgcattagcttggtgattttaactttccaatggcgtttttacctttcttttagaaaactaatgcgatggatattaatacttgttattgccttgtggtttattgagcttttggatgtgtggagcacttgtagtcagcccatttgtgcaaaatggacaaggacagaggctgagggaagcaagaagtctttgtcttctgaagggcaccacatggatcttcctgatgttgtcattacctcacttcctggttcaggagctgaaattctcaaacaactttttttcaacagtagtgattttctctacatcagggttcctacagcctacattgatattcctgaaactgagttggaaatcgactcatttgtagatgcttgtgaatggaaggtgtcagatatccgcagtgggcattttcgtttactccgaggctggttgcagtctttagtccaggacacaaaattacatttgcaaaacatccatctgcatgaacccaataggggtaaactggcccaatattttgcaatgaataaggacaaaaaaagaaaatttaaaaggagagagtctttgccagaacaaagaagtcaaatgaaaggcgcctttgatagagatgctgaatatattagggctttgaggagacacctggtttactatccaagtgcacgtcctgtgctcagtttaagcagtggaagctggacgttaaagcttcatttttttcaggaagttttaggagcttcgatgagggcattgtacatagtaagagaccctcgggcatggatttattcaatgttgtacaatagtaaaccaagtctttattctttgaagaatgtaccagagcatttagcaaaattgtttaaaatagagggaggtaaaggcaaatgtaacttaaattcgggttatgctttcgagtatgaaccattgaggaaagaattatcaaaatccaaatcaaatgcagtgtccctcttgtctcacttgtggctagcaaatacagcagcagccttgagaataaatacagatttgctgcctactagctaccagctggtcaagtttgaagatattgtgcattttcctcagaaaactactgaaaggatttttgcctttcttggaattcctttgtctcctgctagtttaaaccaaatattgtttgccacctctacaaaccttttttaccttccctatgaaggggaaatatcaccaactaatactaatgtttggaaacagaacttgcctagagatgaaattaaactaattgaaaacatctgctggactctgatggatcgcctaggatatccaaagtttatggactaaatgctgcaggtcagcagaaatttgcactaataatacttaccaacccactttgtggatatgaatcagaagagtttgtttattctttagtgtgtgtgtgtgtgtgcacgcgtgtatgtgttcagtgttgtttgcacagagagattgttttaaaaaatggcaccatatttggcctagcaggatttatttttatgtcatcacctcccttgcctttgtttctgaaaattttgtctgctaaaaagtttctgctacagagtggtagatgaagttatatcatggggtcaggggagatgggaaaattttaagtttttgtctaactccccttcatctgtaactgtgctaatctatctagagacctcaaacactgctaaaggccttgcaattgctgctttacccacgcatctcttgctttcaagatggactacaaaagttccttatccttttgaaaaggtcttctgacacacttatcttgcacaaagaaaaagaaaatttcttttactgtgtttaatgttcagtgatatcactgaggaaatggtgaaagctcctatcagaactataggatttcttctgggaaatacagatggaaatacagaatgaatatgtttttttgaggtcggaaactgactttaaaagcctccttgaagttttttacttagaaatataaggaataagtctttgaacaatctgggtggcaagggctggtagattattttagacatgattgtctgtttaaaactctcctttcactttttatcctccctggagctacagctgttcgccatcacatcactcccatcctatcctttctgtcactgtcaagcaaaacaatcagtagttactaatcgctgaactctcaatattgtggggcattttccccccagttgattaattttgcgttaaagactgacacagacttagaatcaaatttatttttctggaattaacactctgtgactcaaagtagtgccactgcagtgtctttttaaactggaaacagaattggaaaactgcctgacttatcttgcatccctttgaatgagtttacagactgccagtgtctgcaaaagttgaaagcaaatgggagatgatgtcagaggcatctgtttcctttaccatctgcatcttattataaatgtagtcgtcataaagtgtggtttattttattttggtaggctctgaaatcaaaatgctacgccattataagccagtggagtaattacaatgtattggatgaaaacataaggcagtgtggagacttgatgaaaatctctgtacagattgcagtcttcttcctgatgtttcaaactgtggttcccccaagctctctaacacttggaagtctgtcattctgacctagataaaagtggttctttctcagtagttattattatgtcaaaatgtgcctccagagtgataaagctctgtatatgttagattccagctaaacctaacttggctgtcatttttcttccattatagtgtgagtggagactgccccccctccccaacatattccttcccatatctctcatgattgtccctctgtaatttcaaaatgaatgaaattcatgtgaatgtaggttgagagggcactgaagacctgaatctacactagtaatctcaagaaagattattcattctatctcagagttaccggcaagcatataaaatgctacttggataatatctacatgaatattgcatgctacatggttgataacactatttccattattgggcagaatctcagtgtttactttcaattcctaggatatgtgatcgtgaatcagatcacatataaaaagtctggattgtcagtagtattagatctgatcaaggtaggaattacaattgcatgcaggtagcaagcaagaaagcagaaactactgttccctttattttaacattgtacagacaatacagaaatgtacctgttggcggccgggtgcagtggctcacgcctgtaatcccagcacttcgggaggccgaggcgggtggatcacgaggtcaggagatcaagaccatcctggctaacacggtgaaaccccgtctctactaaaaaaaaaagtacaaaaaattagccgggcgtggtggcgggcacctgtagtcccagctacacgggaggctgaggcaggagaatggcatgaacctgggaggcagagcttgcagtgagtggagatgcgccactgcactccagcctgggcgacagagcgagactccgcctcaaaaaaaaaaaaaaaagaaaaaaagaaatgtacctgttggcaggagaaggccagatggagtatgtggagtaatagggaaagaagagttacagaaaatgaaaaagaaaatgagttacactgagaatgaatatgggaacacgtcattgatagcaaaagaaaggtacaggcttacgaaaatgatctttacaatgtatcccagctttcacccccacatggcaatgcagagttgtatttacttgtttctgtactcacctactcccaccccaagggaaaattttagacatgaaccctactatttagttattctaaaatagaaagtttgctggagaaagcgtccactcacagattgttctgtaaggaatgttatgtatgggtgagcgggtgacacatccattgggtatgtatgcatgtgatggtgcctgagacccctgccttagaaacagaattcctaaggggattgactctcccagcatgttcccaggtcctgcacccttagggtgatctaggaaaattttaaatagcttctactcttatttttgttctttgaaataattaaaagagggattatcactatctgatacttctgaaagaaacacttacaaaatttcttatctgtaaaatccgtctttttctacattaacttccccaaacataggcctaattgagataattgcttttattataataataggattgaaattttaaaattttgaaaggacttattaattttgctgacaaaagtgaagtaacaaatataatgataattggctttttaaattttcaaacaacatagatttactcaagatgaaataaaaaggccatattcagagttgaatttaatgaaaactcagaggaaataggaaaatctgctcaggagaaagaagctaaatctgcatagatttagtttgtagaatttaatttaaaatttaaattttaacaaagtgatgacacaacaatatgtacgtttaggtgtggacaccaaaatattagacatttgattgtccttttacatagagaataactaataaatgcctgacaagaatgggacaatccttccttgtatcaaaattcccaggtcttgctacattgccctctgcaaatgtattcaaagaagaacctcctccaccacttacttttggttggcataattgttcagcaacgatttctgtacatcaccaagtatctttggcattcttggtatacaaagtatatcacaattttaagtgagtaaatattaatgataatttttgaattgctttgtttggcttgattaactttgatcagaaatagaaacgttttcatttgttgatttaggaaaaagcataaatagaatgcagtataacaccacttccaaaggtaaggatacctaacattcttttttttttttttttttttttttttgggatggagtctcactttgttgcccaggctggagtgcagtggtctgatctcggctcactgcaacctccgcctaccgggttcaagtgattctcctacgtcagcctcctgaatagctgggattacaggtgcacgccaccatgcttggctcatttttgtatttttagtagtgacagcgtttcaccacattggtcaggctggtctcaatctcttgacctggtgatctgcccacctgggcctcccaaaatgctgggattacaggcatgagccaccacacctggcaagggtacctgacattctaagatatcaagacacttaatatgtgggctattagctgcttatttaaatgttgaccaaattgtctgatatatctgattaatcatgatttcacttcatttcggaagaaaaattatccatatcatttttaaagacgcaaatgactttggatttttgcatagagtacaatagacacttcaaacaatagattctaacattctctgaaacacttgagatgtttgagctaccatttatatgggttatttatatttagtctaagtaacacatacatgtttaattgattctgttttcatggatagattcaactaagtcttccaagcaattaattttttgttcgtcgtcgtttttccttcatacgttatctagttatgcagcactggaaacagactgaagatcataaaccagttttatcagacctatgtgtaataagactcctgttaatacaaaaataaaaagctaaaagcaacttgt

SEQ ID NO: 8205 - DNA, 9525 bp, Homo sapiens
acctgctttcggccccgccccgcccgccgccggcctgctcacggctcctcccgtcctccccgaagccccgcctctgaccccgccctgtcctgtctccgtcccgccccacgcccgccagccagcgtcgctgtctctcgccttccctgaggccccgccttcagccccgccttcaaccccgccccgtcctgcctccgccccgcccccgcttgccggcccgcgtcgccgtctcaccctccccgggctgcgcggccggagctggcacagaggatcctcggccgcggcgacatcaccgcctgggcacgcgggcgctgctctggatacggcgccaccgagagaacccgccgcccgcgggtctctgtcctgcggtccgtggttgcccccacaagcgtccggcgtttcctgagggcgggcgtgtccgggccgtgcgggtcgcggggaccgagcgcggctgaggagaccgagctggggcagcgcctgccgtagcgcgggagacgacgcgggggtcttgcggagccccgcgggagcctggcccgccgtgcagagcagttttctggaactctccacctccgtctcccttggggcccagtgcggcgccgagcccccgtcgggatctgcctgagaaagtgtcatgaaaaaagagcagaagagagacctcactgttgctgaaaggggaattttctttccccgttggcggttacttcatgatcggacgagaagtatctaggtgactgaagatattccatttttatgtttgtacacatgaagctgataaaagaagatgtgaacatgatttctctttgtcataataggctgatgagtaagtaagcctgaaaaatatttgaaatgaaggcaagaattttgaatttttaaaaaccaactaagactttgatcacttgttgaggatgtttctctctcataaatgaaagaaaaacgtattcacaagacaagaagtataaaaagttgagaggaatgacaactgagtccactcactcgaagaatgtcagtacttcatcatcttctttgggcaaacatacacaaatgcatcatacatgtgtggtgagcttatcaccagtgatggttttctgtgctagaaatgactcttaatttgaattttggagtgctttttctctttttttacaatgtgtgttccaactctttgtgttaaatagatttaagtaaaggaggtaaatgctaaattcatagtgttttttacctgtatcacttccctgtgtattatggaaaaattagagattttaacgttattcaaagttttactggaagcaaaactgtgccagggacagagatatacaatttaagttttctctttttggcaactgcacttgcttaaaatgtactgaatgtcagctggatttcacagcatatcagatttacagtctttgtcttatcaaggcctttactgtatgttttatactaaccagatgggaaacacattgagcatcatatctgacatgtatgcctaagggaggagctcccccatggatcatggcgttaatgtttacaggacatttactattcttagcattattgatgtttgctttctctacttttgaggaatctgtgagcaattattccgaatgggcagttttcacagatgatatagatcagtttaaaacacagaaagtgcaagatttcagacccaaccaaaagctgaagaaaagtatgcttcatccaagtttatattttgatgctggagaaatccaagcaatgagacaaaagtctcgtgcaagccatttgcatctttttagagctatcagaagtgcagtgacagttatgctgtccaacccaacatactacctacctccaccaaagcatgctgattttgctgccaagtggaatgaaatttatggtaacaatctgcctcctttagcattgtactgtttgttatgcccagaagacaaagttgcctttgaatttgtcttggaatatatggacaggatggttggctacaaagactggctagtagagaatgcaccaggagatgaggttccaattggccattccttaacaggttttgccactgcctttgactttttatataacttattagataatcatcgaagacaaaaatacctggaaaaaatatgggttattactgaggaaatgtacgagtattccaaggtccgctcatggggcaaacagcttctccataaccaccaagccactaatatgatagcattactcacaggggccttggtgactggagtagataaaggatctaaagcaaatatatggaaacaggctgtagtggatgtcatggaaaagacaatgtttctattgaatcatattgttgatggttctttggatgaaggtgtggcctatggaagctacacagctaaatccgtcacacagtatgtttttctggcccagcgccattttaatatcaacaacttggataataactggttaaagatgcacttttggttctattatgccacccttttacctggcttccaaagaactgtgggtatagcagattccaattataattggttttatggtccagaaagccagctagttttcttggataagttcatcttaaagaatggagctggaaattggttagctcagcaaattagaaagcaccgacctaaagatggaccgatggttccttcaactgcccaaaggtggagtactcttcacactgaatacatctggtatgatccccagctcacaccacagccacctgctgattatggtactgcaaaaatacacacattccctaactggggtgtggttacttatggggctgggttgccaaacacacagaccaacacctttgtgtcttttaaatctgggaagctggggggacgagctgtgtatgacatagttcattttcagccatattcctggattgatgggtggagaagttttaacccaggacatgagcatccagatcagaactcatttacttttgcccccaatggacaagtatttgtttctgaagctctctatggacccaagttgagccaccttaacaatgtattggtgtttgctccatcaccctcaagccagtgtaataagccctgggaaggtcaactgggagaatgtgcgcagtggcttaagtggactggcgaggaggttggtgatgcagctggggaaataatcactgcctctcaacatggggaaatggtatttgtgagtggggaagccgtgtctgcttattcttcagcaatgagactgaaaagtgtatatcgtgctttgcttctcttaaattcccaaactctgctagttgttgatcatattgagaggcaagaagattccccaataaattctgtcagtgccttctttcataatttggatattgattttaaatatatcccatataagtttatgaataggtataatggtgccatgatggatgtgtgggatgcacattacaaaatgttttggtttgatcatcatggcaatagtcccatggccagtatacaggaagcagagcaagctgctgaatttaaaaaacgatggactcaatttgttaatgttacttttcagatggaacccacaatcacaagaattgcatatgtcttttatgggccatatatcaatgtctccagctgcagatttattgatagttccaatcctggacttcagatttctctcaatgtcaataatactgaacatgttgtttctattgtaactgattaccataacctgaagacaagattcaattatctgggattcggtggctttgccagtgtggctgatcaaggccaaataacccgatttggtttgggcactcaagcaatagtaaagcctgtaagacatgataggattattttcccctttggatttaaatttaatatagcagttggattaattttgtgcattagcttggtgattttaactttccaatggcgtttttacctttcttttagaaaactaatgcgatggatattaatacttgttattgccttgtggtttattgagcttttggatgtgtggagcacttgtagtcagcccatttgtgcaaaatggacaaggacagaggctgagggaagcaagaagtctttgtcttctgaagggcaccacatggatcttcctgatgttgtcattacctcacttcctggttcaggagctgaaattctcaaacaactttttttcaacagtagtgattttctctacatcagggttcctacagcctacattgatattcctgaaactgagttggaaatcgactcatttgtagatgcttgtgaatggaaggtgtcagatatccgcagtgggcattttcgtttactccgaggctggttgcagtctttagtccaggacacaaaattacatttgcaaaacatccatctgcatgaacccaataggggtaaactggcccaatattttgcaatgaataaggacaaaaaaagaaaatttaaaaggagagagtctttgccagaacaaagaagtcaaatgaaaggcgcctttgatagagatgctgaatatattagggctttgaggagacacctggtttactatccaagtgcacgtcctgtgctcagtttaagcagtggaagctggacgttaaagcttcatttttttcaggaagttttaggagcttcgatgagggcattgtacatagtaagagaccctcgggcatggatttattcaatgttgtacaatagtaaaccaagtctttattctttgaagaatgtaccagagcatttagcaaaattgtttaaaatagagggaggtaaaggcaaatgtaacttaaattcgggttatgctttcgagtatgaaccattgaggaaagaattatcaaaatccaaatcaaatgcagtgtccctcttgtctcacttgtggctagcaaatacagcagcagccttgagaataaatacagatttgctgcctactagctaccagctggtcaagtttgaagatattgtgcattttcctcagaaaactactgaaaggatttttgcctttcttggaattcctttgtctcctgctagtttaaaccaaatattgtttgccacctctacaaaccttttttaccttccctatgaaggggaaatatcaccaactaatactaatgtttggaaacagaacttgcctagagatgaaattaaactaattgaaaacatctgctggactctgatggatcgcctaggatatccaaagtttatggactaaatgctgcaggtcagcagaaatttgcactaataatacttaccaacccactttgtggatatgaatcagaagagtttgtttattctttagtgtgtgtgtgtgtgtgcacgcgtgtatgtgttcagtgttgtttgcacagagagattgttttaaaaaatggcaccatatttggcctagcaggatttatttttatgtcatcacctcccttgcctttgtttctgaaaattttgtctgctaaaaagtttctgctacagagtggtagatgaagttatatcatggggtcaggggagatgggaaaattttaagtttttgtctaactccccttcatctgtaactgtgctaatctatctagagacctcaaacactgctaaaggccttgcaattgctgctttacccacgcatctcttgctttcaagatggactacaaaagttccttatccttttgaaaaggtcttctgacacacttatcttgcacaaagaaaaagaaaatttcttttactgtgtttaatgttcagtgatatcactgaggaaatggtgaaagctcctatcagaactataggatttcttctgggaaatacagatggaaatacagaatgaatatgtttttttgaggtcggaaactgactttaaaagcctccttgaagttttttacttagaaatataaggaataagtctttgaacaatctgggtggcaagggctggtagattattttagacatgattgtctgtttaaaactctcctttcactttttatcctccctggagctacagctgttcgccatcacatcactcccatcctatcctttctgtcactgtcaagcaaaacaatcagtagttactaatcgctgaactctcaatattgtggggcattttccccccagttgattaattttgcgttaaagactgacacagacttagaatcaaatttatttttctggaattaacactctgtgactcaaagtagtgccactgcagtgtctttttaaactggaaacagaattggaaaactgcctgacttatcttgcatccctttgaatgagtttacagactgccagtgtctgcaaaagttgaaagcaaatgggagatgatgtcagaggcatctgtttcctttaccatctgcatcttattataaatgtagtcgtcataaagtgtggtttattttattttggtaggctctgaaatcaaaatgctacgccattataagccagtggagtaattacaatgtattggatgaaaacataaggcagtgtggagacttgatgaaaatctctgtacagattgcagtcttcttcctgatgtttcaaactgtggttcccccaagctctctaacacttggaagtctgtcattctgacctagataaaagtggttctttctcagtagttattattatgtcaaaatgtgcctccagagtgataaagctctgtatatgttagattccagctaaacctaacttggctgtcatttttcttccattatagtgtgagtggagactgccccccctccccaacatattccttcccatatctctcatgattgtccctctgtaatttcaaaatgaatgaaattcatgtgaatgtaggttgagagggcactgaagacctgaatctacactagtaatctcaagaaagattattcattctatctcagagttaccggcaagcatataaaatgctacttggataatatctacatgaatattgcatgctacatggttgataacactatttccattattgggcagaatctcagtgtttactttcaattcctaggatatgtgatcgtgaatcagatcacatataaaaagtctggattgtcagtagtattagatctgatcaaggtaggaattacaattgcatgcaggtagcaagcaagaaagcagaaactactgttccctttattttaacattgtacagacaatacagaaatgtacctgttggcggccgggtgcagtggctcacgcctgtaatcccagcacttcgggaggccgaggcgggtggatcacgaggtcaggagatcaagaccatcctggctaacacggtgaaaccccgtctctactaaaaaaaaaagtacaaaaaattagccgggcgtggtggcgggcacctgtagtcccagctacacgggaggctgaggcaggagaatggcatgaacctgggaggcagagcttgcagtgagtggagatgcgccactgcactccagcctgggcgacagagcgagactccgcctcaaaaaaaaaaaaaaaagaaaaaaagaaatgtacctgttggcaggagaaggccagatggagtatgtggagtaatagggaaagaagagttacagaaaatgaaaaagaaaatgagttacactgagaatgaatatgggaacacgtcattgatagcaaaagaaaggtacaggcttacgaaaatgatctttacaatgtatcccagctttcacccccacatggcaatgcagagttgtatttacttgtttctgtactcacctactcccaccccaagggaaaattttagacatgaaccctactatttagttattctaaaatagaaagtttgctggagaaagcgtccactcacagattgttctgtaaggaatgttatgtatgggtgagcgggtgacacatccattgggtatgtatgcatgtgatggtgcctgagacccctgccttagaaacagaattcctaaggggattgactctcccagcatgttcccaggtcctgcacccttagggtgatctaggaaaattttaaatagcttctactcttatttttgttctttgaaataattaaaagagggattatcactatctgatacttctgaaagaaacacttacaaaatttcttatctgtaaaatccgtctttttctacattaacttccccaaacataggcctaattgagataattgcttttattataataataggattgaaattttaaaattttgaaaggacttattaattttgctgacaaaagtgaagtaacaaatataatgataattggctttttaaattttcaaacaacatagatttactcaagatgaaataaaaaggccatattcagagttgaatttaatgaaaactcagaggaaataggaaaatctgctcaggagaaagaagctaaatctgcatagatttagtttgtagaatttaatttaaaatttaaattttaacaaagtgatgacacaacaatatgtacgtttaggtgtggacaccaaaatattagacatttgattgtccttttacatagagaataactaataaatgcctgacaagaatgggacaatccttccttgtatcaaaattcccaggtcttgctacattgccctctgcaaatgtattcaaagaagaacctcctccaccacttacttttggttggcataattgttcagcaacgatttctgtacatcaccaagtatctttggcattcttggtatacaaagtatatcacaattttaagtgagtaaatattaatgataatttttgaattgctttgtttggcttgattaactttgatcagaaatagaaacgttttcatttgttgatttaggaaaaagcataaatagaatgcagtataacaccacttccaaaggtaaggatacctaacattcttttttttttttttttttttttttttgggatggagtctcactttgttgcccaggctggagtgcagtggtctgatctcggctcactgcaacctccgcctaccgggttcaagtgattctcctacgtcagcctcctgaatagctgggattacaggtgcacgccaccatgcttggctcatttttgtatttttagtagtgacagcgtttcaccacattggtcaggctggtctcaatctcttgacctggtgatctgcccacctgggcctcccaaaatgctgggattacaggcatgagccaccacacctggcaagggtacctgacattctaagatatcaagacacttaatatgtgggctattagctgcttatttaaatgttgaccaaattgtctgatatatctgattaatcatgatttcacttcatttcggaagaaaaattatccatatcatttttaaagacgcaaatgactttggatttttgcatagagtacaatagacacttcaaacaatagattctaacattctctgaaacacttgagatgtttgagctaccatttatatgggttatttatatttagtctaagtaacacatacatgtttaattgattctgttttcatggatagattcaactaagtcttccaagcaattaattttttgttcgtcgtcgtttttccttcatacgttatctagttatgcagcactggaaacagactgaagatcataaaccagttttatcagacctatgtgtaataagactcctgttaatacaaaaataaaaagctaaaagcaa

SEQ ID NO: 8206 - DNA, 1786 bp, Homo sapiens
acatctggaagccacatgtcagcggcagctatataaaacggtcagaccagcaatcttagagtgacattgtttgccaaaatcccaggcagcatggacctcagtcttctctgggtacttctgcccctagtcaccatggcctggggccagtatggcgattatggatacccataccagcagtatcatgactacagcgatgatgggtgggtgaatttgaaccggcaaggcttcagctaccagtgtccccaggggcaggtgatagtggccgtgaggagcatcttcagcaagaaggaaggttctgacagacaatggaactacgcctgcatgcccacgccacagagcctcggggaacccacggagtgctggtgggaggagatcaacagggctggcatggaatggtaccagacgtgctccaacaatgggctggtggcaggattccagagccgctacttcgagtcagtgctggatcgggagtggcagttttactgttgtcgctacagcaagaggtgcccatattcctgctggctaacaacagaatatccaggtcactatggtgaggaaatggacatgatttcctacaattatgattactatatccgaggagcaacaaccactttctctgcagtggaaagggatcgccagtggaagttcataatgtgccggatgactgaatacgactgtgaatttgcaaatgtttagatttgccacataccaaatctgggtgaaaggaaaggggccggggacaggagggtgtccacatatgttaacatcagttggatctcctatagaagtttctgctgctctctttccttctccctgagctggtaactgcaatgccaacttcctgggcctttctgactagtatcacacttctaataaaatccacaattaaaccatgtttctcacttttcacatgtttcatagcaactgctttatatgactgatgatggcttccttgcacaccacatatacagtgcgcatgcttacagccgggcttctggagcaccagctgcagcctggctactgctttttactgcagaatgaactgcaagttcagcatagtggaggggagaggcagaactggaggagaggtgcagtgaaggttctctacagctaagcctgtttgaatgatacgtaggttccccaccaaaagcaggctttctgccctgagggacatcttcccactcccctgctccacatgagccatgcatgcttagcaatccaagtgcagagctctttgctccaggagtgaggagactgggaggtgaaatggggaaatggaagggtttggaggcagagctgaaaacagggttggaaggatttcctgaattagaagacaaacgttagcatacccagtaaggaaaatgagtgcaggggccaggggaacccgtgaggatcactctcaaatgagattaaaaacaaggaagcagagaatggtcagagaatgggattcagattgggaacttgtggggatgagagtgaccaggttgaactgggaagtggaaaaaggagtttgagtcactggcacctagaagcctgcccacgattcctaggaaggctggcagacaccctggaaccctggggagctactggcaaactctcctggattgggcctgatttttttggtgggaaaggctgccctggggatcaactttccttctgtgtgtggctcaggagttcttctgcagagatggcgctatctttcctcctcctgtgatgtcctgctcccaaccatttgtactcttcattacaaaagaaataaaaatattaacgttcactatgctgaaaa

SEQ ID NO: 8207 - DNA, 645 bp, Homo sapiens
cagccagcctttgttgacttaacaggtggctctgaggtgggagaagaggaggaggagaacacaccactggaagactggttcccattggtccctgtcatgcttaaaaaaaggcccagagaggcagtcttgacaccctagatcccaagatctccaaggatttggtggcatacccactccagcacacagaagcatgaggttcatgactctcctcttcctgacagctctggcaggagccctggtctgtgcctatgatccagaggccgcctctgccccaggatcggggaacccttgccatgaagcatcagcagctcaaaaggaaaatgcaggtgaagacccagggttagccagacaggcaccaaagccaaggaagcagagatccagccttctggaaaaaggcctagacggagcaaaaaaagctgtggggggactcggaaaactaggaaaagatgcagtcgaagatctagaaagcgtgggtaaaggagccgtccatgacgttaaagacgtccttgactcagtactatagctgtaaggagaagctgagaaatgatacccaggagcagcaggctttacgtcttcagcctaaaacctaaaaaaaaaaaaaaaaaaaaaaatttaaaacagctattaaactgaaagcatctgtaa

SEQ ID NO: 8208 - DNA, 1936 bp, Homo sapiens
gtccggagtccgggcgttctggcagcaccagagtcctgcagcagagacgggctgggctggcactcacccacgaccccccttccctgctatgatggtttgtcagtagcaggtcctagacaccccccgcccgctcccggggcacgtgggcagagctagcagcagccaggtgcacggagccacaagagctctagggcactctgggggcagctgtgcctgctgccctctctggtgcctgtggagatgcctaactgacaggagagttagtgaggacaagaacgctcccttttggccgaggtccgctgtatccatggctctcctgaccaatctactgcccctgtgctgcttggcacttctggcgctgccagcccagagctgcgggccgggccgggggccggttggccggcgccgctatgcgcgcaagcagctcgtgccgctactctacaagcaatttgtgcccggcgtgccagagcggaccctgggcgccagtgggccagcggaggggagggtggcaaggggctccgagcgcttccgggacctcgtgcccaactacaaccccgacatcatcttcaaggatgaggagaacagtggagccgaccgcctgatgaccgagcgttgtaaggagcgggtgaacgctttggccattgccgtgatgaacatgtggcccggagtgcgcctacgagtgactgagggctgggacgaggacggccaccacgctcaggattcactccactacgaaggccgtgctttggacatcactacgtctgaccgcgaccgcaacaagtatgggttgctggcgcgcctcgcagtggaagccggcttcgactgggtctactacgagtcccgcaaccacgtccacgtgtcggtcaaagctgataactcactggcggtccgggcgggcggctgctttccgggaaatgcaactgtgcgcctgtggagcggcgagcggaaagggctgcgggaactgcaccgcggagactgggttttggcggccgatgcgtcaggccgggtggtgcccacgccggtgctgctcttcctggaccgggacttgcagcgccgggcttcatttgtggctgtggagaccgagtggcctccacgcaaactgttgctcacgccctggcacctggtgtttgccgctcgagggccggcgcccgcgccaggcgactttgcaccggtgttcgcgcgccggctacgcgctggggactcggtgctggcgcccggcggggatgcgcttcggccagcgcgcgtggcccgtgtggcgcgggaggaagccgtgggcgtgttcgcgccgctcaccgcgcacgggacgctgctggtgaacgatgtcctggcctcttgctacgcggttctggagagtcaccagtgggcgcaccgcgcttttgcccccttgagactgctgcacgcgctaggggcgctgctccccggcggggccgtccagccgactggcatgcattggtactctcggctcctctaccgcttagcggaggagctactgggctgagcgtcccaggcatagaaacctcgaagcgcccgaggaaacgagggcctgctggctgagatatggggctgtgggcagcagacgatgccgactggaagggagggagagggagggggagggagaaaatggggctatgcctggcttaggggcaacctcgtactgagaggaggtgataccgggtcctaggtaggtagggctgatggtgcgcactccttaaagaggactatttagcctctcccccagtgcttcagccccacccgataattttattttatttcttatttataaattgtaatataatgattcccttgcccagcttgccaaggtgaggggctggggcatggcattaacactgtctgacacagccagccagtctgacatctgacgttttcctgcaaggtgggctaataaagggaaggctttcaggagcttactggaaaa

SEQ ID NO: 8209 - DNA, 2248 bp, Homo sapiens
gtctcccctcgccgcatccactctccggccggccgcctgcccgccgcctcctccgtgcgcccgccagcctcgcccgcgccgtcaccatgagccaggcctactcgtccagccagcgcgtgtcctcctaccgccgcaccttcggcggggccccgggcttcccactcggctccccgctgagttcgcccgtgttcccgcgggcgggtttcggctctaagggctcctccagctcggtgacgtcccgcgtgtaccaggtgtcgcgcacgtcgggcggggccgggggcctggggtcgctgcgggccagccggctggggaccacccgcacgccctcctcctacggcgcaggcgagctgctggacttctcactggccgacgcggtgaaccaggagtttctgaccacgcgcaccaacgagaaggtggagctgcaggagctcaatgaccgcttcgccaactacatcgagaaggtgcgcttcctggagcagcagaacgcggcgctcgccgccgaagtgaaccggctcaagggccgcgagccgacgcgagtggccgagctctacgaggaggagctgcgggagctgcggcgccaggtggaggtgctcactaaccagcgcgcgcgcgtcgacgtcgagcgcgacaacctgctcgacgacctgcagcggctcaaggccaagctgcaggaggagattcagttgaaggaagaagcagagaacaatttggctgccttccgagcggacgtggatgcagctactctagctcgcattgacctggagcgcagaattgaatctctcaacgaggagatcgcgttccttaagaaagtgcatgaagaggagatccgtgagttgcaggctcagcttcaggaacagcaggtccaggtggagatggacatgtctaagccagacctcactgccgccctcagggacatccgggctcagtatgagaccatcgcggctaagaacatttctgaagctgaggagtggtacaagtcgaaggtgtcagacctgacccaggcagccaacaagaacaacgacgccctgcgccaggccaagcaggagatgatggaataccgacaccagatccagtcctacacctgcgagattgacgccctgaagggcactaacgattccctgatgaggcagatgcgggaattggaggaccgatttgccagtgaggccagtggctaccaggacaacattgcgcgcctggaggaggaaatccggcacctcaaggatgagatggcccgccatctgcgcgagtaccaggacctgctcaacgtgaagatggccctggatgtggagattgccacctaccggaagctgctggagggagaggagagccggatcaatctccccatccagacctactctgccctcaacttccgagaaaccagccctgagcaaaggggttctgaggtccataccaagaagacggtgatgatcaagaccatcgagacacgggatggggaggtcgtcagtgaggccacacagcagcagcatgaagtgctctaaagacagagaccctctgccaccagagaccgtcctcacccctgtcctcactgctccctgaagccagccttcttccatcccaggacaccacacccagcctcagtcctcccctcacagcctctgacccctcctcactggccatccctcgtggtccccaacagcgacatagcccatccctgcctggtcacagggcatgccccggccacctctgcggaccccagctgtgagccttggctgttggcagtgagtgagcctggctcttgtgctggatggagcccaggcgggagcggtggccctgtccctcccacctctgtgacctcaggcactagcctttggctctggagacagccccagagcagggtgttgggatactgcagggccaggactgagccccgcagacctccccagcccctagcccaggagagagaaagccaggcaggtagccagggggactagcccctgtggagactggggggcttgaaattgtccccgtggtctcttactttcctttccccagcccagggtggacttagaaagcaggggctacaagagggaatccccgaaggtgctggaggtgggagcaggagattgagaaggagagaaagtgggtgagatgctggagaagagaggagaggagagaggcagagagcggtctcaggctggtgggaggggcgcccacctccccacgccctcccctcccctgctgcaggggctctggagagaaacaataaagagattcacacacaagccaa

SEQ ID NO: 8210 - DNA, 4271 bp, Homo sapiens
acttgtaggaaagcctctttgcatttagacgtaattgaactggaaggaaggagactggccagggaatagggggaaagaaattctcccgttgctcctcctactgtttatcacttgcctccggactgtcttccaaaccaagctcagctgcatcaaggtggcagcagaataccctgtgcaagtgccagcgtcttcttagccgctctgtgcatcccaggctgccctgttatctggccaccgtccctggccattgggactgcttctgatggctctggcctctgctgccccagggagcatcttctgtaagcagctccttttctctctcctggttttaacattactttgcgatgcttgtcagaaagtttatcttcgagttccttctcatcttcaggctgaaacacttgtaggcaaagtgaatctggaggagtgtctcaagtcggccagcctaatccggtccagtgaccctgccttcagaattctagaagatggctcaatttacacaacacatgacctcattttgtcttctgaaaggaaaagtttttccattttcctttcagatggtcagagacgggaacaacaagagataaaagttgtactgtcagcaagagaaaacaagtctcctaagaagagacataccaaagacacagccctcaagcgcagcaagagacgatgggctcctattccagcttcattgatggagaactcgttgggtccatttccacaacacgttcagcagatccaatctgatgctgcacagaattacaccatcttttattccataagtgggccaggcgtggacaaagaacccttcaatttgttttacatagagaaagacactggggatatcttttgtacaaggagcattgaccgtgagaaatatgaacagtttgcgttatatggctatgcaacaactgcagatggctatgcaccagaatatccactccctttgatcatcaaaattgaagatgataatgataacgccccatattttgaacacagagtgactatctttactgtgcctgaaaattgccgatccggaacttcagtgggaaaagtgaccgccacagaccttgacgaacctgacactctccatactcgtctgaaatataaaatcttacaacaaatcccagatcatccaaagcatttctccatacacccagataccggtgtcatcaccacaactacaccttttctggatagagaaaaatgtgatacttaccagttaataatggaagtgcgagacatgggtggtcagcctttcggtttatttaatacaggaacaattactatttcacttgaggatgaaaatgacaatccaccatctttcacagaaacttcttatgttacagaagtagaagaaaacagaattgacgtggagattttacgaatgaaggtacaggatcaggatttgccaaacactcctcactcaaaggctgtatacaaaatcctacaaggaaatgaaaatggaaacttcataattagcacagatccaaatacaaatgaaggagtgctgtgtgttgtcaagccattgaactatgaagtcaatcgccaagttattttgcaagttggtgtcattaacgaggcacaattctctaaagcagcgagctcacaaactcctacaatgtgcactacaactgtcaccgttaaaattatagacagtgatgagggccctgaatgccaccctccagtgaaagttattcagagtcaagatggcttcccagctggccaagaactccttggatacaaagcactggacccggaaatatccagtggtgaaggcttaaggtatcagaagttaggggatgaagataactggtttgaaattaatcaacacactggcgacttgagaactctaaaagtactagatagagaatccaaatttgtaaaaaacaaccaatacaatatttcagttgttgcagtggatgcagttggccgatcttgcactggaacattagtagttcatttggatgattacaacgatcacgcacctcaaattgacaaagaagtgaccatttgtcagaataatgaggattttgctgttctgaaacctgtagatccagatggacctgaaaatggaccaccttttcaattctttctggataattctgccagtaaaaactggaacatagaagaaaaggatggtaaaactgccattcttcgtcaacggcaaaatcttgattataactattattctgtgcctattcaaataaaagacaggcatggtttagttgcaacacatatgttaacagtgagagtatgtgactgttcaactccatctgagtgtagaatgaaggataaaagtacaagagacgttagaccaaatgtaatacttggaagatgggctattcttgctatggtgttgggttctgtattgttattatgtattctgtttacatgtttctgtgtcactgctaagagaacagtcaagaaatgttttccagaagacatagcccagcaaaatttaattgtatcaaatactgaaggacctggagaagaagtaacggaagcaaatattagactccccatgcagacatccaacatttgtgacacaagcatgtctgttggtactgttggtggccagggaatcaaaacacagcaaagttttgagatggtcaaaggaggctacactttggattccaacaaaggaggtggacatcagaccttggagtccgtcaagggagtggggcagggagatactggcagatatgcgtacacggactggcagagtttcacccaacctcggcttggcgaagaatccattagaggacacactctgattaaaaattaaacagtaaaagaaggtgtatttgtgtggacaagatgaggagcataaacattgtgaagactacgtttgttcgtataactatgaaggcaaaggttctctggccggctcagtaggttgctgcagcgatcggcaggaagaagagggactggagtttctagatcacctggaacccaaatttaggacattagcaaagacatgcatcaagaaataaatgtgccttttaatagtgtaatatccacagatgcataagtaggaatttattacttgcagaatgttagcagcatctgctaatgtttttgtttatggaggtaaactttgtcatgtataggtaagggtactataaatatgagattcccctacattctccttgtctggtataacttccatgttctctagaaatcaaggttttgtttgttaattctcttttatatgcatgtatatattgcccttttcacgactgtactgtacaccttcttgcaccttttatttgcaaactgatgttactttttgtgctgtggaagagcatttgggaaagctgggtattatagaggccaatgaaagatgaatttgcattgtagatgtacgaattaaatatgttcttcaaaatcttggggagaattatgttcttagaacatagttggtgccagataattgcattctctccacctgagtggtttaaaaaggacttttaagtattcttcagtgcaatcttcagttttgtgattaagttcatttctcttttacacttttgtactcctcagagcagtgctcccagcattgttttctttcaggatccttcagagctcagtccctggacctctgcccatgtggatttgttgttaggtcactccaacttctagggttcttggaaagataaggaccagaacaagctcatagcaaattgaggggcagagattttatgaagattacatgagaagatttccatgaaagaattgcagccctgaggtccatgggttgacttatgctcacaaatatgtttcgtttgctcaacatggtttactactaacattttaaaaatataaatactttagcaaaaacattcactcttgagtttgacataggcctgccttatctgtggttgccacctgccatctccaagcatttggacaactagccctgatgcattaggctgcaactctgatatacagagactagcaccttgaatatgccagaaattgaattaccatctgtattagaacttaagactcagcctaaatttacagttactttaagaaaatgggcagtcagaattagggactagaatgtatatgagaaacccccactctactaaaaatataagaaattagccggacatggtggcgaatgactgtaatcccagctactcaggaggctgaggcaggagaatcgcttgaatccaggaggcggaggttgcagtgagccgagattgccactgcactccagcctgggcaacaagagcgaaactccgtctcaaaaaaaaaaaaaaaaa

SEQ ID NO: 8211 - DNA, 4225 bp, Homo sapiens
acttgtaggaaagcctctttgcatttagacgtaattgaactggaaggaaggagactggccagggaatagggggaaagaaattctcccgttgctcctcctactgtttatcacttgcctccggactgtcttccaaaccaagctcagctgcatcaaggtggcagcagaataccctgtgcaagtgccagcgtcttcttagccgctctgtgcatcccaggctgccctgttatctggccaccgtccctggccattgggactgcttctgatggctctggcctctgctgccccagggagcatcttctgtaagcagctccttttctctctcctggttttaacattactttgcgatgcttgtcagaaagtttatcttcgagttccttctcatcttcaggctgaaacacttgtaggcaaagtgaatctggaggagtgtctcaagtcggccagcctaatccggtccagtgaccctgccttcagaattctagaagatggctcaatttacacaacacatgacctcattttgtcttctgaaaggaaaagtttttccattttcctttcagatggtcagagacgggaacaacaagagataaaagttgtactgtcagcaagagaaaacaagtctcctaagaagagacataccaaagacacagccctcaagcgcagcaagagacgatgggctcctattccagcttcattgatggagaactcgttgggtccatttccacaacacgttcagcagatccaatctgatgctgcacagaattacaccatcttttattccataagtgggccaggcgtggacaaagaacccttcaatttgttttacatagagaaagacactggggatatcttttgtacaaggagcattgaccgtgagaaatatgaacagtttgcgttatatggctatgcaacaactgcagatggctatgcaccagaatatccactccctttgatcatcaaaattgaagatgataatgataacgccccatattttgaacacagagtgactatctttactgtgcctgaaaattgccgatccggaacttcagtgggaaaagtgaccgccacagaccttgacgaacctgacactctccatactcgtctgaaatataaaatcttacaacaaatcccagatcatccaaagcatttctccatacacccagataccggtgtcatcaccacaactacaccttttctggatagagaaaaatgtgatacttaccagttaataatggaagtgcgagacatgggtggtcagcctttcggtttatttaatacaggaacaattactatttcacttgaggatgaaaatgacaatccaccatctttcacagaaacttcttatgttacagaagtagaagaaaacagaattgacgtggagattttacgaatgaaggtacaggatcaggatttgccaaacactcctcactcaaaggctgtatacaaaatcctacaaggaaatgaaaatggaaacttcataattagcacagatccaaatacaaatgaaggagtgctgtgtgttgtcaagccattgaactatgaagtcaatcgccaagttattttgcaagttggtgtcattaacgaggcacaattctctaaagcagcgagctcacaaactcctacaatgtgcactacaactgtcaccgttaaaattatagacagtgatgagggccctgaatgccaccctccagtgaaagttattcagagtcaagatggcttcccagctggccaagaactccttggatacaaagcactggacccggaaatatccagtggtgaaggcttaaggtatcagaagttaggggatgaagataactggtttgaaattaatcaacacactggcgacttgagaactctaaaagtactagatagagaatccaaatttgtaaaaaacaaccaatacaatatttcagttgttgcagtggatgcagttggccgatcttgcactggaacattagtagttcatttggatgattacaacgatcacgcacctcaaattgacaaagaagtgaccatttgtcagaataatgaggattttgctgttctgaaacctgtagatccagatggacctgaaaatggaccaccttttcaattctttctggataattctgccagtaaaaactggaacatagaagaaaaggatggtaaaactgccattcttcgtcaacggcaaaatcttgattataactattattctgtgcctattcaaataaaagacaggcatggtttagttgcaacacatatgttaacagtgagagtatgtgactgttcaactccatctgagtgtagaatgaaggataaaagtacaagagacgttagaccaaatgtaatacttggaagatgggctattcttgctatggtgttgggttctgtattgttattatgtattctgtttacatgtttctgtgtcactgctaagagaacagtcaagaaatgttttccagaagacatagcccagcaaaatttaattgtatcaaatactgaaggacctggagaagaagtaacggaagcaaatattagactccccatgcagacatccaacatttgtgacacaagcatgtctgttggtactgttggtggccagggaatcaaaacacagcaaagttttgagatggtcaaaggaggctacactttggattccaacaaaggaggtggacatcagaccttggagtccgtcaagggagtggggcagggagatactggcagatatgcgtacacggactggcagagtttcacccaacctcggcttggcgaaaaggtgtatttgtgtggacaagatgaggagcataaacattgtgaagactacgtttgttcgtataactatgaaggcaaaggttctctggccggctcagtaggttgctgcagcgatcggcaggaagaagagggactggagtttctagatcacctggaacccaaatttaggacattagcaaagacatgcatcaagaaataaatgtgccttttaatagtgtaatatccacagatgcataagtaggaatttattacttgcagaatgttagcagcatctgctaatgtttttgtttatggaggtaaactttgtcatgtataggtaagggtactataaatatgagattcccctacattctccttgtctggtataacttccatgttctctagaaatcaaggttttgtttgttaattctcttttatatgcatgtatatattgcccttttcacgactgtactgtacaccttcttgcaccttttatttgcaaactgatgttactttttgtgctgtggaagagcatttgggaaagctgggtattatagaggccaatgaaagatgaatttgcattgtagatgtacgaattaaatatgttcttcaaaatcttggggagaattatgttcttagaacatagttggtgccagataattgcattctctccacctgagtggtttaaaaaggacttttaagtattcttcagtgcaatcttcagttttgtgattaagttcatttctcttttacacttttgtactcctcagagcagtgctcccagcattgttttctttcaggatccttcagagctcagtccctggacctctgcccatgtggatttgttgttaggtcactccaacttctagggttcttggaaagataaggaccagaacaagctcatagcaaattgaggggcagagattttatgaagattacatgagaagatttccatgaaagaattgcagccctgaggtccatgggttgacttatgctcacaaatatgtttcgtttgctcaacatggtttactactaacattttaaaaatataaatactttagcaaaaacattcactcttgagtttgacataggcctgccttatctgtggttgccacctgccatctccaagcatttggacaactagccctgatgcattaggctgcaactctgatatacagagactagcaccttgaatatgccagaaattgaattaccatctgtattagaacttaagactcagcctaaatttacagttactttaagaaaatgggcagtcagaattagggactagaatgtatatgagaaacccccactctactaaaaatataagaaattagccggacatggtggcgaatgactgtaatcccagctactcaggaggctgaggcaggagaatcgcttgaatccaggaggcggaggttgcagtgagccgagattgccactgcactccagcctgggcaacaagagcgaaactccgtctcaaaaaaaaaaaaaaaaa

SEQ ID NO: 8212 - DNA, 6935 bp, Homo sapiens
gaagttgctcccgggcaggcaagcctgagagaggccaaatacacttaaaaacaagcagcggcgagaaaagcacctcccgcgccctgcacctcggcaggtctcgctctcggcaccctcccggcgcccgcgttctcctggccctgcccggcatcccgatggccgccgctgggccccggcgctccgtgcgcggagccgtctgcctgcatctgctgctgaccctcgtgatcttcagtcgtgctggtgaagcctgcaaaaaggtgatacttaatgtaccttctaaactagaggcagacaaaataattggcagagttaatttggaagagtgcttcaggtctgcagacctcatccggtcaagtgatcctgatttcagagttctaaatgatgggtcagtgtacacagccagggctgttgcgctgtctgataagaaaagatcatttaccatatggctttctgacaaaaggaaacagacacagaaagaggttactgtgctgctagaacatcagaagaaggtatcgaagacaagacacactagagaaactgttctcaggcgtgccaagaggagatgggcacctattccttgctctatgcaagagaattccttgggccctttcccattgtttcttcaacaagttgaatctgatgcagcacagaactatactgtcttctactcaataagtggacgtggagttgataaagaacctttaaatttgttttatatagaaagagacactggaaatctattttgcactcggcctgtggatcgtgaagaatatgatgtttttgatttgattgcttatgcgtcaactgcagatggatattcagcagatctgcccctcccactacccatcagggtagaggatgaaaatgacaaccaccctgttttcacagaagcaatttataattttgaagttttggaaagtagtagacctggtactacagtgggggtggtttgtgccacagacagagatgaaccggacacaatgcatacgcgcctgaaatacagcattttgcagcagacaccaaggtcacctgggctcttttctgtgcatcccagcacaggcgtaatcaccacagtctctcattatttggacagagaggttgtagacaagtactcattgataatgaaagtacaagacatggatggccagttttttggattgataggcacatcaacttgtatcataacagtaacagattcaaatgataatgcacccactttcagacaaaatgcttatgaagcatttgtagaggaaaatgcattcaatgtggaaatcttacgaatacctatagaagataaggatttaattaacactgccaattggagagtcaattttaccattttaaagggaaatgaaaatggacatttcaaaatcagcacagacaaagaaactaatgaaggtgttctttctgttgtaaagccactgaattatgaagaaaaccgtcaagtgaacctggaaattggagtaaacaatgaagcgccatttgctagagatattcccagagtgacagccttgaacagagccttggttacagttcatgtgagggatctggatgaggggcctgaatgcactcctgcagcccaatatgtgcggattaaagaaaacttagcagtggggtcaaagatcaacggctataaggcatatgaccccgaaaatagaaatggcaatggtttaaggtacaaaaaattgcatgatcctaaaggttggatcaccattgatgaaatttcagggtcaatcataacttccaaaatcctggatagggaggttgaaactcccaaaaatgagttgtataatattacagtcctggcaatagacaaagatgatagatcatgtactggaacacttgctgtgaacattgaagatgtaaatgataatccaccagaaatacttcaagaatatgtagtcatttgcaaaccaaaaatggggtataccgacattttagctgttgatcctgatgaacctgtccatggagctccattttatttcagtttgcccaatacttctccagaaatcagtagactgtggagcctcaccaaagttaatgatacagctgcccgtctttcatatcagaaaaatgctggatttcaagaatataccattcctattactgtaaaagacagggccggccaagctgcaacaaaattattgagagttaatctgtgtgaatgtactcatccaactcagtgtcgtgcgacttcaaggagtacaggagtaatacttggaaaatgggcaatccttgcaatattactgggtatagcactgctcttttctgtattgctaactttagtatgtggagtttttggtgcaactaaagggaaacgttttcctgaagatttagcacagcaaaacttaattatatcaaacacagaagcacctggagacgatagagtgtgctctgccaatggatttatgacccaaactaccaacaactctagccaaggtttttgtggtactatgggatcaggaatgaaaaatggagggcaggaaaccattgaaatgatgaaaggaggaaaccagaccttggaatcctgccggggggctgggcatcatcataccctggactcctgcaggggaggacacacggaggtggacaactgcagatacacttactcggagtggcacagttttactcaaccccgtctcggtgaaaaattgcatcgatgtaatcagaatgaagaccgcatgccatcccaagattatgtcctcacttataactatgagggaagaggatctccagctggttctgtgggctgctgcagtgaaaagcaggaagaagatggccttgactttttaaataatttggaacccaaatttattacattagcagaagcatgcacaaagagataatgtcacagtgctacaattaggtctttgtcagacattctggaggtttccaaaaataatattgtaaagttcaatttcaacatgtatgtatatgatgatttttttctcaattttgaattatgctactcaccaatttatatttttaaagcaagttgttgcttatcttttccaaaaagtgaaaaatgttaaaacagacaactggtaaatctcaaactccagcactggaattaaggtctctaaagcatctgctcttttttttttttacggatattttagtaataaatatgctggataaatattagtccaacaatagctaagttatgctaatatcacattattatgtattcactttaagtgatagtttaaaaaataaacaagaaatattgagtatcactatgtgaagaaagttttggaaaagaaacaatgaagactgaattaaattaaaaatgttgcagctcataaagaattgggactcacccctactgcactaccaaattcatttgactttggaggcaaaatgtgttgaagtgccctatgaagtagcaattttctataggaatatagttggaaataaatgtgtgtgtgtatattattattaatcaatgcaatatttaaaatgaaatgagaacaaagaggaaaatggtaaaaacttgaaatgaggctggggtatagtttgtcctacaatagaaaaaagagagagcttcctaggcctgggctcttaaatgctgcattataactgagtctatgaggaaatagttcctgtccaatttgtgtaatttgtttaaaattgtaaataaattaaacttttctggtttctgtgggaaggaaatagggaatccaatggaacagtagctttgctttgcagtctgtttcaagatttctgcatccacaagttagtagcaaactggggaatactcgctgcagctggggttccctgctttttggtagcaagggtccagagatgaggtgtttttttcggggagctaataacaaaaacattttaaaacttacctttactgaagttaaatcctctattgctgtttctattctctcttatagtgaccaacatctttttaatttagatccaaataaccatgtcctcctagagtttagaggctagagggagctgaggggaggatcttactgaaagcaccctggggagattgattgtccttaaacctaagccccacaaacttgacacctgatcaggtctgggagctacaaaatttcatttttctcctcactgcccttcttctgagtggcattggcctgaatcaaggaaagccaggccttgtgggcccccttctttcggctttctgctaaagcaacacctccagcagagattcccttaagtgactccaggttttccaccatccttcagcgtgaattaatttttaatcagtttgctttctccagagaaattttaaaataatagaagaaatagaaattttgaatgtataaaagaaaaagatcaagttgtcattttagaacagagggaactttgggagaaagcagcccaagtaggttatttgtacagtcagagggcaacaggaagatgcaggccttcaagggcaaggagaggccacaaggaatatgggtgggagtaaaagcaacatcgtctgcttcatactttttcctaggcttggcactgccttttcctttctcaggccaatggcaactgccatttgagtccggtgagggatcagccaacctcttctctatggctcaccttatttggagtgagaaatcaaggagacagagctgactgcatgatgagtctgaaggcatttgcaggatgagcctgaactggttgtgcagaacaaacaaggcattcatgggaattgttgtattccttctgcagccctccttctgggcactaagaaggtctatgaattaaatgcctatctaaaattctgatttattcctacattttctgttttctaatttgaccctaaaatctatgtgttttagacttagactttttattgccccccccccccccttttttttttgagacggagtctcgctctgacgcacaggctggagtgcagtggctccgatctctgctcactgaaagctccgcctcccgggttcacgccattctcctgcctcagcctcctgagtagctgggactacaggcgcccaccaccacgcccggctaattttttgtatttttaatagagacggggtttcactgtgttagccaggatggtctcgatctcctgacctcgtgatccgcctgcctcggcctcccaaagtgctgggattacaggcatgacccaccgctcccggccttgttttccgtttaaagtcgtcttcttttaatgtaatcattttgaacatgtgtgaaagttgatcatacgaattggatcaatcttgaaatactcaaccaaaagacagtcgagaagccagggggagaaagaactcagggcacaaaatattggtctgagaatggaattctctgtaagcctagttgctgaaatttcctgctgtatccagaagccagttttatctaacggctactgaaacacccactgtgttttgctcactccctcactcaccgatcaaaacctgctacctccccaagactttactagtgccgataaactttctcaaagagcaaccagtatcacttccctgtttataaaacctctaaccatctctttgttctttgaacatgctgaaaaccacctggtctgcatgtatgcccgaatttgtaattcttttctctcaaatgaaaatttaattttagggattcatttctatattttcacatatgtagtattattatttccttatatgtgtaaggtgaaatttatggtatttgagtgtgcaagaaaatatatttttaaagctttcatttttcccccagtgaatgatttagaattttttatgtaaatatacagaatgttttttcttacttttataaggaagcagctgtctaaaatgcagtggggtttgttttgcaatgttttaaacagagttttagtattgctattaaaagaagttactttgcttttaaagaaacttggctgcttaaaataagcaaaaattggatgcgtaaagtaatatttacagatgtggggagatgtaataaaacaatattaacttggtttcttgtttttgctgtatttagagattaaataattctaagatgatcactttgcaaaattatgcttatggctggcatggaaatagaaataattatgtctttgttgtattaatggggaatattttggacaatgtttcattatcaaattgtcgacatcattaatatatattgtaatgttgggaagagatcactattttgaagcacagctttacagatgagtatctatgatacatatgtataataaattttgattgggtattaaaagtattagaaggtggttataattgcagagtattccatgaatagtacactgacacaggggttttactttgaggaccagtgtagtcaagggaaaacatgagttaaaaagaaaagcaggcgatattgcagtcttgattctgccacttacaggatagataacgcctgaactttaatgacaagatgatccaaccataaaggtgctctgtgcttcacagtgaatcttttccccatgcaggagtgtgctcccctacaaacgttaagactgatcatttcaaaaatctattagctatatcaaaagccttacattttaatataggttgaaccaaaatttcaattccagtaacttctattgtaaccattatttttgtgtatgtcttcaagaatgttcattggatttttgtttgtaatagtaaaataccggatacatttcacgtgtccttcagtattgatttggttgaatattgggtcataatggttgagaagcatggacactagagccagaatgcttggatatgaatcctggatctgtcacttacttctgtgtgacctttgaaaggctacttatttcctctcttagctttctcattaaaatcaatgaacaatgccagcctcatggggttgttgaatgattaaatgagttactatacctaaagtacatagaacactgcctgcacatagtaaaagaattataagtgtgaggtagttggtaaaattatgta

SEQ ID NO: 8213 - DNA, 6978 bp, Homo sapiens
gaagttgctcccgggcaggcaagcctgagagaggccaaatacacttaaaaacaagcagcggcgagaaaagcacctcccgcgccctgcacctcggcaggtctcgctctcggcaccctcccggcgcccgcgttctcctggccctgcccggcatcccgatggccgccgctgggccccggcgctccgtgcgcggagccgtctgcctgcatctgctgctgaccctcgtgatcttcagtcgtgctggtgaagcctgcaaaaaggtgatacttaatgtaccttctaaactagaggcagacaaaataattggcagagttaatttggaagagtgcttcaggtctgcagacctcatccggtcaagtgatcctgatttcagagttctaaatgatgggtcagtgtacacagccagggctgttgcgctgtctgataagaaaagatcatttaccatatggctttctgacaaaaggaaacagacacagaaagaggttactgtgctgctagaacatcagaagaaggtatcgaagacaagacacactagagaaactgttctcaggcgtgccaagaggagatgggcacctattccttgctctatgcaagagaattccttgggccctttcccattgtttcttcaacaagttgaatctgatgcagcacagaactatactgtcttctactcaataagtggacgtggagttgataaagaacctttaaatttgttttatatagaaagagacactggaaatctattttgcactcggcctgtggatcgtgaagaatatgatgtttttgatttgattgcttatgcgtcaactgcagatggatattcagcagatctgcccctcccactacccatcagggtagaggatgaaaatgacaaccaccctgttttcacagaagcaatttataattttgaagttttggaaagtagtagacctggtactacagtgggggtggtttgtgccacagacagagatgaaccggacacaatgcatacgcgcctgaaatacagcattttgcagcagacaccaaggtcacctgggctcttttctgtgcatcccagcacaggcgtaatcaccacagtctctcattatttggacagagaggttgtagacaagtactcattgataatgaaagtacaagacatggatggccagttttttggattgataggcacatcaacttgtatcataacagtaacagattcaaatgataatgcacccactttcagacaaaatgcttatgaagcatttgtagaggaaaatgcattcaatgtggaaatcttacgaatacctatagaagataaggatttaattaacactgccaattggagagtcaattttaccattttaaagggaaatgaaaatggacatttcaaaatcagcacagacaaagaaactaatgaaggtgttctttctgttgtaaagccactgaattatgaagaaaaccgtcaagtgaacctggaaattggagtaaacaatgaagcgccatttgctagagatattcccagagtgacagccttgaacagagccttggttacagttcatgtgagggatctggatgaggggcctgaatgcactcctgcagcccaatatgtgcggattaaagaaaacttagcagtggggtcaaagatcaacggctataaggcatatgaccccgaaaatagaaatggcaatggtttaaggtacaaaaaattgcatgatcctaaaggttggatcaccattgatgaaatttcagggtcaatcataacttccaaaatcctggatagggaggttgaaactcccaaaaatgagttgtataatattacagtcctggcaatagacaaagatgatagatcatgtactggaacacttgctgtgaacattgaagatgtaaatgataatccaccagaaatacttcaagaatatgtagtcatttgcaaaccaaaaatggggtataccgacattttagctgttgatcctgatgaacctgtccatggagctccattttatttcagtttgcccaatacttctccagaaatcagtagactgtggagcctcaccaaagttaatgatacagctgcccgtctttcatatcagaaaaatgctggatttcaagaatataccattcctattactgtaaaagacagggccggccaagctgcaacaaaattattgagagttaatctgtgtgaatgtactcatccaactcagtgtcgtgcgacttcaaggagtacaggagtaatacttggaaaatgggcaatccttgcaatattactgggtatagcactgctcttttctgtattgctaactttagtatgtggagtttttggtgcaactaaagggaaacgttttcctgaagatttagcacagcaaaacttaattatatcaaacacagaagcacctggagacgatagagtgtgctctgccaatggatttatgacccaaactaccaacaactctagccaaggtttttgtggtactatgggatcaggaatgaaaaatggagggcaggaaaccattgaaatgatgaaaggaggaaaccagaccttggaatcctgccggggggctgggcatcatcataccctggactcctgcaggggaggacacacggaggtggacaactgcagatacacttactcggagtggcacagttttactcaaccccgtctcggtgaagaatccattagaggacacactggttaaaaattaaacataaaagaaattgcatcgatgtaatcagaatgaagaccgcatgccatcccaagattatgtcctcacttataactatgagggaagaggatctccagctggttctgtgggctgctgcagtgaaaagcaggaagaagatggccttgactttttaaataatttggaacccaaatttattacattagcagaagcatgcacaaagagataatgtcacagtgctacaattaggtctttgtcagacattctggaggtttccaaaaataatattgtaaagttcaatttcaacatgtatgtatatgatgatttttttctcaattttgaattatgctactcaccaatttatatttttaaagcaagttgttgcttatcttttccaaaaagtgaaaaatgttaaaacagacaactggtaaatctcaaactccagcactggaattaaggtctctaaagcatctgctcttttttttttttacggatattttagtaataaatatgctggataaatattagtccaacaatagctaagttatgctaatatcacattattatgtattcactttaagtgatagtttaaaaaataaacaagaaatattgagtatcactatgtgaagaaagttttggaaaagaaacaatgaagactgaattaaattaaaaatgttgcagctcataaagaattgggactcacccctactgcactaccaaattcatttgactttggaggcaaaatgtgttgaagtgccctatgaagtagcaattttctataggaatatagttggaaataaatgtgtgtgtgtatattattattaatcaatgcaatatttaaaatgaaatgagaacaaagaggaaaatggtaaaaacttgaaatgaggctggggtatagtttgtcctacaatagaaaaaagagagagcttcctaggcctgggctcttaaatgctgcattataactgagtctatgaggaaatagttcctgtccaatttgtgtaatttgtttaaaattgtaaataaattaaacttttctggtttctgtgggaaggaaatagggaatccaatggaacagtagctttgctttgcagtctgtttcaagatttctgcatccacaagttagtagcaaactggggaatactcgctgcagctggggttccctgctttttggtagcaagggtccagagatgaggtgtttttttcggggagctaataacaaaaacattttaaaacttacctttactgaagttaaatcctctattgctgtttctattctctcttatagtgaccaacatctttttaatttagatccaaataaccatgtcctcctagagtttagaggctagagggagctgaggggaggatcttactgaaagcaccctggggagattgattgtccttaaacctaagccccacaaacttgacacctgatcaggtctgggagctacaaaatttcatttttctcctcactgcccttcttctgagtggcattggcctgaatcaaggaaagccaggccttgtgggcccccttctttcggctttctgctaaagcaacacctccagcagagattcccttaagtgactccaggttttccaccatccttcagcgtgaattaatttttaatcagtttgctttctccagagaaattttaaaataatagaagaaatagaaattttgaatgtataaaagaaaaagatcaagttgtcattttagaacagagggaactttgggagaaagcagcccaagtaggttatttgtacagtcagagggcaacaggaagatgcaggccttcaagggcaaggagaggccacaaggaatatgggtgggagtaaaagcaacatcgtctgcttcatactttttcctaggcttggcactgccttttcctttctcaggccaatggcaactgccatttgagtccggtgagggatcagccaacctcttctctatggctcaccttatttggagtgagaaatcaaggagacagagctgactgcatgatgagtctgaaggcatttgcaggatgagcctgaactggttgtgcagaacaaacaaggcattcatgggaattgttgtattccttctgcagccctccttctgggcactaagaaggtctatgaattaaatgcctatctaaaattctgatttattcctacattttctgttttctaatttgaccctaaaatctatgtgttttagacttagactttttattgccccccccccccccttttttttttgagacggagtctcgctctgacgcacaggctggagtgcagtggctccgatctctgctcactgaaagctccgcctcccgggttcacgccattctcctgcctcagcctcctgagtagctgggactacaggcgcccaccaccacgcccggctaattttttgtatttttaatagagacggggtttcactgtgttagccaggatggtctcgatctcctgacctcgtgatccgcctgcctcggcctcccaaagtgctgggattacaggcatgacccaccgctcccggccttgttttccgtttaaagtcgtcttcttttaatgtaatcattttgaacatgtgtgaaagttgatcatacgaattggatcaatcttgaaatactcaaccaaaagacagtcgagaagccagggggagaaagaactcagggcacaaaatattggtctgagaatggaattctctgtaagcctagttgctgaaatttcctgctgtatccagaagccagttttatctaacggctactgaaacacccactgtgttttgctcactccctcactcaccgatcaaaacctgctacctccccaagactttactagtgccgataaactttctcaaagagcaaccagtatcacttccctgtttataaaacctctaaccatctctttgttctttgaacatgctgaaaaccacctggtctgcatgtatgcccgaatttgtaattcttttctctcaaatgaaaatttaattttagggattcatttctatattttcacatatgtagtattattatttccttatatgtgtaaggtgaaatttatggtatttgagtgtgcaagaaaatatatttttaaagctttcatttttcccccagtgaatgatttagaattttttatgtaaatatacagaatgttttttcttacttttataaggaagcagctgtctaaaatgcagtggggtttgttttgcaatgttttaaacagagttttagtattgctattaaaagaagttactttgcttttaaagaaacttggctgcttaaaataagcaaaaattggatgcgtaaagtaatatttacagatgtggggagatgtaataaaacaatattaacttggtttcttgtttttgctgtatttagagattaaataattctaagatgatcactttgcaaaattatgcttatggctggcatggaaatagaaataattatgtctttgttgtattaatggggaatattttggacaatgtttcattatcaaattgtcgacatcattaatatatattgtaatgttgggaagagatcactattttgaagcacagctttacagatgagtatctatgatacatatgtataataaattttgattgggtattaaaagtattagaaggtggttataattgcagagtattccatgaatagtacactgacacaggggttttactttgaggaccagtgtagtcaagggaaaacatgagttaaaaagaaaagcaggcgatattgcagtcttgattctgccacttacaggatagataacgcctgaactttaatgacaagatgatccaaccataaaggtgctctgtgcttcacagtgaatcttttccccatgcaggagtgtgctcccctacaaacgttaagactgatcatttcaaaaatctattagctatatcaaaagccttacattttaatataggttgaaccaaaatttcaattccagtaacttctattgtaaccattatttttgtgtatgtcttcaagaatgttcattggatttttgtttgtaatagtaaaataccggatacatttcacgtgtccttcagtattgatttggttgaatattgggtcataatggttgagaagcatggacactagagccagaatgcttggatatgaatcctggatctgtcacttacttctgtgtgacctttgaaaggctacttatttcctctcttagctttctcattaaaatcaatgaacaatgccagcctcatggggttgttgaatgattaaatgagttactatacctaaagtacatagaacactgcctgcacatagtaaaagaattataagtgtgaggtagttggtaaaattatgta

SEQ ID NO: 8214 - DNA, 5045 bp, Homo sapiens
ccagcccaagtttttagggtggggatccagactggttatacgtaccttcagtccttctcccagaggaaggcagaaacacctcaaagcctgcatgtaagaacatctactgagaaattattttaatcagacaccagctgagtgggagaaagaaaaagaacagagaagaacaaacaaaactcccttggtcttggatgtaagagaatccagcagagatggactggagtttcttcagagtagttgcaatgctgttcatttttctggtggtggtagaagttaacagtgaattccgaatccaggtaagagattataacactaaaaatggcaccatcaaatggcattcaatccgaaggcagaaacgtgaatggatcaagttcgcagcagcctgtcgtgaaggtgaagacaactcaaagaggaacccaatcgccaaaattcactcagattgtgctgcaaaccagcaagttacataccgcatctctggagtaggaattgatcagccaccatatgggatctttgtcattaatcagaaaactggtgaaattaatataacatccatagttgatcgagaggtcactcctttcttcattatctactgccgagctctgaactcaatgggccaagatttagagaggcctctagagctcagagtcagggttttggatataaatgacaaccctccagtgttttcaatggctacatttgcaggacaaatagaagaaaattctaatgcaaatacactggtgatgatactcaatgctactgacgcagatgaaccgaacaatttgaactcaaaaatagccttcaagattataagacaagaaccttcagattcaccaatgtttattatcaacagaaatactggagaaattcgaacgatgaataattttctagacagagagcaatacggccagtatgctcttgctgtaagaggctctgaccgagatggcggggcagatggcatgtcagcggaatgtgagtgcaacattaaaatcctcgatgtcaatgataatatcccttacatggaacagtcttcatataccatagaaattcaagaaaatactctaaattcaaatttgctcgagattagagtaattgatttggatgaagagttctcagctaactggatggcagtaattttctttatctctggaaatgaaggaaattggtttgagatagaaatgaatgaaagaacaaatgtgggaattttaaaggttgttaagcccttagattatgaagctatgcagagtctgcaactcagtattggtgtcagaaataaagctgaatttcatcattcaattatgtctcaatataaactgaaagcatctgcaatttctgtgactgtgttaaatgtaattgaaggcccagtgtttcgtccaggttcaaagacatatgttgtaactggtaatatgggatcaaatgataaagtgggagactttgtagctactgacctggacacaggtagaccttcaacgactgttaggtatgtaatgggaaataatccagctgacctgctagctgttgattcaagaacaggcaaactcactttgaaaaataaagttaccaaggaacagtacaatatgctcggaggaaaataccaaggaacgattctctctatagatgataatcttcaaagaacttgcactggtacaattaatattaacattcaaagttttggtaatgacgacaggactaatacagagccgaacactaaaattactaccaatactggcagacaagaaagtacttcttccactaactatgataccagcacaacttctactgactctagccaagtatattcttctgaacccggaaacggagccaaagatttgttatcagacaatgtacattttggtcctgctggcattggactcctcatcatgggattcttggtcttaggattggtcccatttttgatgatctgttgtgattgtggaggtgctcctcgtagtgcagctggctttgagcctgttcccgaatgttcagatggagcaattcattcatgggcagtagaaggaccacagcctgaacccagggatataaccactgtcataccacaaataccacctgataacgcaaatataattgaatgcattgacaactcaggagtttatacaaatgagtatggtggcagagaaatgcaagatctgggaggaggagagagaatgacaggatttgaactaacagagggagttaaaacttcaggaatgcctgagatatgtcaagaatactctggaacattaagaagaaattctatgagggaatgtagagaaggaggtctgaatatgaatttcatggaaagctacttctgtcagaaagcatatgcttacgcagatgaagatgaaggacgcccatctaatgactgtttgctcatatatgacatcgaaggtgtaggttcccctgctggctctgtgggttgttgtagcttcattggagaagacctggatgacagcttcttggataccctgggacctaaatttaagaagttggcagacatcagcctaggaaaagaatcatatccagaccttgatccttcttggccaccacaaagcactgaaccagtttgccttcctcaggaaacagagcccgttgttagtggacacccaccaatctccccacatttcggcactaccacagtaatttctgagagcacctatccctcgggacctggtgtactgcatcctaagcctattctcgatcctctgggctatggtaatgtcactgtgaccgagtcttacaccacctctgacactctgaagccctctgtgcacgttcacgataaccgaccagcatcaaacgtggtagtgacagagagagtggtcggcccaatctctggcgctgatttgcatggaatgttagagatgcctgacttgcgagatgggtcgaatgttatagtgacagaaagggtaatagcaccaagctctagtctacccacctctctgactatccatcatcctagagagtcttcaaatgtggtagtgacagaaagagtaatccaaccaacttccggcatgataggtagtctgagtatgcaccccgagttagccaatgcccacaatgtcattgtgacagagagggttgtttctggtgctggcgtaactggaattagtggcaccactgggatcagcggtggcataggcagcagtggcctggttggcaccagcatgggtgctgggagcggtgccctgagtggagctggcataagtggtggtggcattggcctgagcagcttgggagggacagccagcattggccacatgaggagttcctctgaccatcactttaaccaaaccattgggtccgcctcccctagcacagctcgaagtcgaatcacaaagtatagtaccgtgcaatatagcaagtagtcaggaccccagctcactttttcatagtcattgtggtttagatccaattcccaccactaaaaaaccaacaatgtgatttataacgcacaacttcgtgctcaggtcatctaggagcaaggtgagaaatcacaatgagaaaaataaatggaaacaccactgctaggggagagctctccttagcattcataaacttttctcttatattaggactaaggaactaaaacttgaggcagagtcttctttgtgcctgagtggcctgtagtccatctccagcatgtaactggccttacgatggcaattggcatcattctccttgctctgttttgcttttccatatagctcgagcaaaattcaaaaagaactaaatatgcaatatatgttcatatctatgggaaaaatctaaaatgtgtgccagatgccctgttggtttcacagataacataaataaaaattcaaccacagatttatacaagggttaaccattttttttaagtttgactacatagtcaagtccacaagccatcaagcactcctaccttaattattgcactagagaaaataaattccaaattaggaagtgtttcctaggaggaaaattccattagagagtggcaataggatgaggtttcttcagggtaaactagcaatgcctgagcctgaaccttaatgtggggcctcagttaaatctcctgtggagtcaaggattcttctgattctagtgtgtgtttagtgatagatgtagtcttgacgaatattgcttactggtgaggttgaggaatatcacactcgtctttccctttaccactgtggttttgacttaagaaagcaaaactcactaagtttacttctcgaattgaagcaagtgaggcctgacatggttgtcatcactagtggcaaatgaccttccaagtaagcagatgggaactgaattgtgttttcaggttttgtttttagtaggtgatattcattcgtatccagctctttattacatagctctgaagttaaaatgatttacataggccgagctgtggacaaaaaaaaaagaagcagcagcttgtagtatgcttaagctttggggaatttttttttaaggggatctaaaaaaatgtttttagaacatgtaaaatgtttaatggtgaaagttggaaaagaattcttctgtaaagtaataccatgctaattattcgcttttagtaagtaaagtagtggttgctttagcaaacctctgctgccattttgcaggaatcaaccaggaacctttagcagaattgacaatatggtgttgataagcatgaaataataatagaaacctattctgctagtttatctcaccctctaatttttctcactagcataaattttaaattcctgatttgatttgtcaataagatcttggcttatatatgctgatttataggtagtgtccaaattatatagtataacatatttttctagtttcaaaatttagtaatgtcctatttatgatatatcatttctgtgtgtttgctatgtagtattacccaattaaaaatctctaaaaagaattaaagcattctaagaaaaaggtaaatttactattgcatggtacagaaattttttctttcttaaatacaatgttactataagctcactaaaatgaaactctatatgacaaaataaaattagaaaaaaatttgccctgga

SEQ ID NO: 8215 - DNA, 5652 bp, Homo sapiens
ctggagccgcgcctttgggttgggctgggctgggccgcgcaaccgccacgggaagacagccctcggggcggggagggagagggtggccgggccggggggaggccggggccagggaggagccgagtgcgcgctcggggcaggcggcggcgcggagcggtgcggcggcgggaggcggaggcgagggtgcgatggcgcggagcccgggacgcgcgtacgccctgctgcttctcctgatctgctttaacgttggaagtggacttcacttacaggtcttaagcacaagaaatgaaaataagctgcttcctaaacatcctcatttagtgcggcaaaagcgcgcctggatcaccgcccccgtggctcttcgggagggagaggatctgtccaagaagaatccaattgccaagatacattctgatcttgcagaagaaagaggactcaaaattacttacaaatacactggaaaagggattacagagccaccttttggtatatttgtctttaacaaagatactggagaactgaatgttaccagcattcttgatcgagaagaaacaccattttttctgctaacaggttacgctttggatgcaagaggaaacaatgtagagaaacccttagagctacgcattaaggttcttgatatcaatgacaacgaaccagtgttcacacaggatgtctttgttgggtctgttgaagagttgagtgcagcacatactcttgtgatgaaaatcaatgcaacagatgcagatgagcccaataccctgaattcgaaaatttcctatagaatcgtatctctggagcctgcttatcctccagtgttctacctaaataaagatacaggagagatttatacaaccagtgttaccttggacagagaggaacacagcagctacactttgacagtagaagcaagagatggcaatggagaagttacagacaaacctgtaaaacaagctcaagttcagattcgtattttggatgtcaatgacaatatacctgtagtagaaaataaagtgcttgaagggatggttgaagaaaatcaagtcaacgtagaagttacgcgcataaaagtgttcgatgcagatgaaataggttctgataattggctggcaaattttacatttgcatcaggaaatgaaggaggttatttccacatagaaacagatgctcaaactaacgaaggaattgtgacccttattaaggaagtagattatgaagaaatgaagaatcttgacttcagtgttattgtcgctaataaagcagcttttcacaagtcgattaggagtaaatacaagcctacacccattcccatcaaggtcaaagtgaaaaatgtgaaagaaggcattcattttaaaagcagcgtcatctcaatttatgttagcgagagcatggatagatcaagcaaaggccaaataattggaaattttcaagcttttgatgaggacactggactaccagcccatgcaagatatgtaaaattagaagatagagataattggatctctgtggattctgtcacatctgaaattaaacttgcaaaacttcctgattttgaatctagatatgttcaaaatggcacatacactgtaaagattgtggccatatcagaagattatcctagaaaaaccatcactggcacagtccttatcaatgttgaagacatcaacgacaactgtcccacactgatagagcctgtgcagacaatctgtcacgatgcagagtatgtgaatgttactgcagaggacctggatggacacccaaacagtggccctttcagtttctccgtcattgacaaaccacctggcatggcagaaaaatggaaaatagcacgccaagaaagtaccagtgtgctgctgcaacaaagtgagaaaaagcttgggagaagtgaaattcagttcctgatttcagacaatcagggttttagttgtcctgaaaagcaggtccttacactcacagtttgtgagtgtctgcatggcagcggctgcagggaagcacagcatgactcctatgtgggcctgggacccgcagcaattgcgctcatgattttggcctttctgctcctgctattggtaccacttttactgctgatgtgccattgcggaaagggcgccaaaggctttacccccatacctggcaccatagagatgctgcatccttggaataatgaaggagcaccacctgaagacaaggtggtgccatcatttctgccagtggatcaagggggcagtctagtaggaagaaatggagtaggaggtatggccaaggaagccacgatgaaaggaagtagctctgcttccattgtcaaagggcaacatgagatgtccgagatggatggaaggtgggaagaacacagaagcctgctttctggtagagctacccagtttacaggggccacaggcgctatcatgaccactgaaaccacgaagaccgcaagggccacaggggcttccagagacatggccggagctcaggcagctgctgttgcactgaacgaagaattcttaagaaattatttcactgataaagcggcctcttacactgaggaagatgaaaatcacacagccaaagattgccttctggtttattctcaggaagaaactgaatcgctgaatgcttctattggttgttgcagttttattgaaggagagctagatgaccgcttcttagatgatttgggacttaaattcaagacactagctgaagtttgcctgggtcaaaaaatagatataaataaggaaattgagcagagacaaaaacctgccacagaaacaagtatgaacacagcttcacattcactctgtgagcaaactatggttaattcagagaatacctactcctctggcagtagcttcccagttccaaaatctttgcaagaagccaatgcagagaaagtaactcaggaaatagtcactgaaagatctgtgtcttctaggcaggcgcaaaaggtagctacacctcttcctgacccaatggcttctagaaatgtgatagcaacagaaacttcctatgtcacagggtccactatgccaccaaccactgtgatcctgggtcctagccagccacagagccttattgtgacagagagggtgtatgctccagcttctaccttggtagatcagccttatgctaatgaaggtacagttgtggtcactgaaagagtaatacagcctcatgggggtggatcgaatcctctggaaggcactcagcatcttcaagatgtaccttacgtcatggtgagggaaagagagagcttccttgcccccagctcaggtgtgcagcctactctggccatgcctaatatagcagtaggacagaatgtgacagtgacagaaagagttctagcacctgcttccactctgcaatccagttaccagattcccactgaaaattctatgacggctaggaacaccacggtgtctggagctggagtccctggccctctgccagattttggtttagaggaatctggtcattctaattctaccataaccacatcttccaccagagttaccaagcatagcactgtacagcattcttactcctaaacagcagtcagccacaaactgacccagagtttaattagcagtgactaatttcatgtttccaatgtacctgatttttcatgagccttacagacacacagagacacatacacattgatcttaaaatttttctcagtcactgatatgcaaaggaccacactgtctctgcttccaggagtattttagaaatgttccacaatttactgaagacatagagatgatgctgctgcttaggtgccttttagcaagctatgcaaacaatcctgataaaacaagatacatagagagtcaatctggcttctgagaatttaccaagtgaacagagtacctagttcatcagccgtccagtaaagcaacccaggaaactgactgggtctctttgcctaccgtattaacattaaacattgatgttctgtattctgtactttactgcacccagcagactttcaacaactcattgatccaaagatacatgcacagtctgagcaccagctatggtgctcataacttctttaagacttgaaccctttcaatctgtgtgattcattaaattggaccattgatgataagaatacacattgtatgtttctgtgcacatgacagtgtgtgtgtgtgcacgtacatactgtatagtcttaaaaatagcattatactggccaggggtggtggctaacgcctgtaatcccagcactttgggaggccgaggcgggtggatcaactgtggtcaggagtttgagatcagccaggccaacctggtgaaaccccgtctctactaaaaatacaaaaattagctgggcgtgatggtgggcgcctgtaatcccagctacttgggaggctgaggcaggagaatcacttgaacccgggaggcggaggttgcagtgagccgagatcgcaccattgcactccagtctgggcaacagagtgagattccgtctcaaaaaaaaaaagaaaaggaaaaaaaaatagcattatacctcttccttgtctcaaccgccatgaaaattctgaacactccaaattcagttgaataatccaaaacaaaatttataagtataaaataattttacttcttatagtaatagtatactttaaaaagcctcagggtatattatcttctaaacagctacaattcagtgcagctacattaaccaactatgttctctagttgagaacaactaggcctatttcactgctgtgtagcctcagtgcctaacatgggtgccaaataaatattcgtagaattacactgaattgtaaaaaccattcgtttttgtttacaattgccaaaaatctcaaaaggccctgtatttatgtaattctttgaaattattattttattttgatttctcagttattgactggctgggtgtgacttagtacataagtactcaatattataaaaacctcaaataattgacttgattttacacaacatccttcccttttctacaagttaatttttttacaaatcatttgggttatctcctaaataggttatattttattgcttctagaaacaatgtttcaaaatatatgtgcattatcagtaataatttgtataaatatttcccacaacaattttcataattttcaaagactaatttcttgactgaagatattttgctagggaagtgaaactttaaaattttgtagattttaaaaaatattgttgaatggtgtcatgcaaaggatttatatagtgtgctcccactaactgtacagatcaggacacatatttttagacatctaagtctgtagcttaaatggaggttactcttccatcatctagaattgtttacttagtaattgttgtttcttttattattatagacttactatcagttttattttgccaagtatgcaacaggtatatcactagtatatgaaaatgtaaatatcacttgtgtactcaaacaaaagttggtcttaagcttccaccttgagcagccttggaaacctaacctgcctcttttagcataatcacattttctaaatgattttctttgttcctgaaaaagtgatttgtattagttttacatttgttttttggaagattatatttgtatatgtatcatcataaaatatttaaataaaaagtatctttagagtg

SEQ ID NO: 8216 - DNA, 3579 bp, Homo sapiens
caccacagttatcacccatgccctcctaaaagggtgtctcaaagcatatctttctgtagagcagaattcggaactgagaagacgagggctcaaattgaatctcacaggatttgcgtgcaagagaaacccaaaggaatggattggctcttcttcagaaacatttgccttttgatcattctaatggtggtgatggaagtaaacagtgaatttattgttgaggtgaaggaatttgacattgaaaatggcactacaaaatggcaaacagtcagaagacaaaagcgggagtggatcaagtttgccgcagcctgtcgagaaggagaggacaactcgaagaggaaccccattgccaaaattcgatcagactgcgaatcgaaccagaagataacataccggatttctggagtagggattgatcgaccaccatatggggtattcaccattaatcctcgcactggggaaattaacatcacttcagtggtagacagagaaataactccacttttcttgatctattgccgggctctgaattcacggggtgaagatttagaaaggcctcttgagcttagagtcaaagttatggacataaatgataacgctccagtcttttcgcaaagtgtatacacagccagcattgaagaaaatagtgatgccaatacattggtagtaaagttatgtgccacagatgcagatgaagaaaatcatctgaattctaaaattgcctacaagatcgtctctcaggagccatcaggtgcacccatgttcattctgaataggtacactggagaagtctgcaccatgtccagtttcttggacagagagcaacacagtatgtacaacctggttgtgagaggctcagatcgggatggagctgcagatggactgtcttctgagtgtgactgtagaatcaaggttttagacgtcaacgataatttccccaccttagagaaaacttcatactcagccagtattgaagagaattgtttaagttcggaactgatacgattacaagcaattgatcttgatgaagaaggcactgataactggttggctcaatatttaattctctctggaaatgatgggaattggttcgatattcaaacagatccacaaaccaatgaaggcattttgaaagttgtcaagatgctggattatgaacaagcacctaacattcagcttagtatcggagttaaaaaccaagctgattttcactactccgttgcttctcaattccaaatgcacccaacccctgtgagaattcaagttgttgatgtgagagaaggacctgcatttcatccaagtactatggcttttagtgtgcgggaaggaataaaaggaagttccttattgaattatgtgcttggcacatatacagccatagatttggacacaggaaaccctgcaacagatgtcagatatatcatagggcatgatgcaggcagctggttaaaaattgattcaagaactggtgagatacaattttctagagaatttgataagaagtcaaaatatattatcaatgggatatacacagcagagatcctggctatagatgatggctctggaaaaacagctacaggaaccatatgtattgaggttcctgatatcaatgattattgtccaaacatttttcctgaaagaagaaccatctgcattgactctccatcagtccttatctctgttaatgaacattcttatgggtctccgtttactttctgtgttgttgatgagccaccaggaatagctgacatgtgggatgtcagatcaacaaatgctacctcggcaatccttacggctaagcaggttttatctccaggattttatgaaatcccaatcctggtgaaggacagctataacagagcatgtgaattggcacaaatggtgcagttatatgcctgtgattgcgatgacaaccacatgtgcctggactctggtgccgcgggcatctacacagaggacataactggtgacacgtatgggcctgtcactgaagaccaagctggagtttcaaatgttggtcttggaccagcagggattggcatgatggttctgggcatcctgctactgattttggctccactcttgctgctcctgtgttgctgcaaacagagacagccagaaggcctgggaacaagatttgctcctgtgcctgagggcggagaaggagtgatgcagtcttggagaattgaaggggcccatcccgaggacagggatgtgtcaaatatatgtgcacccatgacagcctcaaatacccaggatcggatggattcctctgaaatctacaccaacacctatgcagccgggggcacggtggaaggaggtgtatcgggagtggagctcaacacaggtatggggacagccgttggcctcatggccgcaggggccgcaggagcctcaggggccgcaaggaagaggagctctaccatgggaaccctgcgggactacgctgacgcagacatcaacatggctttcttggacagctacttctcggagaaagcgtatgcttatgcagatgaagatgaaggtcgaccagccaatgactgcttgctcatttatgaccacgagggagtcgggtctcccgtaggctctattggttgttgcagttggattgtggatgacttagatgaaagctgcatggaaactttagatccaaaatttaggactcttgctgagatctgcttaaacacagaaattgaaccatttccttcacaccaggcttgtataccaatcagtactgacctccctttgctcggacctaattactttgttaatgaatcttcaggattgactccctcagaagttgaattccaagaagaaatggcagcatctgaacccgtggtccatggggatattattgtgactgagacttacggtaatgctgatccatgtgtgcaacccactacaattatttttgatcctcagcttgcacccaatgttgtagtaaccgaagcagtaatggcacctgtctatgatattcaagggaatatttgtgtacctgctgagttagcagattacaacaatgtaatctatgctgagagagtactggctagtcctggtgtgcctgacatgagcaatagtagcacgactgagggttgtatgggacctgtgatgagcggcaatattttagtagggccagaaattcaagtgatgcaaatgatgagtccagaccttcccataggccaaaccgttggctccacatcccccatgacatctcgacacagagtaacacgatacagtaacatacattacacccaacagtaagtgctttatggtcagtattctatgtggagaccttgcaccttgtaatcatcaatacatccaccaaaaatatataatgtaccatatatattaatagtcaacaaatactcagatattctaaggtcaatgccattatttgattataccattttgagggtgaatatggctaggcactttagataagcctttttaaaattctttctgattttaaataatgcgtcaaaaaatgtgcagaaaatgtattgcatcccttgatactgtctaacgaatagcacataactcatattgtgaatcctatgggtcttgaggcctgtagaaccaatc

SEQ ID NO: 8217 - DNA, 3637 bp, Homo sapiens
caccacagttatcacccatgccctcctaaaagggtgtctcaaagcatatctttctgtagagcagaattcggaactgagaagacgagggctcaaattgaatctcacaggatttgcgtgcaagagaaacccaaaggaatggattggctcttcttcagaaacatttgccttttgatcattctaatggtggtgatggaagtaaacagtgaatttattgttgaggtgaaggaatttgacattgaaaatggcactacaaaatggcaaacagtcagaagacaaaagcgggagtggatcaagtttgccgcagcctgtcgagaaggagaggacaactcgaagaggaaccccattgccaaaattcgatcagactgcgaatcgaaccagaagataacataccggatttctggagtagggattgatcgaccaccatatggggtattcaccattaatcctcgcactggggaaattaacatcacttcagtggtagacagagaaataactccacttttcttgatctattgccgggctctgaattcacggggtgaagatttagaaaggcctcttgagcttagagtcaaagttatggacataaatgataacgctccagtcttttcgcaaagtgtatacacagccagcattgaagaaaatagtgatgccaatacattggtagtaaagttatgtgccacagatgcagatgaagaaaatcatctgaattctaaaattgcctacaagatcgtctctcaggagccatcaggtgcacccatgttcattctgaataggtacactggagaagtctgcaccatgtccagtttcttggacagagagcaacacagtatgtacaacctggttgtgagaggctcagatcgggatggagctgcagatggactgtcttctgagtgtgactgtagaatcaaggttttagacgtcaacgataatttccccaccttagagaaaacttcatactcagccagtattgaagagaattgtttaagttcggaactgatacgattacaagcaattgatcttgatgaagaaggcactgataactggttggctcaatatttaattctctctggaaatgatgggaattggttcgatattcaaacagatccacaaaccaatgaaggcattttgaaagttgtcaagatgctggattatgaacaagcacctaacattcagcttagtatcggagttaaaaaccaagctgattttcactactccgttgcttctcaattccaaatgcacccaacccctgtgagaattcaagttgttgatgtgagagaaggacctgcatttcatccaagtactatggcttttagtgtgcgggaaggaataaaaggaagttccttattgaattatgtgcttggcacatatacagccatagatttggacacaggaaaccctgcaacagatgtcagatatatcatagggcatgatgcaggcagctggttaaaaattgattcaagaactggtgagatacaattttctagagaatttgataagaagtcaaaatatattatcaatgggatatacacagcagagatcctggctatagatgatggctctggaaaaacagctacaggaaccatatgtattgaggttcctgatatcaatgattattgtccaaacatttttcctgaaagaagaaccatctgcattgactctccatcagtccttatctctgttaatgaacattcttatgggtctccgtttactttctgtgttgttgatgagccaccaggaatagctgacatgtgggatgtcagatcaacaaatgctacctcggcaatccttacggctaagcaggttttatctccaggattttatgaaatcccaatcctggtgaaggacagctataacagagcatgtgaattggcacaaatggtgcagttatatgcctgtgattgcgatgacaaccacatgtgcctggactctggtgccgcgggcatctacacagaggacataactggtgacacgtatgggcctgtcactgaagaccaagctggagtttcaaatgttggtcttggaccagcagggattggcatgatggttctgggcatcctgctactgattttggctccactcttgctgctcctgtgttgctgcaaacagagacagccagaaggcctgggaacaagatttgctcctgtgcctgagggcggagaaggagtgatgcagtcttggagaattgaaggggcccatcccgaggacaggctttttagcgcctacgccttgccgggtggtggtggcaccgcagacggcggcggcagcgttttaggcagatgcgcgctgcaggcaactccagcgctgttaaaccaacatcctcccttttcagaaatctacaccaacacctatgcagccgggggcacggtggaaggaggtgtatcgggagtggagctcaacacaggtatggggacagccgttggcctcatggccgcaggggccgcaggagcctcaggggccgcaaggaagaggagctctaccatgggaaccctgcgggactacgctgacgcagacatcaacatggctttcttggacagctacttctcggagaaagcgtatgcttatgcagatgaagatgaaggtcgaccagccaatgactgcttgctcatttatgaccacgagggagtcgggtctcccgtaggctctattggttgttgcagttggattgtggatgacttagatgaaagctgcatggaaactttagatccaaaatttaggactcttgctgagatctgcttaaacacagaaattgaaccatttccttcacaccaggcttgtataccaatcagtactgacctccctttgctcggacctaattactttgttaatgaatcttcaggattgactccctcagaagttgaattccaagaagaaatggcagcatctgaacccgtggtccatggggatattattgtgactgagacttacggtaatgctgatccatgtgtgcaacccactacaattatttttgatcctcagcttgcacccaatgttgtagtaaccgaagcagtaatggcacctgtctatgatattcaagggaatatttgtgtacctgctgagttagcagattacaacaatgtaatctatgctgagagagtactggctagtcctggtgtgcctgacatgagcaatagtagcacgactgagggttgtatgggacctgtgatgagcggcaatattttagtagggccagaaattcaagtgatgcaaatgatgagtccagaccttcccataggccaaaccgttggctccacatcccccatgacatctcgacacagagtaacacgatacagtaacatacattacacccaacagtaagtgctttatggtcagtattctatgtggagaccttgcaccttgtaatcatcaatacatccaccaaaaatatataatgtaccatatatattaatagtcaacaaatactcagatattctaaggtcaatgccattatttgattataccattttgagggtgaatatggctaggcactttagataagcctttttaaaattctttctgattttaaataatgcgtcaaaaaatgtgcagaaaatgtattgcatcccttgatactgtctaacgaatagcacataactcatattgtgaatcctatgggtcttgaggcctgtagaaccaatct

SEQ ID NO: 8218 - DNA, 1940 bp, Homo sapiens
ttctagcctcctgcagaccagagaggacgcacccccacccctaaacactttctggtgaggcggaccctgccccgcagccttcagcagatgagggaagctcccctccgagactctggatagccgccgggggggcgttgcctggccggctggttgcgtagcaacggcaggcggtgcgtgacgtgcgcagccgcgttccgtcctgaggcgcgcccgccccggggtaagctcgcgccgccgcgtcagctcagcgctgggtctctcggtcccgcagccgtgaggaggacggtctgcatactcgctgcccgccggctccctcccccgcgtccctgcgaccgccgcggcgaagatggcctcaggagtgcaagtagctgatgaagtatgtcgcattttttatgacatgaaagttcgtaaatgctccacaccagaagaaatcaagaaaagaaagaaggctgtcattttttgtctcagtgcagacaaaaagtgcatcattgtagaagaaggcaaagagatcttggttggagatgttggtgtaaccataactgatcctttcaagcattttgtgggaatgcttcctgaaaaagattgtcgctatgctttgtatgatgcaagctttgaaacaaaagaatccagaaaagaagagttgatgttttttttgtgggcaccagaactagcacctctgaaaagtaaaatgatctatgcaagctccaaggatgcaattaaaaagaaatttcaaggcataaaacatgaatgtcaagcaaatggaccagaagatctcaatcgggcttgtattgctgaaaagttaggtggatccttaattgtagcctttgaaggatgccctgtgtagattattcagtgccacaaattgaaagcttccatgtttaatgttatcctcttgctatataaataaagcaaatatatttaggccagggtctcactgagggggagctgtcttgtcatcttttagagtaaactattctataaacatatgcaaacagccctaaataaatctaaagtctaaagttttattgatgtgaaattaaattcttattggccaaatgcctgttttgatgagttgatttataaagatttttgttaagctcaggattttaaattacacagttcacaaacagtaaaggccatgtgaagagaattattacatctttattaacctcagcatttactttgtttcttttgcttaggaaattgctcataatctggttataattttggtccaaattctttattcttccttgagctaagcagaataatggaatataatatgtcttcataatataacaacactaatacactaatagtaagattaagttaggcagtcttctaccaaatgtgtaatggagattgcctcaaaattgtgtccacataatccacgctcatcttgcaaagcgctatttcaggcacatcattggaatacaggaagtagccctgcacctgccagtgagctcgccattcactgattggaagagtgacctggcatcttggaaatcattgtgtgtcttcaggagaatgtgcagtgtcttgtaacaactaattataatgcaaattagggctacattgtaatctgctttgttaatgaaaatgataaaacagaatattgacaagctaggacacctgtggtatctttaattgtatctccttcagaagtttgcttcttatggtataataaagtatggaagaatattgagtatatgtttactctgggcctgggagaacttaactttctagagcagtttgttgacttgtgtgcaatggggagaggtaccatgatgacactcacagggagccactgttcactgacacttggaagcggtcattgttaatatcacgggcgtaacactttgaacgatatagagatgcacaaacagttgaacttagaagtagcagtattggctttatgtaataaaggaagcatttttgactta

SEQ ID NO: 8219 - DNA, 1746 bp, Homo sapiens
gggaagctcccctccgagactctggatagccgccgggggggcgttgcctggccggctggttgcgtagcaacggcaggcggtgcgtgacgtgcgcagccgcgttccgtcctgaggcgcgcccgccccggggtaagctcgcgccgccgcgtcagctcagcgctgggtctctcggtcccgcagccgtgaggaggacggtctgcatactcgctgcccgccggctccctcccccgcgtccctgcgaccgccgcggcgaagatgattttcagttcacccactagaggcaaagacgtaagagagctaccagcgtattgagaggagatacacaggcactacgagaatggagtttagaagaaggtcagagccctgggcagtgttgggccaggctttagggcctcaggagtgcaagtagctgatgaagtatgtcgcattttttatgacatgaaagttcgtaaatgctccacaccagaagaaatcaagaaaagaaagaaggctgtcattttttgtctcagtgcagacaaaaagtgcatcattgtagaagaaggcaaagagatcttggttggagatgttggtgtaaccataactgatcctttcaagcattttgtgggaatgcttcctgaaaaagattgtcgctatgctttgtatgatgcaagctttgaaacaaaagaatccagaaaagaagagttgatgttttttttgtgggcaccagaactagcacctctgaaaagtaaaatgatctatgcaagctccaaggatgcaattaaaaagaaatttcaaggcataaaacatgaatgtcaagcaaatggaccagaagatctcaatcgggcttgtattgctgaaaagttaggtggatccttaattgtagcctttgaaggatgccctgtgtagattattcagtgccacaaattgaaagcttccatgtttaatgttatcctcttgctatataaataaagcaaatatatttaggccagggtctcactgagggggagctgtcttgtcatcttttagagtaaactattctataaacatatgcaaacagccctaaataaatctaaagtctaaagttttattgatgtgaaattaaattcttattggccaaatgcctgttttgatgagttgatttataaagatttttgttaagctcaggattttaaattacacagttcacaaacagtaaaggccatgtgaagagaattattacatctttattaacctcagcatttactttgtttcttttgcttaggaaattgctcataatctggttataattttggtccaaattctttattcttccttgagctaagcagaataatggaatataatatgtcttcataatataacaacactaatacactaatagtaagattaagttaggcagtcttctaccaaatgtgtaatggagattgcctcaaaattgtgtccacataatccacgctcatcttgcaaagcgctatttcaggcacatcattggaatacaggaagtagccctgcacctgccagtgagctcgccattcactgattggaagagtgacctggcatcttggaaatcattgtgtgtcttcaggagaatgtgcagtgtcttgtaacaactaattataatgcaaattagggctacattgtaatctgctttgttaatgaaaatgataaaacagaatattgacaagctaggacacctgtggtatctttaattgtatctccttcagaagtttgcttcttatggtataataaagtatggaagaatattgagta

SEQ ID NO: 8220 - DNA, 1383 bp, Homo sapiens
agccctttgtttatggcctgatctagctaaggcttctagacttcaggagcttaagaatcgtccggagggctgggcgtggcggtgcaggcctgtagtcccacccactccgaaggctgcggagggaggatcaacttgagtctgggaactcagccaggaattcaagaccagcctgggcaacacagtgaggccccctacccacatcctctccgtccccgcaatctccttccatcccagggtgttgctgaaaatgtcagatgcaaatttggatagcagcaagaagaatttcttggagggggaagtagatgatgaggaaagtgtgattttgacactggtgccagttaaagatgacgcaaatatggaacaaatggaaccaagcgtttcttcaacttctgatgtcaaactggagaagcctaagaaatacaatccaggtcatctacttcaaacaaatgagcaatttacagctccacaaaaagctagatgcaaaataccagcccttcccttgccgaccattttgcctcccattaataaggtgtgtcgggacactttgcgggactggtgtcaacaactcggtttgagtactaatggcaagaaaatcgaagtttatctgaggcttcataggcatgcttaccctgaacaacggcaagatatgcctgaaatgtcacaagagaccagattacagcgatgttcgaggaaacgcaaggcagtgaccaagagagcaaggcttcagagaagttatgagatgaatgagagagcagaagagaccaatacagttgaagtgataacttcagcaccgggagccatgttggcatcatgggcaagaattgctgcaagagctgttcagcctaaggctttgaattcatgttccattcctgtttctgttgaggcctttttgatgcaagcctctggcgtcaggtggtgtgtggtccatggcagacttctctcggcagacacaaagggttgggtacgcctgcagtttcatgcaggtcaggcctgggtgcctaccactcacaggaggatgatttctctcttcttgttacctgcctgcattttcccatccccaggcatagaagataatatgttatgccccgactgtgctaagaggaataagaagatgatgaaaagattaatgacagtagagaagtagcagcaacctgtttgaatacaatgtactaaaggagggatgtactttcagatcatgtaacctattacgaaggagtggaagaggagacaatttgaatgaatcctcatgatctacaaaacaaaatcatagtgactaggactccacagtgaagatggttgactagtgacacagccccatctaaagaatccctttctgtatgtctgaaaacccattaaaataaagtcactgcaattggccttgta

SEQ ID NO: 8221 - DNA, 1079 bp, Homo sapiens
tggagctccggttttcagcctctttccgggctacctggtagcaatttgaggctctgtcatcagtttctgctacgtttcaaagatcctggagaagcctagtgttgtgtcaagacgccgatggacccatcacagtttaatccaacctacatcccagggtctccacaaatgctcaccgaagaaaattcccgggacgattcaggggcctctcaaatctcctccgagacgttgataaagaaccttagtaacttgactatcaacgctagtagcgaatctgtttcccctctatcggaagctttactccgtcgagagtctgtaggagcagcagtcctcagggaaatcgaagatgagtggctttacagcaggagaggagtaagaacattgctgtctgtgcagagagaaaagatggcaagattgagatacatgttactcggcggagttcgtacgcatgaaagaagaccaacaaacaaggagcctaagggagttaagaaggaatcaagaccattcaaatgtccctgcagtttctgcgtgtctaatggatgggatccttctgagaatgctagaatagggaatcaagacaccaagccacttcagccataaatcttattcttgcacctttttttcttggtagtaattttatatagcaggttgagaaagctactctatgctagtatagactatacaccaataattttgataatgagttctaggatgtatttttcttgtatctttttcttcctactatgatactagtaattcataagggatctgtgtaatctgaatgtatttgaataactttagctctactgtttgatttgacccaaagaagccaagatgatataagtattcccatgtgtcttagaagcccaaagtcagtgagatgaaacccaacatcaagaaattgaagcaaagttacttatggataaagaaagcattaggtagttgggctatagcataattagattttctggctttcaaaaatttggattgcaatcacagcaaactttgttatttttacagttttcagtacaaaagtgtttatatagaaacaataaagttgacatttgagtaccttttaaaaa

SEQ ID NO: 8222 - DNA, 2817 bp, Homo sapiens
aagtgggaggagactttgcaaatagcaatcttggggcaggggccattttggaagcatgttgcgaggctccgcttcttctacaagtatggagaaggcaaaaggcaaggagtggacctccacagagaagtcgagggaagaggatcagcaggcttctaatcaaccaaattcaattgctttgccaggaacatcagcaaagagaaccaaagaaaaaatgtctatcaaaggcagtaaagtgctctgccctaagaaaaaggcagagcacactgacaaccccagacctcagaagaagataccaatccctccattaccttctaaactgccacctgttaatctgattcaccgggacattctgcgggcctggtgccaacaattgaagctgagctccaaaggccagaaattggatgcatataagcgcctgtgtgcctttgcctacccaaatcaaaaggattttcctagcacagcaaaagaggccaaaatccggaaatcattgcaaaaaaaattaaaggtggaaaagggggaaacgtccctgcaaagttctgagacacatcctcctgaagtggctcttcctcctgtgggggagccgcctgccctggaaaattccactgctctccttgagggagttaatacagttgtggtgacaacttctgccccagaggctttgctggcctcctgggcgagaatttcagccagggcgaggacaccagaggcagtggaatctccacaagaggcctctggtgtcaggtggtgtgtggtccatgggaaaagtctccctgcagacacagatggttgggttcacctgcagtttcatgctggtcaagcctgggttccagaaaagcaagaagggagagtgagtgcactcttcttgcttcctgcctccaattttccacccccgcaccttgaagacaatatgttgtgccccaaatgtgttcacaggaacaaggtcttaataaaaagcctccaatgggaatagaatatcaggaaaaaggccacatctatggtaattaatggcagaaaagctggagagttggattctgcggtgctgctgacaggtgaactctggtcctctgcacctgtttatgggccatgcagactggtggggtggcagatgttagcctaagacccctagcagtgcctgttgctttgtgagtggagatagagactcttacatttaaaaatggaaaaacatttcacaaattaccataaattgtagttaatatgtagaaaaactcattcatactacttttctaaaatagacatgacttcagcagcagcttttttttgttgtattttgagacagtgtctcactgttgcccaggctggagtgcagtggtgcaatctcagttcagtgcaatctccgcctcctgggttcaaatgattctcctgcctcagcctcctgagtagctaggtacaggcacctgccaccacacccagctaattttttgtatttttagtagagatggggtttcaccatgttggccaggttggtctcaaactcctggactcaagtgatcaccctcctcagcctcccaaaatgctgggactatgggcatgagcccctgcgcctgaccttcaacagctcttttaagtgagttcttcagctaagcattgtgatggacttgagtaaaatggtagttggctcttgtgctcaattttctcttcctctgaacactgactactttaggagctgcttcattccaattgcaatttcataaaacgtaaagtattttaaggcaaagaaaggctgttaattccctccctcccccaaacacatgatttttaatattctaaacaatatttttcaaagttctcttaataacctgagatttctatggtttgactccaggatcaaaacacaagggactttgtattatttcacttataattgttttgtatatttctggagtttaaaatgtttaaggttgcttcccgctcataaatacataatatattgaatttaaaatgtgtttattaaccgattctccataaataaaaataagatgtgtatgtaaaataattcatctgttgtatttagagaaccatattcattgcatgcaaattttattgttagtgttcttaactcaagtaggagtaaaccaaaaagtgtgatttttcttttgtatgactcgtttgttctttattagttggtggtatgggttggatcatttgtttttaaaactacttaggtatgattcacatacaaaaagctgcacatatttaatgtatcctattgtgtaattaatttttaatttttttgtgtacttcctaaacttatagtcctgcgagtctgggaacagatctgtttttcacttatcctgatttaatgacagtttccaacattgttttgttattacaagtaggggatctttttttttgcccgtttaatgaagatactaaaaataatgcactggaaggagtggaagagttggaaaatttgtaaccatcataatacaggtgtaataggtttgggaaagaatcctcaaaaatgttaaagcaagggaggaaagtttgttgagaagcaagatgttcttctctcctgcccgcccccgccgttggttgttggtggtcagaattattgtgtaataaataatagacattttttcttatactatgtgtattgttccttttgtttcctttttaaacttctcccctgctttatttggatgggtcaagtttctgttctgtttccttcctttctattaatttggaaatgtccttggctttacgattctgcttgtagatacttcccctgcttctaacacatttcaataaacttaaatttctctatatacaaaataaattaataattggagtctacca

SEQ ID NO: 8223 - DNA, 679 bp, Homo sapiens
cctgagcctcggccggcgtgattaggcctggtttgcgctggagagtggtcttggttgtgagggtcataagatgggaactctcccggcacgtagacatatcccgccgtgggtgaaagttcccgaagacctgaaagatccagaggtgttccaggtccagacgcggctgctgaaagccattttcggcccggacggatctcgaatcccttacatcgagcaggtgagcaaggccatgctcgagctgaaggctctggagtcttcagacctcaccgaggtcgtggtttacggctcctatttgtacaagctccggaccaagtggatgctccagtccatggctgagtggcaccgccagcgccaggagcgagggatgctcaaacttgccgaagccatgaatgccctcgaactaggcccttggatgaagtgaaccagtttccagccaatgcaatgaagccgggttgcagagattaggttgtggccagagctagagtgattccttaagcttgttttaaaatctgctccagcctaaagagttaagggaaaaccatttgttcccttaaagagttaagggaaaacccttggctctgagtcttgttgtgaatatttctttgatgattgttaataaaaagtgttttttcttttttcccatttttaaaaataacaataaagttttaaataagttgat

SEQ ID NO: 8224 - DNA, 1746 bp, Homo sapiens
cagccccacgctttgcgactcgcggtgacccctacgcggaactctctcgcggtaattcgaagtaccgcgcctgcgtgctgcagtagcgcctggtggcggtggcagtttgcccgcgggtgtgtgaagggagacagtgtggaggccacagggtactcgccacgatgagcagcaccttagctaagatcgcggagatagaagcagagatggctcggactcaaaagaacaaggccacagcacaccacttagggctgcttaaggctcgtcttgctaagcttcgtcgagaactcattactccaaagggtggtggtggtggaggtccaggagaaggttttgatgtggccaagacaggtgatgctcgaattggatttgttggttttccatctgtggggaagtcaacactgcttagtaacctggcaggggtatattctgaggtggcagcctatgaattcactactctgaccactgtgcctggtgtcatcagatacaaaggtgccaagatccagctcctggatctcccaggtatcattgaaggtgccaaggatgggaaaggtagaggtcgtcaagtcattgcagtggcccgaacctgtaacttgatcttgattgttctggatgtcctgaaacctttgggacataagaagataattgaaaatgagctggaaggctttggcattcgcttgaacagcaaaccccccaacattggctttaagaagaaggacaagggaggcattaatctcacagccacttgcccccagagtgagctggatgctgaaactgtgaagagcattctggctgaatacaagattcataatgccgatgtgactctacgtagtgatgctacagctgatgacctcattgatgtggtggaaggaaacagagtttatatcccctgtatctatgtgttaaataagattgaccaaatctccattgaggaattggatatcatctataaggtgcctcactgtgtacccatctctgcccatcaccgctggaattttgatgacctattggaaaagatctgggactatctgaaactagtgagaatttacaccaaacccaaaggccagttaccagattacacatccccagtggtgcttccttactccaggaccacagtggaggatttctgcatgaagattcacaaaaatcttatcaaagaatttaaatatgctctggtctggggtctctctgtgaaacacaatcctcagaaagtgggtaaagaccatacgttggaggatgaggatgtcattcaaattgtgaagaagtgaaacctttcccttttcccatctgccggacgaaccacaacagcgttccccatgatcaagcaccctaccccagttctttctggttttggcagtcactggatcaggatccaggggagggagatggaggcacccaaactggaacttcatttgtcttaccttggtgtcaccttgtatgtcgaactgcataaaagatctggtaggctggtcagctacatgcagctcatgtgtcattgtcagaatttgttttgggatgggctgaatgaggaagggtatatacggtgaagcagctacagaagggatccttgggaacttcatcttgagtgtgaaatggataaaaatatgacatgctgcatcttacttgatgtttacttatgggaaccccttccaaactagatatggctttcagtcctttcaagtagtctttcccacatgatactggagagaggaaggactttatgtaagttaattgatcactccccgcaag

SEQ ID NO: 8225 - DNA, 1892 bp, Homo sapiens
cgccgtcagaccggaattgccggtgccgccgccaccgctgtctgtgcgcccacctctgctgctaccatggggatcttagagaagatctcggagatcgagaaggagatcgctcggacacagaagaacaaggccactgagtatcatctgggcctgctgaaagctaagctcgccaagtatcgggcccagctcctggaaccgtccaaatcggcctcgtccaaaggagagggctttgatgtcatgaagtcgggtgatgcccgtgtggcgctgattggatttccctctgtgggtaagtccacattcttgagtctgatgacctccacggccagcgaggcagcgtcctatgagttcaccactctgacgtgtattcctggggtcattgaatacaaaggtgccaacatccagctcctggaccttcctggaatcattgaaggcgcagcccaaggaaaaggccgtggccggcaggtgatcgctgtggcgcgcacggctgacgtcatcatcatgatgctggatgccaccaagggagaggtgcagaggtctctgctggagaaggagctggagtctgtgggcatccgcctcaacaagcacaagcctaacatctacttcaagcccaagaaaggtggtggcatctcctttaactcgacagtcacgctgacccagtgctcggaaaagctggtgcagctcatcctgcacgaatacaagatcttcaatgcagaagtgcttttccgagaagactgctccccggacgagttcatcgatgtgatcgtgggcaaccgggtgtacatgccctgcctgtatgtttataacaaaatcgaccagatctccatggaagaggtggaccgcctggcccgaaaacccaacagtgtggtcatcagctgcggcatgaagctgaacctggactatctgctggagatgctttgggagtacttggccctgacctgcatctacaccaagaagagaggacagaggccagacttcacagacgccatcattctccggaaaggggcctcagtggagcacgtgtgccaccgcatccaccggtcactcgccagccagttcaagtacgccctggtgtggggcaccagcaccaagtacagtccgcagcgggtgggcctgacccacaccatggagcatgaggacgtcatccagatcgtgaagaagtaacggcgcctgccgggcctcccgcccacctgcctcgtctccctggggaggtggtcccactgggacacacaaacacccaaacagaaaaatacaaatacacgtaccccaggaaggggtccctcaagtctctgctatttacagaagtttcttcagtaggcagacgaagagtgtgttggggcaaaggggctcggttggaggcatttcccataagactgagccctctcatgggggttttgagtttgtagtgctgagcctgcatctgtgcctcccagccccctgcactgagggagcaagttgcccacatgcccgccagccagggcctaaagcagatggcatgctcagtgccaggctggtagctgggcctgtttgggtccctggaggctgtggctgctgtcatggcacctcactccctcagctcttgccagcttctctgacacttgggttgggggcccttccaggaggaaacccccttgggtgccccacacagggctctccatgatgggaaccagtggttagtggcttcaaaggcccagctgacaccctccacagcctaaggggtgtcctaaagtgcctccccctgtattccccctcccagggcagcccctgcccagcacaaaaccccaggaccctggctctgcacgcctggggcagggacttttgagtttaggatctgtattttctaagtccccagttctcctggctctcctttctgaaataaaggattgaaaacggtt

SEQ ID NO: 8226 - DNA, 1909 bp, Homo sapiens
tctttggcttccgggcgcacgctactctgtcgccgccgtcagaccggaattgccggtgccgccgccaccgctgtctgtgcgcccacctctgctgctaccatggggatcttagagaagatctcggagatcgagaaggagatcgctcggacacagaagaacaaggccactgagtatcatctgggcctgctgaaagctaagctcgccaagtatcgggcccagctcctggaaccgtccaaatcggcctcgtccaaaggagagggctttgatgtcatgaagtcgggtgatgcccgtgtggcgctgattggatttccctctgtgggtaagtccacattcttgagtctgatgacctccacggccagcgaggcagcgtcctatgagttcaccactctgacgtgtattcctggggtcattgaatacaaaggtgccaacatccagctcctggaccttcctggaatcattgaaggcgcagcccaaggaaaaggccgtggccggcaggtgatcgctgtggcgcgcacggctgacgtcatcatcatgatgctggatgccaccaagggagaggtgcagaggtctctgctggagaaggagctggagtctgtgggcatccgcctcaacaagcacaagcctaacatctacttcaagcccaagaaaggtggtggcatctcctttaactcgacagtcacgctgacccagtgctcggaaaagctggtgcagctcatcctgcacgaatacaagatcttcaatgcagaagtgcttttccgagaagactgctccccggacgagttcatcgatgtgatcgtgggcaaccgggtgtacatgccctgcctgtatgtttataacaaaatcgaccagatctccatggaagaggtggaccgcctggcccgaaaacccaacagtgtggtcatcagctgcggcatgaagctgaacctggactatctgctggagatgctttgggagtacttggccctgacctgcatctacaccaagaagagaggacagaggccagacttcacagacgccatcattctccggaaaggggcctcagtggagcacgtgtgccaccgcatccaccggtcactcgccagccagttcaaggcaccagcaccaagtacagtccgcagcgggtgggcctgacccacaccatggagcatgaggacgtcatccagatcgtgaagaagtaacggcgcctgccgggcctcccgcccacctgcctcgtctccctggggaggtggtcccactgggacacacaaacacccaaacagaaaaatacaaatacacgtaccccaggaaggggtccctcaagtctctgctatttacagaagtttcttcagtaggcagacgaagagtgtgttggggcaaaggggctcggttggaggcatttcccataagactgagccctctcatgggggttttgagtttgtagtgctgagcctgcatctgtgcctcccagccccctgcactgagggagcaagttgcccacatgcccgccagccagggcctaaagcagatggcatgctcagtgccaggctggtagctgggcctgtttgggtccctggaggctgtggctgctgtcatggcacctcactccctcagctcttgccagcttctctgacacttgggttgggggcccttccaggaggaaacccccttgggtgccccacacagggctctccatgatgggaaccagtggttagtggcttcaaaggcccagctgacaccctccacagcctaaggggtgtcctaaagtgcctccccctgtattccccctcccagggcagcccctgcccagcacaaaaccccaggaccctggctctgcacgcctggggcagggacttttgagtttaggatctgtattttctaagtccccagttctcctggctctcctttctgaaataaaggattgaaaacggtt

SEQ ID NO: 8227 - DNA, 2617 bp, Homo sapiens
agtttcagtttccatttctgatttctgctctctgcgctgagcacagcggcaccaggctgagctaagcagggccgccttgggcaggcctacgtggtggtgcaggcgagacccaggctgggcaaggcgcagtttcagtttccatcttgggtctctgagctgagcagagtggcaccaggctgagttaagtgggactgccctgggcagacctacctactagagcagaatggagcttcggtcctaccaatgggaggtgatcatgcctgccctggagggcaagaatatcatcatctggctgcccacgggtgccgggaagacccgggcggctgcttatgtggccaagcggcacctagagactgtggatggagccaaggtggttgtattggtcaacagggtgcacctggtgacccagcatggtgaagagttcaggcgcatgctggatggacgctggaccgtgacaaccctgagtggggacatgggaccacgtgctggctttggccacctggcccggtgccatgacctgctcatctgcacagcagagcttctgcagatggcactgaccagccccgaggaggaggagcacgtggagctcactgtcttctccctgatcgtggtggatgagtgccaccacacgcacaaggacaccgtctacaacgtcatcatgagccagtacctagaacttaaactccagagggcacagccgctaccccaggtgctgggtctcacagcctccccaggcactggcggggcctccaaactcgatggggccatcaaccacgtcctgcagctctgtgccaacttggacacgtggtgcatcatgtcaccccagaactgctgcccccagctgcaggagcacagccaacagccttgcaaacagtacaacctctgccacaggcgcagccaggatccgtttggggacttgctgaagaagctcatggaccaaatccatgaccacctggagatgcctgagttgagccggaaatttgggacgcaaatgtatgagcagcaggtggtgaagctgagtgaggctgcggctttggctgggcttcaggagcaacgggtgtatgcgcttcacctgaggcgctacaatgacgcgctgctcatccatgacaccgtccgcgccgtggatgccttggctgcgctgcaggatttctatcacagggagcacgtcactaaaacccagatcctgtgtgccgagcgccggctgctggccctgttcgatgaccgcaagaatgagctggcccacttggcaactcatggcccagagaatccaaaactggagatgctggaaaagatcctgcaaaggcagttcagtagctctaacagccctcggggtatcatcttcacccgcacccgccaaagcgcacactccctcctgctctggctccagcagcagcagggcctgcagactgtggacatccgggcccagctactgattggggctgggaacagcagccagagcacccacatgacccagagggaccagcaagaagtgatccagaagttccaagatggaaccctgaaccttctggtggccacgagtgtggcggaggaggggctggacatcccacattgcaatgtggtggtgcgttatgggctcttgaccaatgaaatctccatggtccaggccaggggccgtgcccgggccgatcagagtgtatacgcgtttgtagcaactgaaggtagccgggagctgaagcgggagctgatcaacgaggcgctggagacgctgatggagcaggcagtggctgctgtgcagaaaatggaccaggccgagtaccaggccaagatccgggatctgcagcaggcagccttgaccaagcgggcggcccaggcagcccagcgggagaaccagcggcagcagttcccagtggagcacgtgcagctactctgcatcaactgcatggtggctgtgggccatggcagcgacctgcggaaggtggagggcacccaccatgtcaatgtgaaccccaacttctcgaactactataatgtctccagggatcctgtggtcatcaacaaagtcttcaaggactggaagcctgggggtgtcatcagctgcaggaactgtggggaggtctggggtctgcagatgatctacaagtcagtgaagctgccagtgctcaaagtccgcagcatgctgctggagacccctcaggggcggatccaggccaaaaagtggtcccgcgtgcccttctccgtgcctgactttgacttcctgcagcattgtgccgagaacttgtcggacctctccctggactgaccacctcattgctgcagtgcccggtttgggctgtagggggcgggagagtctgcagcagactccaggcccctccttcctgaatcatcagctgtgggcatcaggcccaccagccacacaggagtcctgggcaccctggcttaggctcccgcaatgggaaaacaaccggagggccagagcttagtccagacctaccttgtacgcacatagacattttcatatgcactggatggagttagggaaactgaggcaaaagaatttgccatactgtactcagaatcacgacattccttccctaccaaggccacttctattttttgaggctcctcataaaaataaatgaaaaaatgggatagaaaa

SEQ ID NO: 8228 - DNA, 1072 bp, Homo sapiens
tctcttggttctttttcctggggcggggatgggagattcctaagtcggctcagctggctccttccctcagtttcagtttccatcttgggtctctgagctgagcagagtggcaccaggctgagttaagtgggactgccctgggcagacctacctactagagcagaatggagcttcggtcctaccaatgggaggtgatcatgcctgccctggagggcaagaatatcatcatctggctgcccacgggtgccgggaagacccgggcggctgcttatgtggccaagcggcacctagagactgtggatggagccaaggtggttgtattggtcaacagggtgcacctggtgacccagcatggtgaagagttcaggcgcatgctggatggacgctggaccgtgacaaccctgagtggggacatgggaccacgtgctggctttggccacctggcccggtgccatgacctgctcatctgcacagcagagcttctgcagatggcactgaccagccccgaggaggaggagcacgtggagctcactgtcttctccctgatcgtggtggatgagtgccaccacacgcacaaggacaccgtctacaacgtcatcatgagccagtacctagaacttaaactccagagggcacagccgctaccccaggtgctgggtctcacagcctccccaggcactggcggggcctccaaactcgatggggccatcaaccacgtcctgcagctctgtgccaacttggacacgtggtgcatcatgtcaccccagaactgctgcccccagctgcaggagcacagccaacagccttgcaaacagtacaacctctgccacaggcgcagccaggatccgtttggggacttgctgaagaagctcatggaccaaatccatgaccacctggagatgcctgagttgagccggaaatttgggacgcaaatgtatgagcagcaggtggtgaagctgagtgaggctgcggctttggctgggcttcaggagcaacgggtgtatgcgcttcacctgaggcgctacaatgacgcgctgctcatccatgacaccgtccgcgccgtggatgcctt

SEQ ID NO: 8229 - DNA, 2227 bp, Homo sapiens
tttctcttggttctttttcctggggcggggatgggagattcctaagtcggctcagctggctccttccctcagtttcagtttccatcttgggtctctgagctgagcagagtggcaccaggctgagttaagtgggactgccctgggcagacctacctactagagcagaatggagcttcggtcctaccaatgggaggtgatcatgcctgccctggagggcaagaatatcatcatctggctgcccacgggtgccgggaagacccgggcggctgcttatgtggccaagcggcacctagagactgtggatggagccaaggtggttgtattggtcaacagggtgcacctggtgacccagcatggtgaagagttcaggcgcatgctggatggacgctggaccgtgacaaccctgagtggggacatgggaccacgtgctggctttggccacctggcccggtgccaccacacgcacaaggacaccgtctacaacgtcatcatgagccagtacctagaacttaaactccagagggcacagccgctaccccaggtgctgggtctcacagcctccccaggcactggcggggcctccaaactcgatggggccatcaaccacgtcctgcagctctgtgccaacttggacacgtggtgcatcatgtcaccccagaactgctgcccccagctgcaggagcacagccaacagccttgcaaacagtacaacctctgccacaggcgcagccaggatccgtttggggacttgctgaagaagctcatggaccaaatccatgaccacctggagatgcctgagttgagccggaaatttgggacgcaaatgtatgagcagcaggtggtgaagctgagtgaggctgcggctttggctgggcttcaggagcaacgggtgtatgcgcttcacctgaggcgctacaatgacgcgctgctcatccatgacaccgtccgcgccgtggatgccttggctgcgctgcaggatttctatcacagggagcacgtcactaaaacccagatcctgtgtgccgagcgccggctgctggccctgttcgatgaccgcaagaatgagctggcccacttggcaactcatggcccagagaatccaaaactggagatgctggaaaagatcctgcaaaggcagttcagtagctctaacagccctcggggtatcatcttcacccgcacccgccaaagcgcacactccctcctgctctggctccagcagcagcagggcctgcagactgtggacatccgggcccagctactgattggggctgggaacagcagccagagcacccacatgacccagagggaccagcaagaagtgatccagaagttccaagatggaaccctgaaccttctggtggccacgagtgtggcggaggaggggctggacatcccacattgcaatgtggtggtgcgttatgggctcttgaccaatgaaatctccatggtccaggccaggggccgtgcccgggccgatcagagtgtatacgcgtttgtagcaactgaaggtagccgggagctgaagcgggagctgatcaacgaggcgctggagacgctgatggagcaggcagtggctgctgtgcagaaaatggaccaggccgagtaccaggccaaggaactactataatgtctccagggatcctgtggtcatcaacaaagtcttcaaggactggaagcctgggggtgtcatcagctgcaggaactgtggggaggtctggggtctgcagatgatctacaagtcagtgaagctgccagtgctcaaagtccgcagcatgctgctggagacccctcaggggcggatccaggccaaaaagtggtcccgcgtgcccttctccgtgcctgactttgacttcctgcagcattgtgccgagaacttgtcggacctctccctggactgaccacctcattgctgcagtgcccggtttgggctgtagggggcgggagagtctgcagcagactccaggcccctccttcctgaatcatcagctgtgggcatcaggcccaccagccacacaggagtcctgggcaccctggcttaggctcccgcaatgggaaaacaaccggagggccagagcttagtccagacctaccttgtacgcacatagacattttcatatgcactggatggagttagggaaactgaggcaaaagaatttgccatactgtactcagaatcacgacattccttccctaccaaggccacttctattttttgaggctcctc

SEQ ID NO: 8230 - DNA, 730 bp, Homo sapiens
gctctggccaggagttgggatgagtggagggcccagtgggtctgagtcccctgccattcccagaatggagctgtggccctaccaatgggaggtgatcatgcctgccagggcgctggcgcagcagcagtacttaaccggagtttgtactcacggcagttggcgatgacttttcagtttccatcttgggtctctgagctgagcagagtggcaccaggctgagttaagtgggactgccctgggcagacctacctactagagcagaatggagcttcggtcctaccaatgggaggtgatcatgcctgccctggagggcaagaatatcatcatctggctgcccacgggtgccgggaagacccgggcggctgcttatgtggccaagcggcacctagagactgtggatggagccaaggtggttgtattggtcaacagggtgcacctggtgacccagcatggtgaagagttcaggcgcatgctggatggacgctggaccgtgacaaccctgagtggggacatgggaccacgtgctggctttggccacctggcccggtgccatgacctgctcatctgcacagcagagcttctgcagatggcactgaccagccccgaggaggaggagcacgtggagctcactgtcttctccctgatcgtggtggatgagtgccaccacacgcacaaggacaccgtctacaacgtcatcatgagccagtacctagaacttaaactccagagg

SEQ ID NO: 8231 - DNA, 2909 bp, Homo sapiens
acacaatacccacacatgcatatacccttctagtcagaggtctcccctcccccttcttcccacccccaggtgtaagaaggacgattccaggaacctaaggctttgttactctgccccattttcaatgaagggtaggagggagttagacaggggttggggcggggccagtgagcaggatgcctgggtctccagttcctgccagtgagtccctaggcctccatctctctcccttgctgtaccaccttcaccaccatccatgcgaccccaagagccttaatgactctagaagagactccaggcaggggaagctgaaaggacctttcactccctacttttggccagggccttctgtgccacctgccaagaccagcaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctcagaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaacctctgtaagtacactgttcacgaccagtgtgccatgaaagccctgccttgtgaagtcagcacctatgccaagtctcggaaggacattggtgtccaatcacatgtgtgggtgcgaggaggctgtgagtccgggcgctgcgaccgctgtcagaaaaagatccggatctaccacagtctgaccgggctgcattgtgtatggtgccacctagagatccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcaaagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggggaggaggttatgaaggacagaatctggcaaagatcctcaaggatttagagatgagtaaagtggtacatatggatcgatggtctgtggaggtgatacctcaacaaactgaagaaaaaagtgacccagtcccctttcaaatcatcaataactacttctctattggcgtggatgcctctattgctcatcgattccacatcatgcgagagaaatatccggagaagttcaacagcagaatgaagaacaagctatggtacttcgaatttgccacatctgaatccatcttctcaacatgcaaaaagctggaggagtctttgacagttgagatctgtgggaaaccgctggatctgagcaacctgtccctagaaggcatcgcagtgctaaacatccctagcatgcatggtggctccaacctctggggtgataccaggagaccccatggggatatctatgggatcaaccaggccttaggtgctacagctaaagtcatcaccgaccctgatatcctgaaaacctgtgtaccagacctaagtgacaagagactggaagtggttgggctggagggtgcaattgagatgggccaaatctataccaagctcaagaatgctggacgtcggctggccaagtgctctgagatcaccttccacaccacaaaaacccttcccatgcaaattgacggagaaccctggatgcagacgccctgtacaatcaagatcacccacaagaaccagatgcccatgctcatgggcccacccccccgctccaccaatttctttggcttcttgagctaagggggacacccttggcctccaagccagccttgaacccacctccctgtccctggactctactcccgaggctctgtacattgctgccacatactcctgccagcttgggggagtgttccttcaccctcacagtatttattatcctgcaccacctcactgttccccatgcgcacacacatacacacaccccaaaacacatacattgaaagtgcctcatctgaataaaatgacttgtgtttcccctttggga

SEQ ID NO: 8232 - DNA, 2770 bp, Homo sapiens
gcggccgcgtctgcctggcccgtcccctccagcccagctcgggctccagctccagcgccggcgcttcagctgcgaccgcgagccctctcaagcaaggtagagaccccgcgagccccccagcgccccaccctcccccatcggaaaaggacaggggtagggaagccgaggacccacgggctgcgttcgtgctgctgggtcgggaaggaggaagcgtgacagctggagcgggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctcagaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaacctctgtaagtacactgttcacgaccagtgtgccatgaaagccctgccttgtgaagtcagcacctatgccaagtctcggaaggacattggtgtccaatcacatgtgtgggtgcgaggaggctgtgagtccgggcgctgcgaccgctgtcagaaaaagatccggatctaccacagtctgaccgggctgcattgtgtatggtgccacctagagatccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcaaagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggggaggaggttatgaaggacagaatctggcaaagatcctcaaggatttagagatgagtaaagtggtacatatggatcgatggtctgtggaggtgatacctcaacaaactgaagaaaaaagtgacccagtcccctttcaaatcatcaataactacttctctattggcgtggatgcctctattgctcatcgattccacatcatgcgagagaaatatccggagaagttcaacagcagaatgaagaacaagctatggtacttcgaatttgccacatctgaatccatcttctcaacatgcaaaaagctggaggagtctttgacagttgagatctgtgggaaaccgctggatctgagcaacctgtccctagaaggcatcgcagtgctaaacatccctagcatgcatggtggctccaacctctggggtgataccaggagaccccatggggatatctatgggatcaaccaggccttaggtgctacagctaaagtcatcaccgaccctgatatcctgaaaacctgtgtaccagacctaagtgacaagagactggaagtggttgggctggagggtgcaattgagatgggccaaatctataccaagctcaagaatgctggacgtcggctggccaagtgctctgagatcaccttccacaccacaaaaacccttcccatgcaaattgacggagaaccctggatgcagacgccctgtacaatcaagatcacccacaagaaccagatgcccatgctcatgggcccacccccccgctccaccaatttctttggcttcttgagctaagggggacacccttggcctccaagccagccttgaacccacctccctgtccctggactctactcccgaggctctgtacattgctgccacatactcctgccagcttgggggagtgttccttcaccctcacagtatttattatcctgcaccacctcactgttccccatgcgcacacacatacacacaccccaaaacacatacattgaaagtgcctcatctgaataaaatgacttgtgtttcccctttgggatctgct

SEQ ID NO: 8233 - DNA, 2582 bp, Homo sapiens
agcccagctcgggctccagctccagcgccggcgcttcagctgcgaccgcgagccctctcaagcaaggtagagaccccgcgagccccccagcgccccaccctcccccatcggaaaaggacaggggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctcagaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaaccgtccaatcacatgtgtgggtgcgaggaggctgtgagtccgggcgctgcgaccgctgtcagaaaaagatccggatctaccacagtctgaccgggctgcattgtgtatggtgccacctagagatccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcaaagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggggaggaggttatgaaggacagaatctggcaaagatcctcaaggatttagagatgagtaaagtggtacatatggatcgatggtctgtggaggtgatacctcaacaaactgaagaaaaaagtgacccagtcccctttcaaatcatcaataactacttctctattggcgtggatgcctctattgctcatcgattccacatcatgcgagagaaatatccggagaagttcaacagcagaatgaagaacaagctatggtacttcgaatttgccacatctgaatccatcttctcaacatgcaaaaagctggaggagtctttgacagttgagatctgtgggaaaccgctggatctgagcaacctgtccctagaaggcatcgcagtgctaaacatccctagcatgcatggtggctccaacctctggggtgataccaggagaccccatggggatatctatgggatcaaccaggccttaggtgctacagctaaagtcatcaccgaccctgatatcctgaaaacctgtgtaccagacctaagtgacaagagactggaagtggttgggctggagggtgcaattgagatgggccaaatctataccaagctcaagaatgctggacgtcggctggccaagtgctctgagatcaccttccacaccacaaaaacccttcccatgcaaattgacggagaaccctggatgcagacgccctgtacaatcaagatcacccacaagaaccagatgcccatgctcatgggcccacccccccgctccaccaatttctttggcttcttgagctaagggggacacccttggcctccaagccagccttgaacccacctccctgtccctggactctactcccgaggctctgtacattgctgccacatactcctgccagcttgggggagtgttccttcaccctcacagtatttattatcctgcaccacctcactgttccccatgcgcacacacatacacacaccccaaaacacatacattgaaagtgcctcatctgaataaaatgacttgtgtttcccctttgggatctgctaagtaa

SEQ ID NO: 8234 - DNA, 591 bp, Homo sapiens
agctgcgaccgcgagccctctcaagcaaggtagagaccccgcgagccccccagcgccccaccctcccccatcggaaaaggacaggggtagggaagccgaggacccacgggctgcgttcgtgctgctgggtcgggaaggaggaagcgtgacagctggagcgggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaat

SEQ ID NO: 8235 - DNA, 556 bp, Homo sapiens
attactgagcgcttgctgcctgtaaaacagtcctcagggagccaagagaagttccgaggcacagtccctctcatccccaggaactcctcgtacgtccaggacctgcgagggaaaagggcgcaaggcccacctgcacccaaaaagggggccttataaatgaagaaaggaagaatatccaggctctggcctgcacccagatctcagagcggcttggtgacgtggagcagacaaactccaggaacgcactggggcgcacaagtgtttctagggacggttggagaccctatctaaccctaagaaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaa

SEQ ID NO: 8236 - DNA, 542 bp, Homo sapiens
atgatctcggctcactgcaacctctgcctcccaggttcaagcgattctcctgcctcagcctcgcgagtaactgggactacaggcatgtgccaccacgcccggctaattttttgtatttttagtagagacaggttttcaccgtgttagccaggatggtctcaatctcctgatctcgtgatccgcctgcctcagcctgccaaagtgctgggattacagttcctgccagtgagtccctaggcctccatctctctcccttgctgtaccaccttcaccaccatccatgcgaccccaagagccttaatgactctagaagagactccaggcaggggaagctgaaaggacctttcactccctacttttggccagggccttctgtgccacctgccaagaccagcaggcctaccctctgaagaggtccaagcaacggaagtactactacgaagctgcctttctggccatccttgagaaaaatagacagatggccaaggagaggggcctaataagccccagtgattttgcccagctgcaaaaatacatggaat

SEQ ID NO: 8237 - DNA, 567 bp, Homo sapiens
gactggggaaaataggtctaaaaggaaagaggaacgtgaagaaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctcagaagtggacaaaattatcctacagatgatgcgagtggctgaat

SEQ ID NO: 8238 - DNA, 2671 bp, Homo sapiens
agcccagctcgggctccagctccagcgccggcgcttcagctgcgaccgcgagccctctcaagcaaggtagagaccccgcgagccccccagcgccccaccctcccccatcggaaaaggacaggggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctcagaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaacctctgtaagtacactgttcacgaccagtgtgccatgaaagccctgccttgtgaagtcagcacctatgccaagtctcggaaggacattggtgtccaatcacatgtgtgggtgcgaggaggctgtgagtccgggcgctgcgaccgctgtcagaaaaagatccggatctaccacagtctgaccgggctgcattgtgtatggtgccacctagagatccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcaaagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggggaggaggttatgaaggacagaatctggcaaagatcctcaaggatttagagatgagtaaagtggtacatatggatcgatggtctgtggaggtgatacctcaacaaactgaagaaaaaagtgacccagtcccctttcaaatcatcaataactacttctctattggcgtggatgcctctattgctcatcgattccacatcatgcgagagaaatatccggagaagttcaacagcagaatgaagaacaagctatggtacttcgaatttgccacatctgaatccatcttctcaacatgcaaaaagctggaggagtctttgacagttgagatctgtgggaaaccgctggatctgagcaacctgtccctagaaggcatcgcagtgctaaacatccctagcatgcatggtggctccaacctctggggtgataccaggagaccccatggggatatctatgggatcaaccaggccttaggtgctacagctaaagtcatcaccgaccctgatatcctgaaaacctgtgtaccagacctaagtgacaagagactggaagtggttgggctggagggtgcaattgagatgggccaaatctataccaagctcaagaatgctggacgtcggctggccaagtgctctgagatcaccttccacaccacaaaaacccttcccatgcaaattgacggagaaccctggatgcagacgccctgtacaatcaagatcacccacaagaaccagatgcccatgctcatgggcccacccccccgctccaccaatttctttggcttcttgagctaagggggacacccttggcctccaagccagccttgaacccacctccctgtccctggactctactcccgaggctctgtacattgctgccacatactcctgccagcttgggggagtgttccttcaccctcacagtatttattatcctgcaccacctcactgttccccatgcgcacacacatacacacaccccaaaacacatacattgaaagtgcctcatctgaataaaatgacttgtgtttcccctttgggatctgctaagtaa

SEQ ID NO: 8239 - DNA, 605 bp, Homo sapiens
gtcagaagcgctagaggtcgttgcgtggcgtgggtggctcggggagtgggtggctgagcggagctggggtccctggccagaggcggaacaaaatggggtcatggccaggaagacgcgctaacgcagcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctca

SEQ ID NO: 8240 - DNA, 564 bp, Homo sapiens
agctcgggctccagctccagcgccggcgcttcagctgcgaccgcgagccctctcaagcaagatataacttccccaagtcacacagtggtatcagagctaagaatgggacccagatatgactgatctagttctgttccaaaaccgtgctgtattatattaacgcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagg

SEQ ID NO: 8241 - DNA, 548 bp, Homo sapiens
agaagcagagctgccgccggcgcgggaagaagatgaggagcgcagcaaatggagaaaatgtgtccaaagccccggacatattcgagggagggtggagcaggttatggtgaactggaaacctagaaacgggcctctccaacttcgaagttcccagagtcgggggcgccgggcgcgggcgcggcgggcaggctggggtggggggcgggcagctatgtcgtcaggaacggggcggccccgctgcggccgcgtctgcctggcccgtcccctccagcccagctcgggctccagctccagcgccggcgcttcagctgcgaccgcgagccctctcaagcaaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaa

SEQ ID NO: 8242 - DNA, 569 bp, Homo sapiens
attttcaatgaagggtaggagggagttagacaggggttggggcggggccagtgagcaggatgcctgggtctccagttcctgccagtgagtccctaggcctccatctctctcccttgctgtaccaccttcaccaccatccatgcgaccccaagagccttaatgactctagaagagactccaggcaggggaagctgaaaggacctttcactccctacttttggccagggccttctgtgccacctgccaagaccagcagatataacttccccaagtcacacagtggtatcagagctaagaatgggacccagatatgactgatctagttctgttccaaaaccgtgctgtattatattaacgcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaa

SEQ ID NO: 8243 - DNA, 497 bp, Homo sapiens
agccctctcaagcaaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctcag

SEQ ID NO: 8244 - DNA, 505 bp, Homo sapiens
gctcgggctccagctccagcgccggcgcttcagctgcgaccgcgagccctctcaagcaaggtagagaccccgcgagccccccagcgccccaccctcccccatcggaaaaggacaggggtagggaagccgaggacccacgggctgcgttcgtgctgctgggtcgggaaggaggaagcgtgacagctggagcggatataacttccccaagtcacacagtggtatcagagctaagaatgggacccagatatgactgatctagttctgttccaaaaccgtgctgtattatattaacgcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaa

SEQ ID NO: 8245 - DNA, 6684 bp, Homo sapiens
ttctttaacacattattgaaattacaagcatccaaagcagtttcatgtggacagattgcatattttgaaagcctgaggtattttatcatgaaacatgccatgtggaatctttgaagcatagacctctgcgcaacacctgaataaagaatcttttacctggtatgtgacagagcttctcaccaccaccatgacaaaccaggaaaaatgggcccacctcagcccttcggaattttcccaacttcagaaatatgctgagtattctacaaagaaattaaaggatgttcttgaagaattccatggtaatggtgtgcttgcaaagtataatcctgaagggaagcttgtggtgttgggcaatacaatagattttgaaggtttcaaactattcatgaagacattcctggaagccgagcttcctgatgatttcactgcacaccttttcatgtcatttagcaacaagtttcctcattctagtccaatggtaaaaagtaagcctgctctcctatcaggcggtctgagaatgaataaaggtgccatcacccctccccggactacttctcctgcaaatacgtgttccccagaagtaatccatctgaaggacattgtctgttacctgtctctgcttgaaagaggaagacctgaggataagcttgagtttatgtttcgcctttatgacacggatgggaatggcttcctggacagctcggagctagaaaatatcatcagtcagatgatgcatgttgcagaataccttgagtgggatgtcactgaacttaatccaatcctccatgaaatgatggaagaaattgactatgatcatgatggaaccgtgtctctggaggaatggattcaaggaggaatgacaacgattccacttcttgtgctcctgggcttagaaaataacgtgaaggatgatggacagcacgtgtggcgactgaagcactttaacaaacctgcctattgcaacctttgcctgaacatgctgattggcgtggggaagcagggcctctgctgttccttctgcaagtacacagtccatgagcgctgtgtggctcgagcacctccctcttgcatcaagacctatgtgaagtccaaaaggaacactgatgtcatgcaccattactgggttgaaggtaactgcccaaccaagtgtgataagtgccacaaaactgttaaatgttaccagggcctgacaggactgcattgtgtttggtgtcagatcacactgcataataaatgtgcttctcatctaaaacctgaatgtgactgtggacctttgaaggaccatattttaccacccacaacaatctgtccagtggtactgcagactctgcccacttcaggagtttcagttcctgaggaaagacaatcaacagtgaaaaaggaaaagagtggttcccagcagccaaacaaagtgattgacaagaataaaatgcaaagagccaactctgttactgtagatggacaaggcctgcaggtcactcctgtgcctggtactcacccacttttagtttttgtgaaccccaaaagtggtggaaaacaaggagaacgaatttacagaaaattccagtatctattaaatcctcgtcaggtttacagtctttctggaaatggaccaatgccagggttaaactttttccgtgatgttcctgacttcagagtgttagcctgtggtggagatggaaccgtgggctgggttttggattgcatagaaaaggccaatgtaggcaagcatcctccagttgcgattctgcctcttgggactggcaatgatctagcaagatgcctgcgatggggaggaggttacgaaggtgagaatctgatgaaaattctaaaagacattgaaaacagcacagaaatcatgttggacaggtggaagtttgaagtcatacctaatgacaaagatgagaaaggagacccagtgccttacagtatcatcaataattacttttccattggcgtggatgcctccattgcacacagattccacatcatgagagaaaaacacccagagaaattcaacagtagaatgaagaacaaattttggtattttgagtttggcacatctgaaactttctcagccacctgcaagaagctacatgaatctgtagaaatagaatgtgatggagtacagatagatttaataaacatctctctggaaggaattgctattttgaatataccaagcatgcatggaggatccaatctttggggagagtctaagaaaagacgaagccatcgacgaatagagaaaaaagggtctgacaaaaggaccaccgtcacagatgccaaagagttgaagtttgcaagtcaagatctcagtgaccagctgctggaggtggtcggcttggaaggagccatggagatggggcaaatatacacaggcctgaaaagtgctggccggcggctggctcagtgctcctgcgtggtcatcaggacgagcaagtctctgccaatgcaaattgatggggagccatggatgcagaccccatgcacaataaaaattacacacaagaaccaagccccaatgctgatgggcccgcctccaaaaaccggtttattctgctccctcgtcaaaaggacaagaaaccgaagcaaggaataatcctgtgttgtttcactcttagaaattgaattagcataattgggccatggaacacatatgctggaaatctttgaaccatttcaagtctcctgctcatgcaaaatcatggaagtggtttaacagtttttgttactaagctaatgtaaaattcagctattagaaaatttattgtctcagtttttataggcatctttgcatgaagaaagcagaagtttacctgaagtgatactgcatatttttggtgcatgcattcccatagatttttacatctcccacccaactcttccccaatttccttttactaacctgtgagaaaaacccgtgaaacatgaaaaaggaaataccatgggaaacgtgattctcagtgtgattccaattattacgaagcactaatcagtaacgctacaatgatcataattgcagattgctatacgtttcccttttagaatcagtgtatcagtgacctatgacttgaggagaaacttttaattcgaagattttattaaatagttgactacaataccttgctatatatacatagtttttcttcaacatcttaactcttctgagtggaaataaaaatatcaggcataaggttttctcatgctgaaaaatagaacgcggtttttattttgcttagttttctttttaattccagaaataagtgaaaacatgttacttgacagtcaagtgtggtaatatggcaagccttgttcctttctgcatgagaatctaggagagaattcataaccacaccaataacgaaatagaagttttaaactatgtgcctaatcaatgtgtttcccaccaaagattcagaaaacaatgcttgagagaaatgggttaatgcataattaattaagcattgtggagcaaatttagggttcctgtgattaattttgtgatgactaaaatgctggaaagcgagtgagttgcccattaattatgattaaaattctcacctttcacagacagacaataagccagacaacacaatcaaagctcaatagatgatttcttgcttttttcagtcatttataaatataggtgtaatttttcatggatcagttaagtacacttgaaggaagtaaatgattgtatcagtttatttctagtataaatgggtacctgtaataatactgagctcttggaagcgaatcatgcatgcaattagctccctcctcctcacctactccactcccatctttatgacatttcaaatgtttatttggaaacaacagcctagatcactgttgaaggtgttcatggcatagttggagtctctgactgtttaaagaaatcacagaacagtacttttcttttagtgtttcattaagcctatgatgtaaaatgaaatgcttctgagcagtcttgtaatattgttcattcatattgacctgcatctcatcattgcatgttttatgttttcaaacatgccataaggaaaacgagtgcctgaactgcatgatttattagtttctctccactctgcattaaagtgctaatgatttatcggttctattttgttattgattcattcatctttctttgaataacaaatagcatttagtgattctgttgaacacaatcctgtgcatggatttatggatttcaagtgaaattgctataattttagttctttggtttgaaaactcaactgaatgctgttatatcaaatagctgctctcaagcaatgtgctataatggaagattacgtacaaagtgtattcttttagtgttcctggaacattggacggtaaatatcaatcaacaataagcttaattactttaaaaataaaagcttttgaataaaattaagacataatttagcattcccaggaaaattatgattacaattgcaaatttagtacagcaatcacttgcgctggtataaaataaaaaagttgtttggcagaagagtaatccagaccaaaagaaagaaagaaatctcaaaacagtaacaagtacattactgacataatgttacgtaacacacacattgattttttgtatctatggttgcaggtaataaatattttcacatgaattgacaaaattttctacaatgggcaggcaggctttgtgtcaaaaacatattttgaagccacaaattattttatgttcgctacaacatacaattatgtcttggctaccttttatagtatatagtttgaaggcagcaacagtttgtgaatcattcttaacaatctgtacagtagaaagctgttggatagacagtgggatgagacaaattaaacaacctgcttataagatttcaatgattgaaataatgggatgcagcttcacttcagtgtagctgtataactacaattagtgctaatagtggttacattttcagtcagatggattctttggtacccataataaatgttcaaataggaatccaatttgacttttctcaactcattttctaaatacactgatgtacttgccccttcaagtatactgcccctggggtttggaaagtagtttttaaaaacgtaacttgatgggtttgaaatcagagaagatattctcatcagttttatgacagcttcatatgaaaaatatatagtttaaggaaaattctatagtatattaaaatattgaatgatgaatgttgttagctttacaagatggaaacttctcttctatgtgtgcagataaattttcagctattgagtcgccctcttttaatataggagacataaagttttaagtggctgaaactcttaaatgtaaattaatgctggacttaacagcagtcagaaacaaagagggaaaagagacatgcactctgctaaacattgctaggcactgagttgatgagattccagagagacatttcagagtaaaccttgatatccacgcttctaagagataggaagggaggtatctacatagaaccagaaagtttaaaagacgtaaatttattttttccacttccttgtgtacaccatgtatttcatgtgaaaatgctgatcaatttattgtggtggaaggagatatcttgcaggaagtttaaaaattaacattttaaaacagtttttattttatttaaaacaggttcatgtgatcatagccagaataaaacaaaaggctcagatgtttagcctagtctactgcagacagaaatttaaatccagtgagggctaatgaatcacatacgtgtttccacattttattttgttttcgttttttaggcatatgggaagtagttgcaatttttcagggaagaatatgttttgaatctcacactgtattctccttgaatctcacactgtattcttgaatgagacaagattttgagatcattcttttcctttttgtgtcaacgttagtttgttgttcattggttataaaaaggaaaatgtggccaggcgcaatggcttacgcctgtaatcccagcactttgggagacagaggcaggcagatcacaaggtcaggagttcaagaccagcctggccaatatggtgaaacctcgtctctactaaaaatacaaaaattagccaggcatggtggcacatgcctgtaatcccagctactcgggaggctgaggcagaagaattgcttgaactcgggaggctgcggttgcagtgagccaagatcacaccactgcactccagcctgggtgacagagccagactctgtctcaaaaaaaaaaaggaaaatgtacttttcatggcacgtataacccccaaaggattattcaatactgaacaattaaataataattgaataatattgaatcatgttctccgttatttttcaaataactgaataatatctctattaaaagattaaacccttgtaacatatattaaagctgtaaactttaagaaaataaataaataaaaccctgtaaaagagcttttattttgtgagaggcagaaatcaccacttaaaactcccaattaaattctgctatatttaaataaagtttgagtaaactcacatttgagagattctgtataaccttattgtgtttaaaaacatggaacttaattatagtaccttaattattttctcagaaatgatatatacaatatcctgttttttgaaataaaaacgttaaccactca

SEQ ID NO: 8246 - DNA, 6684 bp, Homo sapiens
ttctttaacacattattgaaattacaagcatccaaagcagtttcatgtggacagattgcatattttgaaagcctgaggtattttatcatgaaacatgccatgtggaatctttgaagcatagacctctgcgcaacacctgaataaagaatcttttacctggtatgtgacagagcttctcaccaccaccatgacaaaccaggaaaaatgggcccacctcagcccttcggaattttcccaacttcagaaatatgctgagtattctacaaagaaattaaaggatgttcttgaagaattccatggtaatggtgtgcttgcaaagtataatcctgaagggaaacaagacattcttaaccaaacaatagattttgaaggtttcaaactattcatgaagacattcctggaagccgagcttcctgatgatttcactgcacaccttttcatgtcatttagcaacaagtttcctcattctagtccaatggtaaaaagtaagcctgctctcctatcaggcggtctgagaatgaataaaggtgccatcacccctccccggactacttctcctgcaaatacgtgttccccagaagtaatccatctgaaggacattgtctgttacctgtctctgcttgaaagaggaagacctgaggataagcttgagtttatgtttcgcctttatgacacggatgggaatggcttcctggacagctcggagctagaaaatatcatcagtcagatgatgcatgttgcagaataccttgagtgggatgtcactgaacttaatccaatcctccatgaaatgatggaagaaattgactatgatcatgatggaaccgtgtctctggaggaatggattcaaggaggaatgacaacgattccacttcttgtgctcctgggcttagaaaataacgtgaaggatgatggacagcacgtgtggcgactgaagcactttaacaaacctgcctattgcaacctttgcctgaacatgctgattggcgtggggaagcagggcctctgctgttccttctgcaagtacacagtccatgagcgctgtgtggctcgagcacctccctcttgcatcaagacctatgtgaagtccaaaaggaacactgatgtcatgcaccattactgggttgaaggtaactgcccaaccaagtgtgataagtgccacaaaactgttaaatgttaccagggcctgacaggactgcattgtgtttggtgtcagatcacactgcataataaatgtgcttctcatctaaaacctgaatgtgactgtggacctttgaaggaccatattttaccacccacaacaatctgtccagtggtactgcagactctgcccacttcaggagtttcagttcctgaggaaagacaatcaacagtgaaaaaggaaaagagtggttcccagcagccaaacaaagtgattgacaagaataaaatgcaaagagccaactctgttactgtagatggacaaggcctgcaggtcactcctgtgcctggtactcacccacttttagtttttgtgaaccccaaaagtggtggaaaacaaggagaacgaatttacagaaaattccagtatctattaaatcctcgtcaggtttacagtctttctggaaatggaccaatgccagggttaaactttttccgtgatgttcctgacttcagagtgttagcctgtggtggagatggaaccgtgggctgggttttggattgcatagaaaaggccaatgtaggcaagcatcctccagttgcgattctgcctcttgggactggcaatgatctagcaagatgcctgcgatggggaggaggttacgaaggtgagaatctgatgaaaattctaaaagacattgaaaacagcacagaaatcatgttggacaggtggaagtttgaagtcatacctaatgacaaagatgagaaaggagacccagtgccttacagtatcatcaataattacttttccattggcgtggatgcctccattgcacacagattccacatcatgagagaaaaacacccagagaaattcaacagtagaatgaagaacaaattttggtattttgagtttggcacatctgaaactttctcagccacctgcaagaagctacatgaatctgtagaaatagaatgtgatggagtacagatagatttaataaacatctctctggaaggaattgctattttgaatataccaagcatgcatggaggatccaatctttggggagagtctaagaaaagacgaagccatcgacgaatagagaaaaaagggtctgacaaaaggaccaccgtcacagatgccaaagagttgaagtttgcaagtcaagatctcagtgaccagctgctggaggtggtcggcttggaaggagccatggagatggggcaaatatacacaggcctgaaaagtgctggccggcggctggctcagtgctcctgcgtggtcatcaggacgagcaagtctctgccaatgcaaattgatggggagccatggatgcagaccccatgcacaataaaaattacacacaagaaccaagccccaatgctgatgggcccgcctccaaaaaccggtttattctgctccctcgtcaaaaggacaagaaaccgaagcaaggaataatcctgtgttgtttcactcttagaaattgaattagcataattgggccatggaacacatatgctggaaatctttgaaccatttcaagtctcctgctcatgcaaaatcatggaagtggtttaacagtttttgttactaagctaatgtaaaattcagctattagaaaatttattgtctcagtttttataggcatctttgcatgaagaaagcagaagtttacctgaagtgatactgcatatttttggtgcatgcattcccatagatttttacatctcccacccaactcttccccaatttccttttactaacctgtgagaaaaacccgtgaaacatgaaaaaggaaataccatgggaaacgtgattctcagtgtgattccaattattacgaagcactaatcagtaacgctacaatgatcataattgcagattgctatacgtttcccttttagaatcagtgtatcagtgacctatgacttgaggagaaacttttaattcgaagattttattaaatagttgactacaataccttgctatatatacatagtttttcttcaacatcttaactcttctgagtggaaataaaaatatcaggcataaggttttctcatgctgaaaaatagaacgcggtttttattttgcttagttttctttttaattccagaaataagtgaaaacatgttacttgacagtcaagtgtggtaatatggcaagccttgttcctttctgcatgagaatctaggagagaattcataaccacaccaataacgaaatagaagttttaaactatgtgcctaatcaatgtgtttcccaccaaagattcagaaaacaatgcttgagagaaatgggttaatgcataattaattaagcattgtggagcaaatttagggttcctgtgattaattttgtgatgactaaaatgctggaaagcgagtgagttgcccattaattatgattaaaattctcacctttcacagacagacaataagccagacaacacaatcaaagctcaatagatgatttcttgcttttttcagtcatttataaatataggtgtaatttttcatggatcagttaagtacacttgaaggaagtaaatgattgtatcagtttatttctagtataaatgggtacctgtaataatactgagctcttggaagcgaatcatgcatgcaattagctccctcctcctcacctactccactcccatctttatgacatttcaaatgtttatttggaaacaacagcctagatcactgttgaaggtgttcatggcatagttggagtctctgactgtttaaagaaatcacagaacagtacttttcttttagtgtttcattaagcctatgatgtaaaatgaaatgcttctgagcagtcttgtaatattgttcattcatattgacctgcatctcatcattgcatgttttatgttttcaaacatgccataaggaaaacgagtgcctgaactgcatgatttattagtttctctccactctgcattaaagtgctaatgatttatcggttctattttgttattgattcattcatctttctttgaataacaaatagcatttagtgattctgttgaacacaatcctgtgcatggatttatggatttcaagtgaaattgctataattttagttctttggtttgaaaactcaactgaatgctgttatatcaaatagctgctctcaagcaatgtgctataatggaagattacgtacaaagtgtattcttttagtgttcctggaacattggacggtaaatatcaatcaacaataagcttaattactttaaaaataaaagcttttgaataaaattaagacataatttagcattcccaggaaaattatgattacaattgcaaatttagtacagcaatcacttgcgctggtataaaataaaaaagttgtttggcagaagagtaatccagaccaaaagaaagaaagaaatctcaaaacagtaacaagtacattactgacataatgttacgtaacacacacattgattttttgtatctatggttgcaggtaataaatattttcacatgaattgacaaaattttctacaatgggcaggcaggctttgtgtcaaaaacatattttgaagccacaaattattttatgttcgctacaacatacaattatgtcttggctaccttttatagtatatagtttgaaggcagcaacagtttgtgaatcattcttaacaatctgtacagtagaaagctgttggatagacagtgggatgagacaaattaaacaacctgcttataagatttcaatgattgaaataatgggatgcagcttcacttcagtgtagctgtataactacaattagtgctaatagtggttacattttcagtcagatggattctttggtacccataataaatgttcaaataggaatccaatttgacttttctcaactcattttctaaatacactgatgtacttgccccttcaagtatactgcccctggggtttggaaagtagtttttaaaaacgtaacttgatgggtttgaaatcagagaagatattctcatcagttttatgacagcttcatatgaaaaatatatagtttaaggaaaattctatagtatattaaaatattgaatgatgaatgttgttagctttacaagatggaaacttctcttctatgtgtgcagataaattttcagctattgagtcgccctcttttaatataggagacataaagttttaagtggctgaaactcttaaatgtaaattaatgctggacttaacagcagtcagaaacaaagagggaaaagagacatgcactctgctaaacattgctaggcactgagttgatgagattccagagagacatttcagagtaaaccttgatatccacgcttctaagagataggaagggaggtatctacatagaaccagaaagtttaaaagacgtaaatttattttttccacttccttgtgtacaccatgtatttcatgtgaaaatgctgatcaatttattgtggtggaaggagatatcttgcaggaagtttaaaaattaacattttaaaacagtttttattttatttaaaacaggttcatgtgatcatagccagaataaaacaaaaggctcagatgtttagcctagtctactgcagacagaaatttaaatccagtgagggctaatgaatcacatacgtgtttccacattttattttgttttcgttttttaggcatatgggaagtagttgcaatttttcagggaagaatatgttttgaatctcacactgtattctccttgaatctcacactgtattcttgaatgagacaagattttgagatcattcttttcctttttgtgtcaacgttagtttgttgttcattggttataaaaaggaaaatgtggccaggcgcaatggcttacgcctgtaatcccagcactttgggagacagaggcaggcagatcacaaggtcaggagttcaagaccagcctggccaatatggtgaaacctcgtctctactaaaaatacaaaaattagccaggcatggtggcacatgcctgtaatcccagctactcgggaggctgaggcagaagaattgcttgaactcgggaggctgcggttgcagtgagccaagatcacaccactgcactccagcctgggtgacagagccagactctgtctcaaaaaaaaaaaggaaaatgtacttttcatggcacgtataacccccaaaggattattcaatactgaacaattaaataataattgaataatattgaatcatgttctccgttatttttcaaataactgaataatatctctattaaaagattaaacccttgtaacatatattaaagctgtaaactttaagaaaataaataaataaaaccctgtaaaagagcttttattttgtgagaggcagaaatcaccacttaaaactcccaattaaattctgctatatttaaataaagtttgagtaaactcacatttgagagattctgtataaccttattgtgtttaaaaacatggaacttaattatagtaccttaattattttctcagaaatgatatatacaatatcctgttttttgaaataaaaacgttaaccactca

SEQ ID NO: 8247 - DNA, 5595 bp, Homo sapiens
ggaaaggatcctgagaactggctagtcccagttcctctccggaaaagcagtggctctcgcttcagagatgcgctcagctttcgcctgcatcacactgcattctttaacacattattgaaattacaagcatccaaagcagtttcatgtggacagattgcatattttgaaagcctgaggtattttatcatgaaacatgccatgtggaatctttgaagcatagacctctgcgcaacacctgaataaagaatcttttacctggtatgtgacagagcttctcaccaccaccatgacaaaccaggaaaaatgggcccacctcagcccttcggaattttcccaacttcagaaatatgctgagtattctacaaagaaattaaaggatgttcttgaagaattccatggtaatggtgtgcttgcaaagtataatcctgaagggaaacaagacattcttaaccaaacaatagattttgaaggtttcaaactattcatgaagacattcctggaagccgagcttcctgatgatttcactgcacaccttttcatgtcatttagcaacaagtttcctcattctagtccaatggtaaaaagtaagcctgctctcctatcaggcggtctgagaatgaataaaggtgccatcacccctccccggactacttctcctgcaaatacgtgttccccagaagtaatccatctgaaggacattgtctgttacctgtctctgcttgaaagaggaagacctgaggataagcttgagtttatgtttcgcctttatgacacggatgggaatggcttcctggacagctcggagctagaaaatatcatcagtcagatgatgcatgttgcagaataccttgagtgggatgtcactgaacttaatccaatcctccatgaaatgatggaagaaattgactatgatcatgatggaaccgtgtctctggaggaatggattcaaggaggaatgacaacgattccacttcttgtgctcctgggcttagaaaataacgtgaaggatgatggacagcacgtgtggcgactgaagcactttaacaaacctgcctattgcaacctttgcctgaacatgctgattggcgtggggaagcagggcctctgctgttccttctgcaagtacacagtccatgagcgctgtgtggctcgagcacctccctcttgcatcaagacctatgtgaagtccaaaaggaacactgatgtcatgcaccattactgggttgaaggtaactgcccaaccaagtgtgataagtgccacaaaactgttaaatgttaccagggcctgacaggactgcattgtgtttggtgtcagatcacactgcataataaatgtgcttctcatctaaaacctgaatgtgactgtggacctttgaaggaccatattttaccacccacaacaatctgtccagtggtactgactctgcccacttcaggagtttcagttcctgaggaaagacaatcaacagtgaaaaaggaaaagagtggttcccagcagccaaacaaagtgattgacaagaataaaatgcaaagagccaactctgttactgtagatggacaaggcctgcaggtcactcctgtgcctggtactcacccacttttagtttttgtgaaccccaaaagtggtggaaaacaaggagaacgaatttacagaaaattccagtatctattaaatcctcgtcaggtttacagtctttctggaaatggaccaatgccagggttaaactttttccgtgatgttcctgacttcagagtgttagcctgtggtggagatggaaccgtgggctgggttttggattgcatagaaaaggccaatgtaggcaagcatcctccagttgcgattctgcctcttgggactggcaatgatctagcaagatgcctgcgatggggaggaggttacgaaggtgagaatctgatgaaaattctaaaagacattgaaaacagcacagaaatcatgttggacaggtggaagtttgaagtcatacctaatgacaaagatgagaaaggagacccagtgccttacagtatcatcaataattacttttccattggcgtggatgcctccattgcacacagattccacatcatgagagaaaaacacccagagaaattcaacagtagaatgaagaacaaattttggtattttgagtttggcacatctgaaactttctcagccacctgcaagaagctacatgaatctgtagaaatagaatgtgatggagtacagatagatttaataaacatctctctggaaggaattgctattttgaatataccaagcatgcatggaggatccaatctttggggagagtctaagaaaagacgaagccatcgacgaatagagaaaaaagggtctgacaaaaggaccaccgtcacagatgccaaagagttgaagtttgcaagtcaagatctcagtgaccagctgctggaggtggtcggcttggaaggagccatggagatggggcaaatatacacaggcctgaaaagtgctggccggcggctggctcagtgctcctgcgtggtcatcaggacgagcaagtctctgccaatgcaaattgatggggagccatggatgcagaccccatgcacaataaaaattacacacaagaaccaagccccaatgctgatgggcccgcctccaaaaaccggtttattctgctccctcgtcaaaaggacaagaaaccgaagcaaggaataatcctgtgttgtttcactcttagaaattgaattagcataattgggccatggaacacatatgctggaaatctttgaaccatttcaagtctcctgctcatgcaaaatcatggaagtggtttaacagtttttgttactaagctaatgtaaaattcagctattagaaaatttattgtctcagtttttataggcatctttgcatgaagaaagcagaagtttacctgaagtgatactgcatatttttggtgcatgcattcccatagatttttacatctcccacccaactcttccccaatttccttttactaacctgtgagaaaaacccgtgaaacatgaaaaaggaaataccatgggaaacgtgattctcagtgtgattccaattattacgaagcactaatcagtaacgctacaatgatcataattgcagattgctatacgtttcccttttagaatcagtgtatcagtgacctatgacttgaggagaaacttttaattcgaagattttattaaatagttgactacaataccttgctatatatacatagtttttcttcaacatcttaactcttctgagtggaaataaaaatatcaggcataaggttttctcatgctgaaaaatagaacgcggtttttattttgcttagttttctttttaattccagaaataagtgaaaacatgttacttgacagtcaagtgtggtaatatggcaagccttgttcctttctgcatgagaatctaggagagaattcataaccacaccaataacgaaatagaagttttaaactatgtgcctaatcaatgtgtttcccaccaaagattcagaaaacaatgcttgagagaaatgggttaatgcataattaattaagcattgtggagcaaatttagggttcctgtgattaattttgtgatgactaaaatgctggaaagcgagtgagttgcccattaattatgattaaaattctcacctttcacagacagacaataagccagacaacacaatcaaagctcaatagatgatttcttgcttttttcagtcatttataaatataggtgtaatttttcatggatcagttaagtacacttgaaggaagtaaatgattgtatcagtttatttctagtataaatgggtacctgtaataatactgagctcttggaagcgaatcatgcatgcaattagctccctcctcctcacctactccactcccatctttatgacatttcaaatgtttatttggaaacaacagcctagatcactgttgaaggtgttcatggcatagttggagtctctgactgtttaaagaaatcacagaacagtacttttcttttagtgtttcattaagcctatgatgtaaaatgaaatgcttctgagcagtcttgtaatattgttcattcatattgacctgcatctcatcattgcatgttttatgttttcaaacatgccataaggaaaacgagtgcctgaactgcatgatttattagtttctctccactctgcattaaagtgctaatgatttatcggttctattttgttattgattcattcatctttctttgaataacaaatagcatttagtgattctgttgaacacaatcctgtgcatggatttatggatttcaagtgaaattgctataattttagttctttggtttgaaaactcaactgaatgctgttatatcaaatagctgctctcaagcaatgtgctataatggaagattacgtacaaagtgtattcttttagtgttcctggaacattggacggtaaatatcaatcaacaataagcttaattactttaaaaataaaagcttttgaataaaattaagacataatttagcattcccaggaaaattatgattacaattgcaaatttagtacagcaatcacttgcgctggtataaaataaaaaagttgtttggcagaagagtaatccagaccaaaagaaagaaagaaatctcaaaacagtaacaagtacattactgacataatgttacgtaacacacacattgattttttgtatctatggttgcaggtaataaatattttcacatgaattgacaaaattttctacaatgggcaggcaggctttgtgtcaaaaacatattttgaagccacaaattattttatgttcgctacaacatacaattatgtcttggctaccttttatagtatatagtttgaaggcagcaacagtttgtgaatcattcttaacaatctgtacagtagaaagctgttggatagacagtgggatgagacaaattaaacaacctgcttataagatttcaatgattgaaataatgggatgcagcttcacttcagtgtagctgtataactacaattagtgctaatagtggttacattttcagtcagatggattctttggtacccataataaatgttcaaataggaatccaatttgacttttctcaactcattttctaaatacactgatgtacttgccccttcaagtatactgcccctggggtttggaaagtagtttttaaaaacgtaacttgatgggtttgaaatcagagaagatattctcatcagttttatgacagcttcatatgaaaaatatatagtttaaggaaaattctatagtatattaaaatattgaatgatgaatgttgttagctttacaagatggaaacttctcttctatgtgtgcagataaattttcagctattgagtcgccctcttttaatataggagacataaagttttaagtggctgaaactcttaaatgtaaattaatgctggacttaacagcagtcagaaacaaagagggaaaagagacatgcactctgctaaacattgctaggcactgagttgatgagattccagagagacatttcagagtaaaccttgatatccacgcttctaagagataggaagggaggtatc

SEQ ID NO: 8248 - DNA, 6917 bp, Homo sapiens
attttcccctgagctccatcagcaagagtagcaatagcagctggagaagcggcagccagagataggcagggctggtgcttgcagccgcgcaaatcgcctcctcctcaacacacacacacacacacacacacacacacacacacacacactgcacagacttccaatatcaacgcgtcttgacataaatcaaggactaagagagactgaagaagagcgttagtcatggacaacagttctttaacacattattgaaattacaagcatccaaagcagtttcatgtggacagattgcatattttgaaagcctgaggtattttatcatgaaacatgccatgtggaatctttgaagcatagacctctgcgcaacacctgaataaagaatcttttacctggtatgtgacagagcttctcaccaccaccatgacaaaccaggaaaaatgggcccacctcagcccttcggaattttcccaacttcagaaatatgctgagtattctacaaagaaattaaaggatgttcttgaagaattccatggtaatggtgtgcttgcaaagtataatcctgaagggaaacaagacattcttaaccaaacaatagattttgaaggtttcaaactattcatgaagacattcctggaagccgagcttcctgatgatttcactgcacaccttttcatgtcatttagcaacaagtttcctcattctagtccaatggtaaaaagtaagcctgctctcctatcaggcggtctgagaatgaataaaggtgccatcacccctccccggactacttctcctgcaaatacgtgttccccagaagtaatccatctgaaggacattgtctgttacctgtctctgcttgaaagaggaagacctgaggataagcttgagtttatgtttcgcctttatgacacggatgggaatggcttcctggacagctcggagctagaaaatatcatcagtcagatgatgcatgttgcagaataccttgagtgggatgtcactgaacttaatccaatcctccatgaaatgatggaagaaattgactatgatcatgatggaaccgtgtctctggaggaatggattcaaggaggaatgacaacgattccacttcttgtgctcctgggcttagaaaataacgtgaaggatgatggacagcacgtgtggcgactgaagcactttaacaaacctgcctattgcaacctttgcctgaacatgctgattggcgtggggaagcagggcctctgctgttccttctgcaagtacacagtccatgagcgctgtgtggctcgagcacctccctcttgcatcaagacctatgtgaagtccaaaaggaacactgatgtcatgcaccattactgggttgaaggtaactgcccaaccaagtgtgataagtgccacaaaactgttaaatgttaccagggcctgacaggactgcattgtgtttggtgtcagatcacactgcataataaatgtgcttctcatctaaaacctgaatgtgactgtggacctttgaaggaccatattttaccacccacaacaatctgtccagtggtactgcagactctgcccacttcaggagtttcagttcctgaggaaagacaatcaacagtgaaaaaggaaaagagtggttcccagcagccaaacaaagtgattgacaagaataaaatgcaaagagccaactctgttactgtagatggacaaggcctgcaggtcactcctgtgcctggtactcacccacttttagtttttgtgaaccccaaaagtggtggaaaacaaggagaacgaatttacagaaaattccagtatctattaaatcctcgtcaggtttacagtctttctggaaatggaccaatgccagggttaaactttttccgtgatgttcctgacttcagagtgttagcctgtggtggagatggaaccgtgggctgggttttggattgcatagaaaaggccaatgtaggcaagcatcctccagttgcgattctgcctcttgggactggcaatgatctagcaagatgcctgcgatggggaggaggttacgaaggtgagaatctgatgaaaattctaaaagacattgaaaacagcacagaaatcatgttggacaggtggaagtttgaagtcatacctaatgacaaagatgagaaaggagacccagtgccttacagtatcatcaataattacttttccattggcgtggatgcctccattgcacacagattccacatcatgagagaaaaacacccagagaaattcaacagtagaatgaagaacaaattttggtattttgagtttggcacatctgaaactttctcagccacctgcaagaagctacatgaatctgtagaaatagaatgtgatggagtacagatagatttaataaacatctctctggaaggaattgctattttgaatataccaagcatgcatggaggatccaatctttggggagagtctaagaaaagacgaagccatcgacgaatagagaaaaaagggtctgacaaaaggaccaccgtcacagatgccaaagagttgaagtttgcaagtcaagatctcagtgaccagctgctggaggtggtcggcttggaaggagccatggagatggggcaaatatacacaggcctgaaaagtgctggccggcggctggctcagtgctcctgcgtggtcatcaggacgagcaagtctctgccaatgcaaattgatggggagccatggatgcagaccccatgcacaataaaaattacacacaagaaccaagccccaatgctgatgggcccgcctccaaaaaccggtttattctgctccctcgtcaaaaggacaagaaaccgaagcaaggaataatcctgtgttgtttcactcttagaaattgaattagcataattgggccatggaacacatatgctggaaatctttgaaccatttcaagtctcctgctcatgcaaaatcatggaagtggtttaacagtttttgttactaagctaatgtaaaattcagctattagaaaatttattgtctcagtttttataggcatctttgcatgaagaaagcagaagtttacctgaagtgatactgcatatttttggtgcatgcattcccatagatttttacatctcccacccaactcttccccaatttccttttactaacctgtgagaaaaacccgtgaaacatgaaaaaggaaataccatgggaaacgtgattctcagtgtgattccaattattacgaagcactaatcagtaacgctacaatgatcataattgcagattgctatacgtttcccttttagaatcagtgtatcagtgacctatgacttgaggagaaacttttaattcgaagattttattaaatagttgactacaataccttgctatatatacatagtttttcttcaacatcttaactcttctgagtggaaataaaaatatcaggcataaggttttctcatgctgaaaaatagaacgcggtttttattttgcttagttttctttttaattccagaaataagtgaaaacatgttacttgacagtcaagtgtggtaatatggcaagccttgttcctttctgcatgagaatctaggagagaattcataaccacaccaataacgaaatagaagttttaaactatgtgcctaatcaatgtgtttcccaccaaagattcagaaaacaatgcttgagagaaatgggttaatgcataattaattaagcattgtggagcaaatttagggttcctgtgattaattttgtgatgactaaaatgctggaaagcgagtgagttgcccattaattatgattaaaattctcacctttcacagacagacaataagccagacaacacaatcaaagctcaatagatgatttcttgcttttttcagtcatttataaatataggtgtaatttttcatggatcagttaagtacacttgaaggaagtaaatgattgtatcagtttatttctagtataaatgggtacctgtaataatactgagctcttggaagcgaatcatgcatgcaattagctccctcctcctcacctactccactcccatctttatgacatttcaaatgtttatttggaaacaacagcctagatcactgttgaaggtgttcatggcatagttggagtctctgactgtttaaagaaatcacagaacagtacttttcttttagtgtttcattaagcctatgatgtaaaatgaaatgcttctgagcagtcttgtaatattgttcattcatattgacctgcatctcatcattgcatgttttatgttttcaaacatgccataaggaaaacgagtgcctgaactgcatgatttattagtttctctccactctgcattaaagtgctaatgatttatcggttctattttgttattgattcattcatctttctttgaataacaaatagcatttagtgattctgttgaacacaatcctgtgcatggatttatggatttcaagtgaaattgctataattttagttctttggtttgaaaactcaactgaatgctgttatatcaaatagctgctctcaagcaatgtgctataatggaagattacgtacaaagtgtattcttttagtgttcctggaacattggacggtaaatatcaatcaacaataagcttaattactttaaaaataaaagcttttgaataaaattaagacataatttagcattcccaggaaaattatgattacaattgcaaatttagtacagcaatcacttgcgctggtataaaataaaaaagttgtttggcagaagagtaatccagaccaaaagaaagaaagaaatctcaaaacagtaacaagtacattactgacataatgttacgtaacacacacattgattttttgtatctatggttgcaggtaataaatattttcacatgaattgacaaaattttctacaatgggcaggcaggctttgtgtcaaaaacatattttgaagccacaaattattttatgttcgctacaacatacaattatgtcttggctaccttttatagtatatagtttgaaggcagcaacagtttgtgaatcattcttaacaatctgtacagtagaaagctgttggatagacagtgggatgagacaaattaaacaacctgcttataagatttcaatgattgaaataatgggatgcagcttcacttcagtgtagctgtataactacaattagtgctaatagtggttacattttcagtcagatggattctttggtacccataataaatgttcaaataggaatccaatttgacttttctcaactcattttctaaatacactgatgtacttgccccttcaagtatactgcccctggggtttggaaagtagtttttaaaaacgtaacttgatgggtttgaaatcagagaagatattctcatcagttttatgacagcttcatatgaaaaatatatagtttaaggaaaattctatagtatattaaaatattgaatgatgaatgttgttagctttacaagatggaaacttctcttctatgtgtgcagataaattttcagctattgagtcgccctcttttaatataggagacataaagttttaagtggctgaaactcttaaatgtaaattaatgctggacttaacagcagtcagaaacaaagagggaaaagagacatgcactctgctaaacattgctaggcactgagttgatgagattccagagagacatttcagagtaaaccttgatatccacgcttctaagagataggaagggaggtatctacatagaaccagaaagtttaaaagacgtaaatttattttttccacttccttgtgtacaccatgtatttcatgtgaaaatgctgatcaatttattgtggtggaaggagatatcttgcaggaagtttaaaaattaacattttaaaacagtttttattttatttaaaacaggttcatgtgatcatagccagaataaaacaaaaggctcagatgtttagcctagtctactgcagacagaaatttaaatccagtgagggctaatgaatcacatacgtgtttccacattttattttgttttcgttttttaggcatatgggaagtagttgcaatttttcagggaagaatatgttttgaatctcacactgtattctccttgaatctcacactgtattcttgaatgagacaagattttgagatcattcttttcctttttgtgtcaacgttagtttgttgttcattggttataaaaaggaaaatgtggccaggcgcaatggcttacgcctgtaatcccagcactttgggagacagaggcaggcagatcacaaggtcaggagttcaagaccagcctggccaatatggtgaaacctcgtctctactaaaaatacaaaaattagccaggcatggtggcacatgcctgtaatcccagctactcgggaggctgaggcagaagaattgcttgaactcgggaggctgcggttgcagtgagccaagatcacaccactgcactccagcctgggtgacagagccagactctgtctcaaaaaaaaaaaggaaaatgtacttttcatggcacgtataacccccaaaggattattcaatactgaacaattaaataataattgaataatattgaatcatgttctccgttatttttcaaataactgaataatatctctattaaaagattaaacccttgtaacatatattaaagctgtaaactttaagaaaataaataaataaaaccctgtaaaagagcttttattttgtgagaggcagaaatcaccacttaaaactcccaattaaattctgctatatttaaataaagtttgagtaaactcacatttgagagattctgtataaccttattgtgtttaaaaacatggaacttaattatagtaccttaattattttctcagaaatgatatatacaatatcctgttttttgaaataaaaacgttaaccactca

SEQ ID NO: 8249 - DNA, 3257 bp, Homo sapiens
ggaatctttgaagcatagacctctgcgcaacacctgaataaagaatcttttacctggtatgtgacagagcttctcaccaccaccatgacaaaccaggaaaaatgggcccacctcagcccttcggaattttcccaacttcagaaatatgctgagtattctacaaagaaattaaaggatgttcttgaagaattccatggtaatggtgtgcttgcaaagtataatcctgaagggaaacaagacattcttaaccaaacaatagattttgaaggtttcaaactattcatgaagacattcctggaagccgagcttcctgatgatttcactgcacaccttttcatgtcatttagcaacaagtttcctcattctagtccaatggtaaaaagtaagcctgctctcctatcaggcggtctgagaatgaataaaggtgccatcacccctccccggactacttctcctgcaaatacgtgttccccagaagtaatccatctgaaggacattgtctgttacctgtctctgcttgaaagaggaagacctgaggataagcttgagtttatgtttcgcctttatgacacggatgggaatggcttcctggacagctcggagctagaaaatatcatcagtcagatgatgcatgttgcagaataccttgagtgggatgtcactgaacttaatccaatcctccatgaaatgatggaagaaattgactatgatcatgatggaaccgtgtctctggaggaatggattcaaggaggaatgacaacgattccacttcttgtgctcctgggcttagaaaataacgtgaaggatgatggacagcacgtgtggcgactgaagcactttaacaaacctgcctattgcaacctttgcctgaacatgctgattggcgtggggaagcagggcctctgctgttccttctgcaagtacacagtccatgagcgctgtgtggctcgagcacctccctcttgcatcaagacctatgtgaagtccaaaaggaacactgatgtcatgcaccattactgggttgaaggtaactgcccaaccaagtgtgataagtgccacaaaactgttaaatgttaccagggcctgacaggactgcattgtgtttggtgtcagatcacactgcataataaatgtgcttctcatctaaaacctgaatgtgactgtggacctttgaaggaccatattttaccacccacaacaatctgtccagtggtactgcagactctgcccacttcaggagtttcagttcctgaggaaagacaatcaacagtgaaaaaggaaaagagtggttcccagcagccaaacaaagtgattgacaagaataaaatgcaaagagccaactctgttactgtagatggacaaggcctgcaggtcactcctgtgcctggtactcacccacttttagtttttgtgaaccccaaaagtggtggaaaacaaggagaacgaatttacagaaaattccagtatctattaaatcctcgtcaggtttacagtctttctggaaatggaccaatgccagggttaaactttttccgtgatgttcctgacttcagagtgttagcctgtggtggagatggaaccgtgggctgggttttggattgcatagaaaaggccaatgtaggcaagcatcctccagttgcgattctgcctcttgggactggcaatgatctagcaagatgcctgcgatggggaggaggttacgaaggtgagaatctgatgaaaattctaaaagacattgaaaacagcacagaaatcatgttggacaggtggaagtttgaagtcatacctaatgacaaagatgagaaaggagacccagtgccttacagtatcatcaataattacttttccattggcgtggatgcctccattgcacacagattccacatcatgagagaaaaacacccagagaaattcaacagtagaatgaagaacaaattttggtattttgagtttggcacatctgaaactttctcagccacctgcaagaagctacatgaatctgtagaaatagaatgtgatggagtacagatagatttaataaacatctctctggaaggaattgctattttgaatataccaagcatgcatggaggatccaatctttggggagagtctaagaaaagacgaagccatcgacgaatagagaaaaaagggtctgacaaaaggaccaccgtcacagatgccaaagagttgaagtttgcaagtcaagatctcagtgaccagctgctggaggtggtcggcttggaaggagccatggagatggggcaaatatacacaggcctgaaaagtgctggccggcggctggctcagtgctcctgcgtggtcatcaggacgagcaagtctctgccaatgcaaattgatggggagccatggatgcagaccccatgcacagtgagtacagagtagttgatatgctatgtcaatctcagttttgctttcctctttgactaaataaccacaataactgatttttttctttatttcttttcaacctatcagcaaatagtctttttgttgttgttgttatgtgtgtgtcagagccactacatttaggttgtagacattatatacccttggcaatgatttagctcttgaatgtttgtgttagcctaagtataaatagatcttttaaatagatcaattataaaccatagatcaattataaactatggagctaaacaaaatattaataaaagtttatctgaaacttttttgtttatttcagagcacattattagaatattatttgcaagaaatgcagacctaagcttatatgtgaacttatttctcagcttttctatgcctccatttggggatttgagggctttcttctccataagaaaaaaatttctctccagtttctaccataattaattgtgttttccagaatgaggtattatttaaggcagacactgcccctctcaaaaaaaaatcagttttcatttgcatagtgaatattttattgcatttcaaaaacatgctaggaactgcttttggcactgggagtagacacatgaacaagaccaacagtgtaatttccttcaagttacttacattcctataatagaggaccgaataaataaacaactacatgataaatataacttcagactgtgagagttattaaaaaataaggtgaaatgatgataagaagctggattaggtgtggagaataaatactacttgagataagggagacctctttgaaaggacatagccaaaagcttagtataaaattaaaaaaaataaaaaaaaaa

SEQ ID NO: 8250 - DNA, 3651 bp, Homo sapiens
atctttcagacactagttccaatgggccgggtgttctggaagggggtggcagtggggaggaggatgctgtgagcagagttcttgaagctccactcctctggggaagccgagctgtgtgggagccttcttactgtgccgggagcgtgtgaattggaaaggatcctgagaactggctagtcccagttcctctccggaaaagcagtggctctcgcttcagagatgcgctcagctttcgcctgcatcacactgcattctttaacacattattgaaattacaagcatccaaagcagtttcatgtggacagattgcatattttgaaagcctgaggtattttatcatgaaacatgccatgtggaatctttgaagcatagacctctgcgcaacacctgaataaagaatcttttacctggtatgtgacagagcttctcaccaccaccatgacaaaccaggaaaaatgggcccacctcagcccttcggaattttcccaacttcagaaatatgctgagtattctacaaagaaattaaaggatgttcttgaagaattccatggtaatggtgtgcttgcaaagtataatcctgaagggacaatagattttgaaggtttcaaactattcatgaagacattcctggaagccgagcttcctgatgatttcactgcacaccttttcatgtcatttagcaacaagtttcctcattctagtccaatggtaaaaagtaagcctgctctcctatcaggcggtctgagaatgaataaaggtgccatcacccctccccggactacttctcctgcaaatacgtgttccccagaagtaatccatctgaaggacattgtctgttacctgtctctgcttgaaagaggaagacctgaggataagcttgagtttatgtttcgcctttatgacacggatgggaatggcttcctggacagctcggagctagaaaatatcatcagtcagatgatgcatgttgcagaataccttgagtgggatgtcactgaacttaatccaatcctccatgaaatgatggaagaaattgactatgatcatgatggaaccgtgtctctggaggaatggattcaaggaggaatgacaacgattccacttcttgtgctcctgggcttagaaaataacgtgaaggatgatggacagcacgtgtggcgactgaagcactttaacaaacctgcctattgcaacctttgcctgaacatgctgattggcgtggggaagcagggcctctgctgttccttctgcaagtacacagtccatgagcgctgtgtggctcgagcacctccctcttgcatcaagacctatgtgaagtccaaaaggaacactgatgtcatgcaccattactgggttgaaggtaactgcccaaccaagtgtgataagtgccacaaaactgttaaatgttaccagggcctgacaggactgcattgtgtttggtgtcagatcacactgcataataaatgtgcttctcatctaaaacctgaatgtgactgtggacctttgaaggaccatattttaccacccacaacaatctgtccagtggtactgactctgcccacttcaggagtttcagttcctgaggaaagacaatcaacagtgaaaaaggaaaagagtggttcccagcagccaaacaaagtgattgacaagaataaaatgcaaagagccaactctgttactgtagatggacaaggcctgcaggtcactcctgtgcctggtactcacccacttttagtttttgtgaaccccaaaagtggtggaaaacaaggagaacgaatttacagaaaattccagtatctattaaatcctcgtcaggtttacagtctttctggaaatggaccaatgccagggttaaactttttccgtgatgttcctgacttcagagtgttagcctgtggtggagatggaaccgtgggctgggttttggattgcatagaaaaggccaatgtaggcaagcatcctccagttgcgattctgcctcttgggactggcaatgatctagcaagatgcctgcgatggggaggaggttacgaaggtgagaatctgatgaaaattctaaaagacattgaaaacagcacagaaatcatgttggacaggtggaagtttgaagtcatacctaatgacaaagatgagaaaggagacccagtgccttacagtatcatcaataattacttttccattggcgtggatgcctccattgcacacagattccacatcatgagagaaaaacacccagagaaattcaacagtagaatgaagaacaaattttggtattttgagtttggcacatctgaaactttctcagccacctgcaagaagctacatgaatctgtagaaatagaatgtgatggagtacagatagatttaataaacatctctctggaaggaattgctattttgaatataccaagcatgcatggaggatccaatctttggggagagtctaagaaaagacgaagccatcgacgaatagagaaaaaagggtctgacaaaaggaccaccgtcacagatgccaaagagttgaagtttgcaagtcaagatctcagtgaccagctgctggaggtggtcggcttggaaggagccatggagatggggcaaatatacacaggcctgaaaagtgctggccggcggctggctcagtgctcctgcgtggtcatcaggacgagcaagtctctgccaatgcaaattgatggggagccatggatgcagaccccatgcacaataaaaattacacacaagaaccaagccccaatgctgatgggcccgcctccaaaaaccggtttattctgctccctcgtcaaaaggacaagaaaccgaagcaaggaataatcctgtgttgtttcactcttagaaattgaattagcataattgggccatggaacacatatgctggaaatctttgaaccatttcaagtctcctgctcatgcaaaatcatggaagtggtttaacagtttttgttactaagctaatgtaaaattcagctattagaaaatttattgtctcagtttttataggcatctttgcatgaagaaagcagaagtttacctgaagtgatactgcatatttttggtgcatgcattcccatagatttttacatctcccacccaactcttccccaatttccttttactaacctgtgagaaaaacccgtgaaacatgaaaaaggaaataccatgggaaacgtgattctcagtgtgattccaattattacgaagcactaatcagtaacgctacaatgatcataattgcagattgctatacgtttcccttttagaatcagtgtatcagtgacctatgacttgaggagaaacttttaattcgaagattttattaaatagttgactacaataccttgctatatatacatagtttttcttcaacatcttaactcttctgagtggaaataaaaatatcaggcataaggttttctcatgctgaaaaatagaacgcggtttttattttgcttagttttctttttaattccagaaataagtgaaaacatgttacttgacagtcaagtgtggtaatatggcaagccttgttcctttctgcatgagaatctaggagagaattcataaccacaccaataacgaaatagaagttttaaactatgtgcctaatcaatgtgtttcccaccaaagattcagaaa

SEQ ID NO: 8251 - DNA, 494 bp, Homo sapiens
acataaattagtaccttactggctagggaatgttgaatcacagttggatgaagaaacaattcatgttaatgtttctctaaagttctttaacacattattgaaattacaagcatccaaagcagtttcatgtggacagattgcatattttgaaagcctgaggtattttatcatgaaacatgccatgtggaatctttgaagcatagacctctgcgcaacacctgaataaagaatcttttacctggtatgtgacagagcttctcaccaccaccatgacaaaccaggaaaaatgggcccacctcagcccttcggaattttcccaacttcagaaatatgctgagtattctacaaagaaattaaaggatgttcttgaagaattccatggtaatggtgtgcttgcaaagtataatcctgaagggaaacaagacattcttaaccaaacaatagattttgaaggtttcaaactattcatgaagacattcctggaagccgagctt

SEQ ID NO: 8252 - DNA, 3397 bp, Homo sapiens
gcaaatgatcagagacgggtgaactgcaggcagcctgtgttgctgcctggaagtagatttccatctttcagacactagttccaatgggccgggtgttctggaagggggtggcagtggggaggaggatgctgtgagcagagttcttgaagctccactcctctggggaagccgagctgtgtgggagccttcttactgtgccgggagcgtgtgaattggaaaggatcctgagaactggctagtcccagttcctctccggaaaagcagtggctctcgcttcagagatgcgctcagctttcgcctgcatcacactgcattctttaacacattattgaaattacaagcatccaaagcagtttcatgtggacagattgcatattttgaaagcctgaggtattttatcatgaaacatgccatgtggaatctttgaagcatagacctctgcgcaacacctgaataaagaatcttttacctggtatgtgacagagcttctcaccaccaccatgacaaaccaggaaaaatgggcccacctcagcccttcggaattttcccaacttcagaaatatgctgagtattctacaaagaaattaaaggatgttcttgaagaattccatggtaatggtgtgcttgcaaagtataatcctgaagggacaatagattttgaaggtttcaaactattcatgaagacattcctggaagccgagcttcctgatgatttcactgcacaccttttcatgtcatttagcaacaagtttcctcattctagtccaatggtaaaaagtaagcctgctctcctatcaggcggtctgagaatgaataaaggtgccatcacccctccccggactacttctcctgcaaatacgtgttccccagaagtaatccatctgaaggacattgtctgttacctgtctctgcttgaaagaggaagacctgaggataagcttgagtttatgtttcgcctttatgacacggatgggaatggcttcctggacagctcggagctagaaaatatcatcagtcagatgatgcatgttgcagaataccttgagtgggatgtcactgaacttaatccaatcctccatgaaatgatggaagaaattgactatgatcatgatggaaccgtgtctctggaggaatggattcaaggaggaatgacaacgattccacttcttgtgctcctgggcttagaaaataacgtgaaggatgatggacagcacgtgtggcgactgaagcactttaacaaacctgcctattgcaacctttgcctgaacatgctgattggcgtggggaagcagggcctctgctgttccttctgcaagtacacagtccatgagcgctgtgtggctcgagcacctccctcttgcatcaagacctatgtgaagtccaaaaggaacactgatgtcatgcaccattactgggttgaaggtaactgcccaaccaagtgtgataagtgccacaaaactgttaaatgttaccagggcctgacaggactgcattgtgtttggtgtcagatcacactgcataataaatgtgcttctcatctaaaacctgaatgtgactgtggacctttgaaggaccatattttaccacccacaacaatctgtccagtggtactggaaagacaatcaacagtgaaaaaggaaaagagtggttcccagcagccaaacaaagtgattgacaagaataaaatgcaaagagccaactctgttactgtagatggacaaggcctgcaggtcactcctgtgcctggtactcacccacttttagtttttgtgaaccccaaaagtggtggaaaacaaggagaacgaatttacagaaaattccagtatctattaaatcctcgtcaggtttacagtctttctggaaatggaccaatgccagggttaaactttttccgtgatgttcctgacttcagagtgttagcctgtggtggagatggaaccgtgggctgggttttggattgcatagaaaaggccaatgtaggcaagcatcctccagttgcgattctgcctcttgggactggcaatgatctagcaagatgcctgcgatggggaggaggttacgaaggtgagaatctgatgaaaattctaaaagacattgaaaacagcacagaaatcatgttggacaggtggaagtttgaagtcatacctaatgacaaagatgagaaaggagacccagtgccttacagtatcatcaataattacttttccattggcgtggatgcctccattgcacacagattccacatcatgagagaaaaacacccagagaaattcaacagtagaatgaagaacaaattttggtattttgagtttggcacatctgaaactttctcagccacctgcaagaagctacatgaatctgtagaaatagaatgtgatggagtacagatagatttaataaacatctctctggaaggaattgctattttgaatataccaagcatgcatggaggatccaatctttggggagagtctaagaaaagacgaagccatcgacgaatagagaaaaaagggtctgacaaaaggaccaccgtcacagatgccaaagagttgaagtttgcaagtcaagatctcagtgaccagctgctggaggtggtcggcttggaaggagccatggagatggggcaaatatacacaggcctgaaaagtgctggccggcggctggctcagtgctcctgcgtggtcatcaggacgagcaagtctctgccaatgcaaattgatggggagccatggatgcagaccccatgcacaataaaaattacacacaagaaccaagccccaatgctgatgggcccgcctccaaaaaccggtttattctgctccctcgtcaaaaggacaagaaaccgaagcaaggaataatcctgtgttgtttcactcttagaaattgaattagcataattgggccatggaacacatatgctggaaatctttgaaccatttcaagtctcctgctcatgcaaaatcatggaagtggtttaacagtttttgttactaagctaatgtaaaattcagctattagaaaatttattgtctcagtttttataggcatctttgcatgaagaaagcagaagtttacctgaagtgatactgcatatttttggtgcatgcattcccatagatttttacatctcccacccaactcttccccaatttccttttactaacctgtgagaaaaacccgtgaaacatgaaaaaggaaataccatgggaaacgtgattctcagtgtgattccaattattacgaagcactaatcagtaacgctacaatgatcataattgcagattgctatacgtttcccttttagaatcagtgtatcagtgacctatgacttgaggagaaacttttaattcgaagattttattaaatagttgactacaataccttgctatatatacat

SEQ ID NO: 8253 - DNA, 6297 bp, Homo sapiens
tggcccggcagcatggcggcggcggcgggcgcccctccgccgggtcccccgcaaccgcctccgccgccgccgcccgaggagtcgtccgacagcgagcccgaggcggagcccggctccccacagaagctcatccgcaaggtgtccacgtcgggtcagatccgacagaagaccatcatcaaagaggggatgctgaccaaacagaacaattcattccagcgatcaaaaaggagatactttaagcttcgagggcgaacgctttactatgccaaaacggcaaagtcaatcatatttgatgaggtggatctgacagatgccagcgtagctgaatccagtaccaaaaacgtcaacaacagttttacggtcataactccatgcaggaagctcatcttgtgtgctgataacagaaaagaaatggaagattggattgcagcattaaagactgtgcagaacagggagcactttgagcccacccagtacagcatggaccacttctcagggatgcacaattggtacgcctgttcccacgcgaggccgacctactgcaatgtgtgccgtgaggctctgtctggggtcacgtcgcacgggctgtcctgcgaggtgtgcaaatttaaggcccacaagcgctgtgctgtgcgtgcaaccaataactgcaagtggaccacactggcctcgatcgggaaggacatcattgaagatgcagatgggattgcaatgccccaccagtggttggaaggaaacctacctgtgagcgccaagtgcactgtgtgcgacaagacctgtggcagtgtgctgcgcctgcaggactggcgctgcctctggtgcaaggccatggttcacacatcgtgtaaagaatccttgctgaccaagtgcccacttggcctgtgcaaagtgtcagtcatcccacccacggctctcaacagcatcgactccgatgggttctggaaggccagctgtcctccttcttgcacaagcccactgttggtcttcgtcaattcaaaaagtggggacaaccagggtgtgaagttcctcagaagattcaaacagctactaaaccccgcccaggtcttcgacctcatgaacggaggcccacacctcggcttacggttattccagaagtttgacacattccggattctggtttgtggcggggatggaagtgttggctgggtcctctccgaaatcgacagcctcaaccttcataaacagtgtcagctgggagtgctgccgctcggcacagggaacgacttggcccgagtactgggctggggctcagcctgcgatgacgacacccagctcccccagatcttggagaagttggagagagccagcaccaagatgctggacaggtggagcgtcatggcatacgaggccaagctcccccggcaggcctcctcctctaccgtcaccgaagacttcagcgaggattccgaggtacagcagattctcttctatgaagactcggttgcagcccacctttctaaaatcctcacctcggaccagcactcggtggtcatctcctcggccaaagtgctctgtgagacggtgaaggacttcgtggcacgggtggggaaggcctatgagaagacgaccgagagctcggaggagtcagaggtcatggccaagaagtgctctgtcctgaaagagaagctggattcccttctcaagaccttggacgatgagtcccaggcctcgtcctctctgcccaacccgccccccaccattgccgaggaggctgaagatggagatgggtcgggcagcatctgcggttccaccggagaccgcttggtggcatcagcttgcccggcccggccgcagatattccggcctcgagaacagctcatgctgagagccaacagcctgaagaaagcaattcgtcagatcatagaacacacagaaaaagctgtcgatgagcagaatgcccagacccaggagcaggagggcttcgtcctgggcctctctgagtcagaggagaagatggaccacagagtgtgcccaccactgtcccacagcgagagcttcggggtccccaaggggaggagccagcgcaaagtgtcgaaatctccgtgtgaaaagctgatcagcaaagggagtctgtccctaggcagttctgcttcccttccgccccagccgggaagccgggacggcctgcctgcgctcaacaccaagatcctgtacccaaatgtccgggctggaatgtctggttccttacccggtggctcagtcatcagtcgcctgttaattaatgctgatcccttcaactctgaaccagaaaccctagagtattacacggagaaatgtgtcatgaacaactattttggcattggcctggatgcgaagatatccctggactttaacaacaagcgcgatgagcacccagagaagtgcaggagccgaaccaagaacatgatgtggtatggagttcttggaaccaaagagttgctgcacagaacctacaagaacctggagcaaaaggtcttgctggagtgtgacgggcgacccatcccactccccagtcttcagggaattgctgtccttaacattcccagctatgccggaggaaccaacttctgggggggtaccaaggaagatgatactttcgcagctccatcattcgatgacaagattctggaggtggtcgccgtgttcggcagcatgcagatggccgtctctcgagtcatcaggctacagcatcatcggatcgcccagtgtcgcacggtgaagatctccatccttggggatgagggcgtgcctgtgcaggtggacggagaggcctgggtccagccgccagggtacattcggattgtccacaagaaccgggcacagacactgaccagagacagggcatttgagagcaccctgaagtcctgggaagacaagcagaagtgcgagctgccccgccctccatcctgttccctgcacccggagatgctgtccgaggaggaggccacccagatggaccagtttgggcaggcagcaggggtcctcattcacagtatccgagaaatagctcagtctcaccgggacatggagcaggaactggcccacgccgtcaatgccagctccaagtccatggaccgtgtgtatggcaagcccagaaccacagaggggctcaactgcagcttcgtcctggaaatggtgaataacttcagagctctgcgcagtgagacggagctgctgctgtctgggaagatggccctgcagctggatccgcctcagaaggagcagctggggagtgctcttgccgagatggaccgacagctcaggaggctggcagacaccccgtggctctgccagtccgcagagcccggcgacgaagagagtgtgatgctggatcttgccaagcgcagtcgcagtggtaaattccgcctcgtgaccaagtttaaaaaggagaaaaacaacaagaacaaagaagctcacagtagcctgggagccccggttcacctctgggggacagaggaggttgctgcctggctggagcacctcagtctctgtgagtataaggacatcttcacacggcacgacatccggggctctgagctcctgcacctggagcggagggacctcaaggacctgggcgtgaccaaggtgggccacatgaagaggatcctgtgtggcatcaaggagctgagccgcagcgcccccgccgtcgaggcctagcctctgtcctctcagcctgtggcctccacatccccgccgccgaggcctagcctccgccctctcagcctgtggcctctgcgcctcctgccactgaggccctgggcagatgctgcagcccgcccccttctcatggtgctacttcctctgtcagctacagaaagcctccgtgacaccgtccaccagagctctggggtctcgaacataacaacacagctacctttgaaacaacactttctccagctcagagtcacctggggcacatgtgtcacggccactcagctctcgcccgcctgtgctgtgggccagggaatccagcggcgtctggcctcctgggcactgcttgcctggcctcgtgcttggattgtcccgggggctcctctccgtgtgtccttctgtggccgcaccgtgtggctccgcctcctggcccccagccagttctcagaaacgtggctggggcccagcacagcagcctgcaagggcccctgtttgttgatgcagcttttgttgaacaaaaatcgtgctctttcctggtttgaaagtagcatggatgtttccagtcttgttgattgtaatttgacgtgaagagaaaaaaaaattcctcctgcgtgagccaaggcagcgggtgctgtttcccaggcggggagcccctccctgggtgtcacagggcctgtgctcctccctcctccatcctctctcctcccgctcctccctccccccactgtgggctggggacgcctgcccttctgtctccggacgctctaggcgagttcagcttggggtgtgagtgagacagcttgccagctgcatccctgcagacagaggatgtgtgtccacatgagtgtttctgtgtgggaaatgcttcctggctctgggaaactttttctgcccattctgtggttcccagggagcgtggccctggtgggccaggggtggtttgacctcttcagcccgtccggtggcctggaggccggaggctctcctgagtgtctgcccctgcagtggcttcttgtcgcctgctgctgggcgtgatgtcgctggaggtgctggcagggactctgatttggtggtccgcgctgcccctgccctgcctctgtcctggctctgaactagtagatgatggtgccagagggcagggagctcgcctggggagagggctgtgccccgtagggacagtgcccaggtgaaggatgcccctggtcctccagggcactgactttgcccttttttcccgttgatagtcatggctcagaggtgcttgtaaatgtcttgggaagaggtttctgtaacccctgccctggtgtgaggaggaaatggctctggcctggctgcctggccgtggcttctctttggctcccaaagagaaggacagtgttgggagtatctgccgtggcttctctttggctcccaaagagaaggacagtgttgggagtatctgccggcgctgtccaggtcctttagtcagcgtcactccatctgatgtgcagaagctgggctgcacctgcgggggtgggcatagaccgggctgggtctgcagcagcccctggtcctgagcaggcggcagtgaacagcactggcccacctcccactcacagcccctctgtcccctctgcagtgcacccaggtgggcccctctgcgtgcctttgggtgctcccctctcgtggtcgttctggcccgaggcccttagagtatggaggctgagccaggccttgggtttccccagcacagcctcctgtcgctgcatgcgacgtgttgggatttttggatgaaagactctcccacgctctgttggtggacttagctgcctcactggaagtgatgtgggtggaaggtggttgtatgttaccttttccacctctcattgttttccccagaacattgtagatgggggttggcagagggagaaataagccagccacggcagtcgcttggtttcccaggtggaatgggctaacacaggagatgatgggaacctgtcccgcagtccctgcatgaccattggccctgctggcctggcgatgtgggcatcctggggttcttagggtcccagaacaagccccaggcaagctggaacttgggtggggaggggacatgaggaggataaacagctgactgtggcttcaaggacatcagggccaccccaagtcctcagtgtcctactcctggcaaggagttgggtttggatcaaaagtgtttaaaattaatatgttgtcagtgattagaacaacactgtttacataaaaaccatttttctaattctaacaagttagaatgtgaggaaggaatgaacatgagtgtttaggaacctgccctttggtgctgggctggcgtcccgcactggggtgtcctcgctgtctgggggctgctctgctgccccggcccaggtccccttgtggtgttgccagacgggcctcatggtctgctgtgcagagagaggcaggaaggatccctgaagagtcttggagaaaaggttctgtgccctcaggtggggcttaccccctcgtatttataatcttaatttatatagtgaccaccgtggaaacaaacgcctcttgtattgtcatgtacatagtccatacctgagtgctgtacataagttgttctgtgtataaataaaacaagcctgtttttgatcttccatc

SEQ ID NO: 8254 - DNA, 6228 bp, Homo sapiens
agagacacgaatatgtttcagccgcaacaggctgcgtttcagccggaagagtgaaagggcaccttgaaaacgcaagtttatgaatatgtttctgtactttcagaccatcatcaaagaggggatgctgaccaaacagaacaattcattccagcgatcaaaaaggagatactttaagcttcgagggcgaacgctttactatgccaaaacggcaaagtcaatcatatttgatgaggtggatctgacagatgccagcgtagctgaatccagtaccaaaaacgtcaacaacagttttacggtcataactccatgcaggaagctcatcttgtgtgctgataacagaaaagaaatggaagattggattgcagcattaaagactgtgcagaacagggagcactttgagcccacccagtacagcatggaccacttctcagggatgcacaattggtacgcctgttcccacgcgaggccgacctactgcaatgtgtgccgtgaggctctgtctggggtcacgtcgcacgggctgtcctgcgaggtgtgcaaatttaaggcccacaagcgctgtgctgtgcgtgcaaccaataactgcaagtggaccacactggcctcgatcgggaaggacatcattgaagatgcagatgggattgcaatgccccaccagtggttggaaggaaacctacctgtgagcgccaagtgcactgtgtgcgacaagacctgtggcagtgtgctgcgcctgcaggactggcgctgcctctggtgcaaggccatggttcacacatcgtgtaaagaatccttgctgaccaagtgcccacttggcctgtgcaaagtgtcagtcatcccacccacggctctcaacagcatcgactccgatgggttctggaaggccagctgtcctccttcttgcacaagcccactgttggtcttcgtcaattcaaaaagtggggacaaccagggtgtgaagttcctcagaagattcaaacagctactaaaccccgcccaggtcttcgacctcatgaacggaggcccacacctcggcttacggttattccagaagtttgacacattccggattctggtttgtggcggggatggaagtgttggctgggtcctctccgaaatcgacagcctcaaccttcataaacagtgtcagctgggagtgctgccgctcggcacagggaacgacttggcccgagtactgggctggggctcagcctgcgatgacgacacccagctcccccagatcttggagaagttggagagagccagcaccaagatgctggacaggtggagcgtcatggcatacgaggccaagctcccccggcaggcctcctcctctaccgtcaccgaagacttcagcgaggattccgaggtacagcagattctcttctatgaagactcggttgcagcccacctttctaaaatcctcacctcggaccagcactcggtggtcatctcctcggccaaagtgctctgtgagacggtgaaggacttcgtggcacgggtggggaaggcctatgagaagacgaccgagagctcggaggagtcagaggtcatggccaagaagtgctctgtcctgaaagagaagctggattcccttctcaagaccttggacgatgagtcccaggcctcgtcctctctgcccaacccgccccccaccattgccgaggaggctgaagatggagatgggtcgggcagcatctgcggttccaccggagaccgcttggtggcatcagcttgcccggcccggccgcagatattccggcctcgagaacagctcatgctgagagccaacagcctgaagaaagcaattcgtcagatcatagaacacacagaaaaagctgtcgatgagcagaatgcccagacccaggagcaggagggcttcgtcctgggcctctctgagtcagaggagaagatggaccacagagtgtgcccaccactgtcccacagcgagagcttcggggtccccaaggggaggagccagcgcaaagtgtcgaaatctccgtgtgaaaagctgatcagcaaagggagtctgtccctaggcagttctgcttcccttccgccccagccgggaagccgggacggcctgcctgcgctcaacaccaagatcctgtacccaaatgtccgggctggaatgtctggttccttacccggtggctcagtcatcagtcgcctgttaattaatgctgatcccttcaactctgaaccagaaaccctagagtattacacggagaaatgtgtcatgaacaactattttggcattggcctggatgcgaagatatccctggactttaacaacaagcgcgatgagcacccagagaagtgcaggagccgaaccaagaacatgatgtggtatggagttcttggaaccaaagagttgctgcacagaacctacaagaacctggagcaaaaggtcttgctggagtgtgacgggcgacccatcccactccccagtcttcagggaattgctgtccttaacattcccagctatgccggaggaaccaacttctgggggggtaccaaggaagatgatactttcgcagctccatcattcgatgacaagattctggaggtggtcgccgtgttcggcagcatgcagatggccgtctctcgagtcatcaggctacagcatcatcggatcgcccagtgtcgcacggtgaagatctccatccttggggatgagggcgtgcctgtgcaggtggacggagaggcctgggtccagccgccagggtacattcggattgtccacaagaaccgggcacagacactgaccagagacagggcatttgagagcaccctgaagtcctgggaagacaagcagaagtgcgagctgccccgccctccatcctgttccctgcacccggagatgctgtccgaggaggaggccacccagatggaccagtttgggcaggcagcaggggtcctcattcacagtatccgagaaatagctcagtctcaccgggacatggagcaggaactggcccacgccgtcaatgccagctccaagtccatggaccgtgtgtatggcaagcccagaaccacagaggggctcaactgcagcttcgtcctggaaatggtgaataacttcagagctctgcgcagtgagacggagctgctgctgtctgggaagatggccctgcagctggatccgcctcagaaggagcagctggggagtgctcttgccgagatggaccgacagctcaggaggctggcagacaccccgtggctctgccagtccgcagagcccggcgacgaagagagtgtgatgctggatcttgccaagcgcagtcgcagtggtaaattccgcctcgtgaccaagtttaaaaaggagaaaaacaacaagaacaaagaagctcacagtagcctgggagccccggttcacctctgggggacagaggaggttgctgcctggctggagcacctcagtctctgtgagtataaggacatcttcacacggcacgacatccggggctctgagctcctgcacctggagcggagggacctcaaggacctgggcgtgaccaaggtgggccacatgaagaggatcctgtgtggcatcaaggagctgagccgcagcgcccccgccgtcgaggcctagcctctgtcctctcagcctgtggcctccacatccccgccgccgaggcctagcctccgccctctcagcctgtggcctctgcgcctcctgccactgaggccctgggcagatgctgcagcccgcccccttctcatggtgctacttcctctgtcagctacagaaagcctccgtgacaccgtccaccagagctctggggtctcgaacataacaacacagctacctttgaaacaacactttctccagctcagagtcacctggggcacatgtgtcacggccactcagctctcgcccgcctgtgctgtgggccagggaatccagcggcgtctggcctcctgggcactgcttgcctggcctcgtgcttggattgtcccgggggctcctctccgtgtgtccttctgtggccgcaccgtgtggctccgcctcctggcccccagccagttctcagaaacgtggctggggcccagcacagcagcctgcaagggcccctgtttgttgatgcagcttttgttgaacaaaaatcgtgctctttcctggtttgaaagtagcatggatgtttccagtcttgttgattgtaatttgacgtgaagagaaaaaaaaattcctcctgcgtgagccaaggcagcgggtgctgtttcccaggcggggagcccctccctgggtgtcacagggcctgtgctcctccctcctccatcctctctcctcccgctcctccctccccccactgtgggctggggacgcctgcccttctgtctccggacgctctaggcgagttcagcttggggtgtgagtgagacagcttgccagctgcatccctgcagacagaggatgtgtgtccacatgagtgtttctgtgtgggaaatgcttcctggctctgggaaactttttctgcccattctgtggttcccagggagcgtggccctggtgggccaggggtggtttgacctcttcagcccgtccggtggcctggaggccggaggctctcctgagtgtctgcccctgcagtggcttcttgtcgcctgctgctgggcgtgatgtcgctggaggtgctggcagggactctgatttggtggtccgcgctgcccctgccctgcctctgtcctggctctgaactagtagatgatggtgccagagggcagggagctcgcctggggagagggctgtgccccgtagggacagtgcccaggtgaaggatgcccctggtcctccagggcactgactttgcccttttttcccgttgatagtcatggctcagaggtgcttgtaaatgtcttgggaagaggtttctgtaacccctgccctggtgtgaggaggaaatggctctggcctggctgcctggccgtggcttctctttggctcccaaagagaaggacagtgttgggagtatctgccgtggcttctctttggctcccaaagagaaggacagtgttgggagtatctgccggcgctgtccaggtcctttagtcagcgtcactccatctgatgtgcagaagctgggctgcacctgcgggggtgggcatagaccgggctgggtctgcagcagcccctggtcctgagcaggcggcagtgaacagcactggcccacctcccactcacagcccctctgtcccctctgcagtgcacccaggtgggcccctctgcgtgcctttgggtgctcccctctcgtggtcgttctggcccgaggcccttagagtatggaggctgagccaggccttgggtttccccagcacagcctcctgtcgctgcatgcgacgtgttgggatttttggatgaaagactctcccacgctctgttggtggacttagctgcctcactggaagtgatgtgggtggaaggtggttgtatgttaccttttccacctctcattgttttccccagaacattgtagatgggggttggcagagggagaaataagccagccacggcagtcgcttggtttcccaggtggaatgggctaacacaggagatgatgggaacctgtcccgcagtccctgcatgaccattggccctgctggcctggcgatgtgggcatcctggggttcttagggtcccagaacaagccccaggcaagctggaacttgggtggggaggggacatgaggaggataaacagctgactgtggcttcaaggacatcagggccaccccaagtcctcagtgtcctactcctggcaaggagttgggtttggatcaaaagtgtttaaaattaatatgttgtcagtgattagaacaacactgtttacataaaaaccatttttctaattctaacaagttagaatgtgaggaaggaatgaacatgagtgtttaggaacctgccctttggtgctgggctggcgtcccgcactggggtgtcctcgctgtctgggggctgctctgctgccccggcccaggtccccttgtggtgttgccagacgggcctcatggtctgctgtgcagagagaggcaggaaggatccctgaagagtcttggagaaaaggttctgtgccctcaggtggggcttaccccctcgtatttataatcttaatttatatagtgaccaccgtggaaacaaacgcctcttgtattgtcatgtacatagtccatacctgagtgctgtacataagttgttctgtgtataaataaaacaagcctgtttttgatcttc

SEQ ID NO: 8255 - DNA, 7766 bp, Homo sapiens
ctccagctcgcggccccgcgcgccggatcggcgtgcgtgcggctggagccttaagcgtttcccccgcccggcttcatccctgctggcggcccagcgtcgttctcctcctgcgcgaggcggccaaggcctgctggcccggagccgcgcctccacccgcgcgaggtatcgtccttggagaagatggaagcggagaggcggccggcgccgggctcgccctccgagggcctgtttgcggacgggcacctgatcttgtggacgctgtgctcggtcctgctgccggtgttcatcaccttctggtgtagcctccagcggtcgcgccggcagctgcaccgcagggacatcttccgcaagagcaagcacgggtggcgcgacacggacctgttcagccagcccacctactgctgcgtgtgcgcgcagcacattctgcagggcgccttctgcgactgctgcgggctccgcgtggacgagggctgcctcaggaaggccgacaagcgcttccagtgcaaggagattatgctcaagaatgacaccaaggtcctggacgccatgccccaccactggatccggggcaacgtgcccctgtgcagttactgtatggtttgcaagcagcagtgtggctgtcaacccaagctttgcgattacaggtgcatttggtgccagaaaacagtacatgatgagtgcatgaaaaatagtttaaagaatgaaaaatgtgattttggagaattcaaaaacctaatcattccaccaagttatttaacatccattaatcagatgcgtaaagacaaaaaaacagattatgaagtgctagcctctaagcttggaaagcagtggaccccattaataatcctggccaactctcgtagtggaactaatatgggagaaggactgttgggagaatttaggatcttgttgaatccagtccaggtttttgatgtaactaaaactcctcctatcaaagccctacaactctgtactcttctcccatattattcagctcgagtacttgtttgtggaggggatgggactgtagggtgggtcctggatgcagttgatgacatgaagattaagggacaagaaaagtacattccacaagttgcagttttgcctctgggaacaggcaacgatctatccaatacattgggttggggtacaggttatgctggagaaattccagttgcgcaggttttgcgaaatgtaatggaagcagatggaattaaactagatcgatggaaagttcaagtaacaaataaaggatactacaacttaagaaaacccaaggaattcacaatgaacaactatttttctgttggacctgatgctctcatggctctcaattttcatgctcatcgtgagaaggcaccatctctgttttctagcagaattcttaataaggcggtttacttattctatggaaccaaagattgtttagtgcaagaatgtaaagatttgaataaaaaagttgagctagaactggatggtgagcgagtagcactgcccagcttggaaggtattatagttctgaacatcggatactggggcggtggctgcagactatgggaagggatgggggacgagacttaccctctagccaggcatgacgatggtctgctggaagtcgttggagtatatgggtctttccactgtgctcagattcaagtaaaactggctaatccttttcgaataggacaggcacatacagtgaggctgattttgaagtgctccatgatgccaatgcaggtggatggggagccttgggcccaagggccctgcactgtcaccataactcacaagacacatgcaatgatgttatatttctctggagaacaaacagatgatgacatctctagtacttcggatcaagaagatataaaggcgactgaatagatggatgagggagtgaaaactttgcatagaatcctcacgcaagtagatacatgttcatccaaaagtattaatagaaattctctatcagctattcagtcttaatttcactagtagtataatgggtatacatttttgtaaatagcatccccaaaccagccagccttcagttatttacaaatgtttgttcttttttcagcaaaatacttcaaatgaatagtattaacttacaaaaagtcacaaaaacttacatgagagtgaaaatttgttatgactgttttgagagtgggactcactctgaagtatgtgctgtctcatgtcttatttttgaaccatgcatatgatggacacacaatggatggacacattatatctccaacaaggtgtgggtggaaagatcaaattaacctgcttttttgaaaggaaatgattactgtcaaaccagcatggttaattgtgagcatcctcctgcagcatgccccttaagattttctacaacccaaaccaagtgtatgtattgatttctaggaacccccaaaaggagaatagtaaaaaaagatcatacttaaaatttgtattacaatttttattttaggaacttattcagacacgtaaatgttgtttaattctgtaggtaaccatttgagctgcaattcaggatcttttttataacaccagtgtagccaaaagagaaacagataagtgaattggtaagaaataagattcagagcacttgggattgtaagttataggttctgagctgaactgtttatcagccgctctttttattaaaagacagtgtcaacacttcaaaaaacgtgcttaaaggagacaacggtgagattaattgcttagaaaaagctcaaggctgactgataagttttaaaaatttggtggtcttgtagtattttgaaatacagtagtcttttaacagaatttccccttagggaggtaagtggacagaaatctttgctaaaatgtttatatcatatttattttaaaatgagagagatatatttttaaattatttattatttaccttgtggtatggtacctgtgtttagtgtttacgttctgtagctttatttaataagttaaattgatcacataaattctgctagtcacaatcagatagaaatttagtctattaattaaaattctaatttaattctcctgacagaaatctagatattcttattcttcacaaatattcctcattgtattgaaaaatgaaggagggcatgaaaagcactagggaactacttttggataactgaaagctttgtttcattgttttatttgcccctcaattgccacaaacttactgaagggctagtttcatggttcccattagagggtgcttgttcgctgctgttgaccagcccaagggtcgtgacccacaggtcggctgacccagagggcatccagcctggtgtttttctgacacatggcccaggctttgtggtctttcatgacattaatctctgaaagatcagaatgtatcccccaaaataccattagctatctttgagggtctattatgaatctgtcatccatgaattgccataaacctaagtttgcctcacctcaggcccagaccatgttttcaaagagcaacttagtaatgtatacagtagtcagtacattttatgaaatactctattttgctaaattaacctcttgcagatctcctcaggtgatcttaaattctagtcttgagaaactttgtgagcagatctgttttcagcttctttatatacctttcatggtaagtaaccatggcagtgaggatggcagagttttgttttttttttttttaatgggccaatcatgttctgagtattatgaagtttatcctttcattcatgatcaaaattgttaaagacatcacattttataaatacactgttaaatccactttgctgtaggttatagtttacctgttatataattcgtagtgctaattgtagtagaagcaaatcaatttaggatgttggaacgaaaataatcacaataactaatacagctttttaattgtgaaaactacaattaaaaattataattttaataccaaccataatattacactgtatttagaacaggcttatgtaaaatgccctcatttatctaaataagttgattttttggttattgtaatctagtaaggtttttgcatcactactggtctgtcatgaagtttttctgctggcttattcacttatttagacttcatttagggaagctatttcagaataccatctcataaaatgtatcattatcttgtttttgcaaaattcacttactttttgggcacatttacccagcatttcaaataagtgtataggcatgtgccttgtttaagtacaatttataagacttcatgtttgcaagttacatattagggtagtgattgtttatattaccagggattctacactttaccaaaaaaaattgccataagattttcctgttccattttaaattgtcttgatatttaaaaaaataacttctacattctcaggaagaaatacatgaagtaaatcatatctccatgtctgtttccagatttctctaatctttttactatcccaatacattcctaattcctataaacgtagtggcttaaatactgaatacctggcagctcttaaagatcccttaggcagatgatgataattttcagtgtttcgtcatgtttaatagaaatcaaactgacttgtgttttaaaatacaagttgtctgctagtaaagttacatgatttaggtgtgttttaggttttctgcaacaattagctgtgaacccctaatgtagctaagtttatacaaattttataatcaaaattatttatttttatttttttagagtatgtcaaaaacatatagtgtttgctttgtgaaatacatttgcttagagttataaaatatactgtgactcagaaattgtaaagtcagtttgcgttgtaaaaatgaatactaccagcatgtcaaaagaaaaataatttacatttgtaatataaagtaaaattgtatttaatatatttattgaattttaaatttgcactaacttgaaaactttaaaggttatactaatttaatgattaatgtggacccaaatacataatttggccaaaaaagtcattagaatgggtaatggttttgtgtggttttccttcaaaatgataatattgaagcaagaaccagcattttatattgataatttttttaatatttctacccagttgaggacagtggaatataagtagatatatttaaaatatctagatatttaaaaagaaagaaaaggttgtttatcccaatctgaattcattctcagcaacaagacagaaaaggtggtttgggttttgcttttaaacagtgtccccctgtctttttcaatttttcccttgaagcctttctcttgttcttcagagtacgcgctgcaggctatctgcagcatcagaatgcctgggcaggctgttgaaagtatggattcctgagcccaacccttaacttaatgattccctgtctctggagatgcaacatagaaatctctgtttttattaacaagcgcctcaggcgattcttaagcatactgaaatttgaaagcttctggtctgaacctcatgtattcacctagggcttttgctaggtgggataccatgccgaaaaattgaattaattgtatgttcttaaaattgtttttcttctactccgctgtcctcttccctcaaaatcacttttctaaaagaactctatgaaaaacttatttgtatcatacccaaattgatatatttgtctgaactctgttacataaaaattggtatgattcatatgtggaatcagtttttggactgtgacccatgcagtgttgggggacaaggagttgcttcaggagttagtgcagtgcgcctccaaggggcagtgagccatggaggcgcctgccttctcactgcagtcaatgcagccacacttgtgtatactgagtgctgcttcagatctcagtagataaaataattccacatttaaaatgattctgctattttttataaagggtttgaaagccactactataatgactttgtcacctaattgattttctactaatttttacatattcagaaacttcgtgtttttttggtggacagaatattttggaggtctccgtcgctgtttagaatgtggccacttggctgtttcacagtttttaaagctattttattgaatagtaaagcagtgaacttagcctttgttctttgtgtttctaatttaagcatatagtctatttaatttttgatatgtaaatacacatcaatacatatatatttacccatgtggccctgtgtagtcagtgcatgaggcttgcatagcccagaaaggtacattccagggttctggggaaagaattttaaaatgccatcctctaatacagacgtttataaaacttaaatgaaatgattgggcttaaccatatgcaagaaagtctgcagaaaataaatcacctagaaactataaatagaaatgtgctgctgaggctgggcacggtggctcacacctgtaatcccagcacttggggggctaagggaggcgtatcacctgaggtcaggagtttgagacaagcctggtcaacatggtgaaacgccgtctctactaaaaatacaaaaaaaattagccaggtacattggcacatgcctttaatcccagctaatcaggaggctgaggcacgagaattgctcgaacccaggcggcagagcttgcagtgagcggagatcacatgactgcactccagcctgggcaacagagcaagactccatctcaaaaaaaaaaaggccgggcgtggtggctcacgcctgtaatcccagcactttgggaggctgaggcaggtggatcacgaggtcaggagatcgagactatcctggctaacacggtgacaccccgcctctactaaaaatccaaaaatttagccgggcatggtggcgggcacctgtagtcccagctactcgggaggctgaggcaggagaatggcgtgaacccgggaggcagagcttgcagggaggcggagcttgcagcgagccgagatagtgccactgcagtggggcctgggccaaagagtgagactccatctcaaaaaaaaaaaaaaagaaagaaatgtgttgctggtatcagatatcagaccaagaacacttcagtctctctaaggatgccctgagctacctcactgttaaaggacgacatcaacacagaatgcactaaacaggaaataagctgtaatctagagaatttccattatgtgttactttttggtgactaacatggaatgttgaaaaggaagagctggaaagctcagttgttttccttgttcctctgacattgtccaggcaagagggcatcctgatcagatgagtagatttggctgagaaaaaccctagagtaaggcaggcactttgtggaggtggatgatgatggctcataaaaacgtttgttctcagtccagttcagggctctgccagcagtctttcagatctgaactgcttaaacaaaccctacagataaattggcactctgatttgtaattctgtttgtacaagtttagagcagcctagctcgagtcctcaaccccagtcctcttagaagtgaactgattgcactggatccctaaacccacaatgttgaggacacatgtgatgactccacttgctcagccagctggcctcttgcactttcccctgcccaccacttgtaactaccacttaattatcttgtgttaattgcttttgttgtgttgggtctgtatttttgtggtcagtgcctgcaggcagaaatgtgaaagcatttggtatgttgaagatacttgcttcttttttaataaaattaaaagtgcagcacgt

SEQ ID NO: 8256 - DNA, 5805 bp, Homo sapiens
gccgcagtgccgtagtagcgggccacggagatagacagctttggagctgctgaactccgagcacagggtgaagaccccggcgctaccaaccacagcctggcagcctggtctccgcggcacccactggggctgcatccccctcccccgagagggctgcgcaggcgggaagacgcccagaggccagcttcggtcccccttctgtctctcggttcctctttcctcccaagtaagggaataaaccgcgaagaaggagcgccccgggccaccgcgcaaccaagtgttgcctggtgaggaagagccaggacttctgaatttaccttgaatacagacaggaggatgttgcctaaggaatagcagagatcttgtctcatcttctgagaggtgcctgctgctgctgtatacacttgagtgctcccagaagtctcctgaaaggcttacatcgcaaacctgcaatgagccaggccctgggctgggcctccacttcagcctagtgaacaaaactccatcactgccctttagccactcacataaagtttaaaaatgggtgaagaacggtgggtctccctcactccagaagaatttgaccaactccagaaatattcagaatattcctccaagaagataaaagatgccttgactgaatttaatgagggtgggagcctcaaacaatatgacccacatgagccgattagctatgatgtcttcaagctgttcatgagggcgtacctggaggtggaccttccccagccactgagcactcacctcttcctggccttcagccagaagcccagacacgagacctctgaccacccgacggagggagccagcaacagtgaggccaacagcgcagatactaatatacagaatgcagataatgccaccaaagcagacgaggcctgtgcccctgatactgaatcaaatatggctgagaagcaagcaccagctgaagaccaagtggctgcgacccccctggaaccccccgtccctcggtcttcaagctcggaatccccagtggtatacctgaaggatgttgtgtgctacctgtccctgctggagacggggaggcctcaggataagctggagttcatgtttcgcctctatgattcagatgagaacggtctcctggaccaagcggagatggattgcattgtcaaccaaatgctgcatattgcccagtacctggagtgggatcccacagagctgaggcctatattgaaggagatgctgcaagggatggactacgaccgggacggctttgtgtctctacaggaatgggtccatggagggatgaccaccatcccattgctggtcctcctggggatggatgactctggctccaagggggatgggcggcacgcctggaccatgaagcacttcaagaaaccaacctactgcaacttctgccatatcatgctcatgggcgtccgcaagcaaggcctgtgctgcacttactgtaaatacactgtccacgaacgctgtgtgtccagaaacattcctggttgtgtcaaaacgtactcaaaagccaaaaggagtggtgaggtgatgcagcacgcatgggtggaagggaactcctccgtcaagtgtgaccggtgccacaaaagtatcaagtgctaccagagtgtcaccgcgcggcactgcgtgtggtgccggatgacgtttcaccgcaaatgtgaattatcaacgttgtgtgacggtggggaactcagagaccacatcttactgcccacctccatatgccccatcacccgggacaggccaggtgagaagtctgatggctgcgtgtccgccaagggcgaacttgtcatgcagtataagatcatccccaccccgggtacccaccccctgctggtcttggtgaaccccaagagtggagggagacaaggagaaagaattcttcggaaattccactatctgctcaaccccaaacaagttttcaacctggacaatggggggcctactccagggttgaactttttccgtgatactccagacttccgtgttttggcctgtggtggagatgggacagttggctggattttggattgcattgataaggccaactttgcaaagcatccaccagtggctgtcctgcctcttggaacaggaaatgaccttgcccgttgtctccgctggggaggaggttatgaagggggcagcttgacaaaaatcctgaaagacattgagcagagccccttggtgatgctggaccgctggcatctggaagtcatccccagagaggaagtggaaaacggggaccaggtcccatacagcatcatgaacaactatttctccattggtgtggacgcttccattgcacacagattccatgtgatgagagagaaacatcctgaaaaattcaacagcaggatgaagaacaagctgtggtactttgaatttggcacctcggagacttttgcagcgacctgcaagaaactccacgaccacattgagttggagtgtgatggggttggggtggacctgagcaacatcttcctggaaggcattgccattctcaacattcccagcatgtacggaggcaccaatctctggggagaaaacaagaagaaccgggctgtgatccgggaaagcaggaagggtgtcactgaccccaaagaactgaaattctgcgttcaagacctcagtgaccagctccttgaagtggtggggctagaaggagccatggagatggggcagatctacaccggcctgaagagtgcaggcaggaggctggcccagtgcgcctctgtcaccatcaggacaaacaagctgctgccaatgcaagtggatggagaaccctggatgcagccatgttgcacgattaaaattactcacaagaaccaagcgcccatgatgatggggcctccccagaagagcagcttcttctcgttgagaaggaagagccgttcaaaagactaaacagtgtgccaaacaccagctaaaccaagagagaaagcaagaaactataatgcacactcacacacaatttatgtgcacactcacacatgcacacacacacacacatacacactcttctctaaccagtggaagcaaagccacccttcgggaagaaaacgtcaccttgccatacattctgtttcaacagtgggtacacccctaacagagccagtgccaacaaaacattttgaatggacttagggcccatgaggttgtggctggcttaggcagcaacctccacattcccacaggccttgagcagaattttctgagactgaagggaaatccccctttctttctaccagccctgcaagtttcctcatggacgctcgcgaggagcaggctgcaggtttcctgcctatggtgagatcagatgtggccaagggaaggagctctggttccagagaatttgcacaaagttccctctgtacagagacaaaacggcctccggctctcagagcataatccttggcagggctcagcaggcgcacgttggtttcttggtcgtcctttgagtgacaacttctccgtgaacctgctgaagaggcagaaaggctgtggaaagctgtatttccattcttgggtttctgcgccgtcggtgggcacttgttattttccaggaaccttctcctggtgtctacatgtttgcttagaggcggctccaagagcccccagagctgcctgcatagcacaccttagatgtggtatttattttcttagttctgtgaacacctgggagggagagcggagaaactgggatttatttttcaaattggtgtcataatattgtgtaaaaagggaaggaaaaaaaaaaccacccccagcttctttctttttcaagccaaagcgtgtttcctgtttgagttccaagccctggtggcagactattcctgaaggcagaaaagatgggaaggaaggaactttgctggggaaaccaggagacggttccctcctgcttctttgcactcaccactcccagagtatgacctgaaggaccttctgatggtcttaacgtgtgtgcgcgcgtgtgtgtgtgtgtgtgcgtgtatatatatatatttagcctatatatttatatatatatatatataaatatttatttactgatggacttttcctcattggaaaaaaaaaacataggtagtatgagacagaaagtggtaaggaaaaagaaggttctcactcccccactccaccgtttcattgtcaggacgcatctccctgtggtgatcacaagggttaaggggaatgaaagtagctccctattatgaacgaagagaccgagaactcctattctggatcctcaaaacaagcatgaaagacctgctgggctggatttactctcccatttgtcagataagaaaattgagtctcagaaaagttcagagacttttccatggtgtcttggctaatgcagcttgagagtaggtgccgttacaaagatatttaatggagaaaagaacccacacatctcagagtagggtcatttctggtcactgaaaagtgagtccacttggatccaggttgccagggaggaacaaacgtacagcacatgcgtggatgggatatccccacacaagaaaacgagcgcctcatgctgcttcccagaggttctctctgacctgaatggaaaagaagttggtctgagatcgaaggtactaaacagatcatcagactgaactctccacatgtcacctcatcatggtcatcatagtctcttagtttggaaacaaccttggctgcagggatgacctcagtggagagtcacaagaaggactgaggcgtcttctgcaagatactgccagccaggacagaggggtctcagcagagctcagtgggcttcattcagcaagtgccagcattaccatcctttcccaagggcaaggccatgcagagcttcattgggcctccatccctctctgagatttatcagtggaaacttggacccacttgatatcgttccactgagctgcctctaatcttgcattggacaggagctttggacaaagaagggaatattaagattgtgtgtacaaatggcacttaactgtgaaggaccacctaggagcaagatcttggaccattctgctcaacctaacagtgcagaatgctaagtaaggggaaaaccaggccacctgaagaatatctttaatgatggtattcttggtgatgggaccaacaagctccagaattactacaggtactatcttggaagccacttgtttctgaaactgaggcaggttcaggtttggggtcactgattctaagacatttacagaagttcgtgcatgtgtttcagccatgatccccaagattgaggctattgagacatggcactatcaacaggtgaaattgattctcagagactcacaggtctcatgaaggggcagtgcagaaaatggcccttacctgctgcaccctagtgcacaggacttgcaatgttgcttgagagacatatcccaagtccttcttagaggcatggagtataacaacttcagtggaattgcacttccagtttggtaaccttagtaaatcttgtgttgttgtttaatcgtgccttgcaaatcatcctttaaacactatgactgtggtttcttgtggtggagtccctcatcatagtgaccctcatagcaacctctgaggttagcagagaaggtattattatctcgatctcaatgaggagaacaaggcttaatgaggtttagtgacttctcaaagccacatggttagtcaggggagaacctaatcccttatttcttatcttattctgattctggccatgctacaaacatgttctcacctgccccccatgcttctaccccaacagcaataaaaactgtaaagcaggaa

SEQ ID NO: 8257 - DNA, 3445 bp, Homo sapiens
ggagcgccccgggccaccgcgcaaccaagtgttgcctggtgaggaagagccaggacttctgaatttaccttgaatacagacaggaggatgttgcctaaggaatagcagagatcttgtctcatcttctgagaggtgcctgctgctgctgtatacacttgagtgctcccagaagtctcctgaaaggcttacatcgcaaacctgcaatgagccaggccctgggctgggcctccacttcagcctagtgaacaaaactccatcactgccctttagccactcacataaagtttaaaaatgggtgaagaacggtgggtctccctcactccagaagaatttgaccaactccagaaatattcagaatattcctccaagaagataaaagatgccttgactgaatttaatgagggtgggagcctcaaacaatatgacccacatgagccgattagctatgatgtcttcaagctgttcatgagggcgtacctggaggtggaccttccccagccactgagcactcacctcttcctggccttcagccagaagcccagacacgagacctctgaccacccgacggagggagccagcaacagtgaggccaacagcgcagatactaatatacagaatgcagataatgccaccaaagcagacgaggcctgtgcccctgatactgaatcaaatatggctgagaagcaagcaccagctgaagaccaagtggctgcgacccccctggaaccccccgtccctcggtcttcaagctcggaatccccagtggtatacctgaaggatgttgtgtgctacctgtccctgctggagacggggaggcctcaggataagctggagttcatgtttcgcctctatgattcagatgagaacggtctcctggaccaagcggagatggattgcattgtcaaccaaatgctgcatattgcccagtacctggagtgggatcccacagagctgaggcctatattgaaggagatgctgcaagggatggactacgaccgggacggctttgtgtctctacaggaatgggtccatggagggatgaccaccatcccattgctggtcctcctggggatggatgactctggctccaagggggatgggcggcacgcctggaccatgaagcacttcaagaaaccaacctactgcaacttctgccatatcatgctcatgggcgtccgcaagcaaggcctgtgctgcacttactgtaaatacactgtccacgaacgctgtgtgtccagaaacattcctggttgtgtcaaaacgtactcaaaagccaaaaggagtggtgaggtgatgcagcacgcatgggtggaagggaactcctccgtcaagtgtgaccggtgccacaaaagtatcaagtgctaccagagtgtcaccgcgcggcactgcgtgtggtgccggatgacgtttcaccgcaaatgtgaattatcaacgttgtgtgacggtggggaactcagagaccacatcttactgcccacctccatatgccccatcacccgggacaggccaggtgagaagtctgatggctgcgtgtccgccaagggcgaacttgtcatgcagtataagatcatccccaccccgggtacccaccccctgctggtcttggtgaaccccaagagtggagggagacaaggagaaaggttgaactttttccgtgatactccagacttccgtgttttggcctgtggtggagatgggacagttggctggattttggattgcattgataaggccaactttgcaaagcatccaccagtggctgtcctgcctcttggaacaggaaatgaccttgcccgttgtctccgctggggaggaggttatgaagggggcagcttgacaaaaatcctgaaagacattgagcagagccccttggtgatgctggaccgctggcatctggaagtcatccccagagaggaagtggaaaacggggaccaggtcccatacagcatcatgaacaactatttctccattggtgtggacgcttccattgcacacagattccatgtgatgagagagaaacatcctgaaaaattcaacagcaggatgaagaacaagctgtggtactttgaatttggcacctcggagacttttgcagcgacctgcaagaaactccacgaccacattgagttggagtgtgatggggttggggtggacctgagcaacatcttcctggaaggcattgccattctcaacattcccagcatgtacggaggcaccaatctctggggagaaaacaagaagaaccgggctgtgatccgggaaagcaggaagggtgtcactgaccccaaagaactgaaattctgcgttcaagacctcagtgaccagctccttgaagtggtggggctagaaggagccatggagatggggcagatctacaccggcctgaagagtgcaggcaggaggctggcccagtgcgcctctgtcaccatcaggacaaacaagctgctgccaatgcaagtggatggagaaccctggatgcagccatgttgcacgattaaaattactcacaagaaccaagcgcccatgatgatggggcctccccagaagagcagcttcttctcgttgagaaggaagagccgttcaaaagactaaacagtgtgccaaacaccagctaaaccaagagagaaagcaagaaactataatgcacactcacacacaatttatgtgcacactcacacatgcacacacacacacacatacacactcttctctaaccagtggaagcaaagccacccttcgggaagaaaacgtcaccttgccatacattctgtttcaacagtgggtacacccctaacagagccagtgccaacaaaacattttgaatggacttagggcccatgaggttgtggctggcttaggcagcaacctccacattcccacaggccttgagcagaattttctgagactgaagggaaatccccctttctttctaccagccctgcaagtttcctcatggacgctcgcgaggagcaggctgcaggtttcctgcctatggtgagatcagatgtggccaagggaaggagctctggttccagagaatttgcacaaagttccctctgtacagagacaaaacggcctccggctctcagagcataatccttggcagggctcagcaggcgcacgttggtttcttggtcgtcctttgagtgacaacttctccgtgaacctgctgaagaggcagaaaggctgtggaaagctgtatttccattcttgggtttctgcgccgtcggtgggcacttgttattttccaggaaccttctcctggtgtctacatgtttgcttagaggcggctccaagagcccccagagctgcctgcatagcacaccttagatgtggtatttattttcttagttctgtgaacacctgggagggagagcggagaaactgggatttatttttcaaattggtgtcataatattgtgtaaaaagggaaggaaaaaaaaaa

SEQ ID NO: 8258 - DNA, 3152 bp, Homo sapiens
ttgcctggtgaggaagagccaggacttctgaatttaccttgaatacagacaggaggatgttgcctaaggaatagcagagatcttgtctcatcttctgagaggtgcctgctgctgctgtatacacttgagtgctcccagaagtctcctgaaaggcttacatcgcaaacctgcaatgagccaggccctgggctgggcctccacttcagcctagtgaacaaaactccatcactgccctttagccactcacataaagtttaaaaatgggtgaagaacggtgggtctccctcactccagaagaatttgaccaactccagaaatattcagaatattcctccaagaagataaaagatgccttgactgaatttaatgagggtgggagcctcaaacaatatgacccacatgagccgattagctatgatgtcttcaagctgttcatgagggcgtacctggaggtggaccttccccagccactgagcactcacctcttcctggccttcagccagaagcccagacacgagacctctgaccacccgacggagggagccagcaacagtgaggccaacagcgcagatactaatatacagaatgcagataatgccaccaaagcagacgaggcctgtgcccctgatactgaatcaaatatggctgagaagcaagcaccagctgaagaccaagtggctgcgacccccctggaaccccccgtccctcggtcttcaagctcggaatccccagtggtatacctgaaggatgttgtgtgctacctgtccctgctggagacggggaggcctcaggataagctggagttcatgtttcgcctctatgattcagatgagaacggtctcctggaccaagcggagatggattgcattgtcaaccaaatgctgcatattgcccagtacctggagtgggatcccacagagctgaggcctatattgaaggagatgctgcaagggatggactacgaccgggacggctttgtgtctctacaggaatgggtccatggagggatgaccaccatcccattgctggtcctcctggggatggatgactctggctccaagggggatgggcggcacgcctggaccatgaagcacttcaagaaaccaacctactgcaacttctgccatatcatgctcatgggcgtccgcaagcaaggcctgtgctgcacttactgtaaatacactgtccacgaacgctgtgtgtccagaaacattcctggttgtgtcaaaacgtactcaaaagccaaaaggagtggtgagtttcaccgcaaatgtgaattatcaacgttgtgtgacggtggggaactcagagaccacatcttactgcccacctccatatgccccatcacccgggacaggccaggtgagaagtctgatggctgcgtgtccgccaagggcgaacttgtcatgcagtataagatcatccccaccccgggtacccaccccctgctggtcttggtgaaccccaagagtggagggagacaaggagaaagaattcttcggaaattccactatctgctcaaccccaaacaagttttcaacctggacaatggggggcctactccagggttgaactttttccgtgatactccagacttccgtgttttggcctgtggtggagatgggacagttggctggattttggattgcattgataaggccaactttgcaaagcatccaccagtggctgtcctgcctcttggaacaggaaatgaccttgcccgttgtctccgctggggaggaggttatgaagggggcagcttgacaaaaatcctgaaagacattgagcagagccccttggtgatgctggaccgctggcatctggaagtcatccccagagaggaagtggaaaacggggaccaggtcccatacagcatcatgaacaactatttctccattggtgtggacgcttccattgcacacagattccatgtgatgagagagaaacatcctgaaaaattcaacagcaggatgaagaacaagctgtggtactttgaatttggcacctcggagacttttgcagcgacctgcaagaaactccacgaccacattgagttggagtgtgatggggttggggtggacctgagcaacatcttcctggaaggcattgccattctcaacattcccagcatgtacggaggcaccaatctctggggagaaaacaagaagaaccgggctgtgatccgggaaagcaggaagggtgtcactgaccccaaagaactgaaattctgcgttcaagacctcagtgaccagctccttgaagtggtggggctagaaggagccatggagatggggcagatctacaccggcctgaagagtgcaggcaggaggctggcccagtgcgcctctgtcaccatcaggacaaacaagctgctgccaatgcaagtggatggagaaccctggatgcagccatgttgcacgattaaaattactcacaagaaccaagcgcccatgatgatggggcctccccagaagagcagcttcttctcgttgagaaggaagagccgttcaaaagactaaacagtgtgccaaacaccagctaaaccaagagagaaagcaagaaactataatgcacactcacacacaatttatgtgcacactcacacatgcacacacacacacacatacacactcttctctaaccagtggaagcaaagccacccttcgggaagaaaacgtcaccttgccatacattctgtttcaacagtgggtacacccctaacagagccagtgccaacaaaacattttgaatggacttagggcccatgaggttgtggctggcttaggcagcaacctccacattcccacaggccttgagcagaattttctgagactgaagggaaatccccctttctttctaccagccctgcaagtttcctcatggacgctcgcgaggagcaggctgcaggtttcctgcctatggtgagatcagatgtggccaagggaaggagctctggttccagagaatttgcacaaagttccctctgtacagagacaaaacggcctccggctctcagagcataatccttggcagggctcagcaggcgcacgttggtttcttggtcgtcctttgagtgacaacttctccgtgaacctgctgaagaggcagaaaggctgtggaaagctgtatttccattcttgggtttctgcgcc

SEQ ID NO: 8259 - DNA, 2343 bp, Homo sapiens
gcagtgccgtagtagcgggccacggagatagacagctttggagctgctgaactccgagcacagggtgaagaccccggcgctaccaaccacagcctggcagcctggtctccgcggcacccactggggctgcatccccctcccccgagagggctgcgcaggcgggaagacgcccagaggccagcttcggtcccccttctgtctctcggttcctctttcctcccaagtaagggaataaaccgcgaagaaggagcgccccgggccaccgcgcaaccaagtgttgcctggtgaggaagagccaggacttctgaatttaccttgaatacagacaggaggatgttgcctaaggaatagcagagatcttgtctcatcttctgagaggtgcctgctgctgctgtatacacttgagtgctcccagaagtctcctgaaaggcttacatcgcaaacctgcaatgagccaggccctgggctgggcctccacttcagcctagtgaacaaaactccatcactgccctttagccactcacataaagtttaaaaatgggtgaagaacggtgggtctccctcactccagaagaatttgaccaactccagaaatattcagaatattcctccaagaagataaaagatgccttgactgaatttaatgagggtgggagcctcaaacaatatgacccacatgagccgattagctatgatgtcttcaagctgttcatgagggcgtacctggaggtggaccttccccagccactgagcactcacctcttcctggccttcagccagaagcccagacacgagacctctgaccacccgacggagggagccagcaacagtgaggccaacagcgcagatactaatatacagaatgcagataatgccaccaaagcagacgaggcctgtgcccctgatactgaatcaaatatggctgagaagcaagcaccagctgaagaccaagtggctgcgacccccctggaaccccccgtccctcggtcttcaagctcggaatccccagtggtatacctgaaggatgttgtgtgctacctgtccctgctggagacggggaggcctcaggataagctggagttcatgtttcgcctctatgattcagatgagaacggtctcctggaccaagcggagatggattgcattgtcaaccaaatgctgcatattgcccagtacctggagtgggatcccacagagctgaggcctatattgaaggagatgctgcaagggatggactacgaccgggacggctttgtgtctctacaggaatgggtccatggagggatgaccaccatcccattgctggtcctcctggggatggatgactctggctccaagggggatgggcggcacgcctggaccatgaagcacttcaagaaaccaacctactgcaacttctgccatatcatgctcatgggcgtccgcaagcaaggcctgtgctgcacttactgtaaatacactgtccacgaacgctgtgtgtccagaaacattcctggttgtgtcaaaacgtactcaaaagccaaaaggagtggtgagtttcaccgcaaatgtgaattatcaacgttgtgtgacggtggggaactcagagaccacatcttactgcccacctccatatgccccatcacccgggacaggccaggtgagaagtctgatggctgcgtgtccgccaagggcgaacttgtcatgcagtataagatcatccccaccccgggtacccaccccctgctggtcttggtgaaccccaagagtggagggagacaaggagaaagaattcttcggaaattccactatctgctcaaccccaaacaagttttcaacctggacaatggggggcctactccagggttgaactttttccgtgatactccagacttccgtgttttggcctgtggtggagatgggacagttggctggattttggattgcattgataaggccaactttgcaaagcatccaccagtggctgtcctgcctcttggaacaggaaatgaccttgcccgttgtctccgctggggaggaggttatgaagggggcagcttgacaaaaatcctgaaagacattgagcagagccccttggtgatgctggaccgctggcatctggaagtcatccccagagaggaagtggaaaacggggaccaggtcccatacagcatcatgaacaactatttctccattggtgtggacgcttccattgcacacagattccatgtgatgagagagaaacatcctgaaaaattcaacagcaggatgaagaacaagctgtggtactttgaatttggcacctcggagacttttgcagcgacctgcaagaaactccacgaccacattgagttggagtggtgt

SEQ ID NO: 8260 - DNA, 3211 bp, Homo sapiens
agtgccgtagtagcgggccacggagatagacagctttggagctgctgaactccgagcacagggtgaagaccccggcgctaccaaccacagcctggcagcctggtctccgcggcacccactggggctgcatccccctcccccgagagggctgcgcaggcgggaagacgcccagaggccagcttcggtcccccttctgtctctcggttcctctttcctcccaagtaagggaataaaccgcgaagaaggagcgccccgggccaccgcgcaaccaagtgttgcctggtgaggaagagccaggacttctgaatttaccttgaatacagacaggaggatgttgcctaaggaatagcagagatcttgtctcatcttctgagaggtgcctgctgctgctgtatacacttgagtgctcccagaagtctcctgaaaggcttacatcgcaaacctgcaatgagccaggccctgggctgggcctccacttcagcctagtgaacaaaactccatcactgccctttagccactcacataaagtttaaaaatgggtgaagaacggtgggtctccctcactccagaagaatttgaccaactccagaaatattcagaatattcctccaagaagataaaagatgccttgactgaatttaatgagggtgggagcctcaaacaatatgacccacatgagccgattagctatgatgtcttcaagctgttcatgagggcgtacctggaggtggaccttccccagccactgagcactcacctcttcctggccttcagccagaagcccagacacgagacctctgaccacccgacggagggagccagcaacagtgaggccaacagcgcagatactaatatacagaatgcagataatgccaccaaagcagacgaggcctgtgcccctgatactgaatcaaatatggctgagaagcaagcaccagctgaagaccaagtggctgcgacccccctggaaccccccgtccctcggtcttcaagctcggaatccccagtggtatacctgaaggatgttgtgtgctacctgtccctgctggagacggggaggcctcaggataagctggagttcatgtttcgcctctatgattcagatgagaacggtctcctggaccaagcggagatggattgcattgtcaaccaaatgctgcatattgcccagtacctggagtgggatcccacagagctgaggcctatattgaaggagatgctgcaagggatggactacgaccgggacggctttgtgtctctacaggaatgggtccatggagggatgaccaccatcccattgctggtcctcctggggatggatgactctggctccaagggggatgggcggcacgcctggaccatgaagcacttcaagaaaccaacctactgcaacttctgccatatcatgctcatgggcgtccgcaagcaaggcctgtgctgcacttactgtaaatacactgtccacgaacgctgtgtgtccagaaacattcctggttgtgtcaaaacgtactcaaaagccaaaaggagtggtgagtttcaccgcaaatgtgaattatcaacgttgtgtgacggtggggaactcagagaccacatcttactgcccacctccatatgccccatcacccggtataagatcatccccaccccgggtacccaccccctgctggtcttggtgaaccccaagagtggagggagacaaggagaaagaattcttcggaaattccactatctgctcaaccccaaacaagttttcaacctggacaatggggggcctactccagggttgaactttttccgtgatactccagacttccgtgttttggcctgtggtggagatgggacagttggctggattttggattgcattgataaggccaactttgcaaagcatccaccagtggctgtcctgcctcttggaacaggaaatgaccttgcccgttgtctccgctggggaggaggttatgaagggggcagcttgacaaaaatcctgaaagacattgagcagagccccttggtgatgctggaccgctggcatctggaagtcatccccagagaggaagtggaaaacggggaccaggtcccatacagcatcatgaacaactatttctccattggtgtggacgcttccattgcacacagattccatgtgatgagagagaaacatcctgaaaaattcaacagcaggatgaagaacaagctgtggtactttgaatttggcacctcggagacttttgcagcgacctgcaagaaactccacgaccacattgagttggagtgtgatggggttggggtggacctgagcaacatcttcctggaaggcattgccattctcaacattcccagcatgtacggaggcaccaatctctggggagaaaacaagaagaaccgggctgtgatccgggaaagcaggaagggtgtcactgaccccaaagaactgaaattctgcgttcaagacctcagtgaccagctccttgaagtggtggggctagaaggagccatggagatggggcagatctacaccggcctgaagagtgcaggcaggaggctggcccagtgcgcctctgtcaccatcaggacaaacaagctgctgccaatgcaagtggatggagaaccctggatgcagccatgttgcacgattaaaattactcacaagaaccaagcgcccatgatgatggggcctccccagaagagcagcttcttctcgttgagaaggaagagccgttcaaaagactaaacagtgtgccaaacaccagctaaaccaagagagaaagcaagaaactataatgcacactcacacacaatttatgtgcacactcacacatgcacacacacacacacatacacactcttctctaaccagtggaagcaaagccacccttcgggaagaaaacgtcaccttgccatacattctgtttcaacagtgggtacacccctaacagagccagtgccaacaaaacattttgaatggacttagggcccatgaggttgtggctggcttaggcagcaacctccacattcccacaggccttgagcagaattttctgagactgaagggaaatccccctttctttctaccagccctgcaagtttcctcatggacgctcgcgaggagcaggctgcaggtttcctgcctatggtgagatcagatgtggccaagggaaggagctctggttccagagaatttgcacaaagttccctctgtacagagaca

SEQ ID NO: 8261 - DNA, 4124 bp, Homo sapiens
gggtcgcagcctgtcctcctctctctccccctccgccgcagcccgtcgcctccgggcagagttcatgttcagcttgggctttcgctcgggatttaggaagaggccggcggggctggagggtgcgggccggcgcgggagggcgcgggaggcggggagcggcggcctctgattggccggggcgggggagtgagcggagtttcccacaatgccccggtgcggtgcagccgcggatggatgctgcgggaaggggctgccatttgctgcccctgccagcggcgcgcggacctgcccgcgctcctgcagccgccgccgccgccgccgccagcccgcccggcccctgcagcggcgccgcctgcgctccctccgcggccgccggagcgggcgccatgaaccccagctcctcggcgggagaggagaaaggggcgacgggcggcagcagcagcagcggaagcggcgccgggagctgctgcctgggcgccgagggcggcgcggacccgcggggcgcagggtcagccgcggcggcgggggccgctgccctggacgagcccgcggccgccggccagaaggagaaggacgaagcgctggaggagaagctgaggaacttaactttccggaagcaggtctcgtacaggaaagcaatctcccgggcaggcctccagcatctggctcctgcacatcccctcagccttcctgtggcaaatggtccagccaaggagcccagagcgactttggactggagtgagaatgccgtgaatggagaacacctgtggctggagaccaacgtctcgggagacctctgctaccttggagaggagaactgccaagtcagatttgcaaaatcagctctcaggaggaagtgtgcagtctgtaaaatcgtcgtccacaccgcctgcattgagcagctagaaaagattaatttcagatgtaaaccaacatttcgagaaggaggctcaaggtcaccaagagaaaattttgtacgtcatcactgggtgcacaggcgtcggcaggaggggaaatgtaagcagtgtggtaagggcttccagcaaaagttctccttccacagtaaagagattgtggctatcagctgttcctggtgcaagcaggcgtttcacaataaggtgacctgcttcatgctgcatcacattgaagaaccctgctccctgggggctcatgctgctgttattgtcccgcccacttggatcattaaggtgaagaaacctcagaactccctgaaggcttcaaatcggaagaagaagagaacaagctttaaaagaaaagccagtaaaagagggatggaacaggaaaacaaaggtcgtccttttgtgataaaacccatctcttctcctctcatgaaacccttgcttgtatttgtgaatcccaagagtggaggcaaccagggaaccaaagtcctgcagatgttcatgtggtacctgaatccacggcaagtctttgatctttctcaggaagggccaaaagatgcgcttgaattgtataggaaagtaccaaatctgcgaattctggcctgtggtggggatggaacggtgggctggatcctttccatcctggatgaactgcagctgagccctcagcctcctgtgggggtccttcctctggggactgggaatgacctggctcgaactctcaactggggagggggctacactgatgaacctgtttctaagatcctgtgtcaagtggaagatgggacagttgtacagctagatcgctggaacctccatgtggaaagaaaccccgacttgcctccagaagaacttgaagatggcgtatgtaagctccctctgaatgttttcaataactacttcagccttggatttgatgcccatgtcacactggagttccatgaatccagagaagcaaatccagagaaattcaacagtcgttttcgaaataaaatgttctatgcaggggcagctttttctgacttcctacagagaagttctagagatctatccaaacatgttaaagttgtttgtgatggaacagatctcaccccaaagattcaggaactgaagttccagtgtatagtatttttaaatatacccagatattgtgctggcacaatgccctggggaaacccaggtgatcaccatgatttcgaacctcagcgtcatgatgatggttatattgaagtcattggatttaccatggcctctttggcagccctgcaagttgggggccatggagagaggctacaccagtgtcgagaagtcatgcttctaacttacaaatccatccccatgcaagtggatggggagccctgtaggttggccccagctatgattcggatctccctgaggaatcaggccaacatggtacagaagagcaagaggagaacatccatgcctttactcaatgatccccagtctgtcccagatcgtctgaggatccgggtgaacaaaatcagtttacaagactatgaaggattccactatgacaaggagaaactccgagaagcttctatttcagactggttaagaaccattgctggggaactagtgcagtcatttggagcgatacctctgggtattctagttgtgcgtggagactgtgatttggagacttgccgtatgtacatagaccgcctacaggaggacctacagtcagtttcttctggctcccagagagttcattaccaggaccatgaaacctccttccccagggctctctcagcacagaggctctctcctcggtggtgcttcctagatgacagatctcaggaacatttgcactttgtgatggagatttcccaagatgagatttttattctggacccagatatggtggtgtcacagccggcggggacacctccgggcatgcctgacctggtggtggaacaagcctcggggatctcagactggtggaatcctgccctgcggaaacgcatgctgagtgacagtgggctggggatgatagctccctattatgaggactcagatctgaaagatctcagccactcccgcgtgctacagtcaccagtctcttcagaagatcatgcaattttgcaggcagtaatagctggtgatcttatgaagctaatagaaagctataaaaatggaggcagtctgctaattcagggaccagaccactgttcactccttcactacgcagctaaaaccggcaacggggagattgtgaaatatatccttgaccacggaccttccgagttattggatatggcagacagtgaaacgggtgagactgcactgcacaaggctgcctgccagcggaaccgggctgtgtgccagcttctggtggatgcaggagcatctctgagaaagacggactccaagggtaagacacctcaagaaagagcacagcaggctggggacccagacttggctgcttacctagaaagccgtcagaactataaggtcattggccatgaggacctggaaactgctgtttgaccctggtattcgggcaaagaggacatgagcaagcgtatcacatctgccctccctgcaattgggcagctcccctggaagaagctgatggaattcatatatctgtctctctcctgcaagaatctacctgagaccatgccactagcttttaagggctaccaagatgtacaacagaacatgatagcccattgagaaggaggcaggatacctggagatttgtggaatacagtacgagttccacaaaatttgatccttattgcttccagcaagtagcatgaacttctgtgttcacctgtataatttattttaaagattcaaaggatgttcgtataaatggcactgctccatcctccccctatgcattggtttttttccctgtaccatacaattctactgtaactacccatcaacttaaagaaaaatattatctcttctctttacattcagtcttggaagaccacaagattgtctgaaggccttctaaaaccttctgaatgtcctgcagaaatataactgtaaaaccacttccatttctaagactaaatatatcaagactatttagtgactctctctgcatgtccccctcacccgccaaccctccgtttcattatataggagctgggaagtgccacatggataatgtcaacttgtgtgctatatctctgaggaatggtgaggtggcatgggagatgtctgtgc

SEQ ID NO: 8262 - DNA, 4133 bp, Homo sapiens
gggtcgcagcctgtcctcctctctctccccctccgccgcagcccgtcgcctccgggcagagttcatgttcagcttgggctttcgctcgggatttaggaagaggccggcggggctggagggtgcgggccggcgcgggagggcgcgggaggcggggagcggcggcctctgattggccggggcgggggagtgagcggagtttcccacaatgccccggtgcggtgcagccgcggatggatgctgcgggaaggggctgccatttgctgcccctgccagcggcgcgcggacctgcccgcgctcctgcagccgccgccgccgccgccgccagcccgcccggcccctgcagcggcgccgcctgcgctccctccgcggccgccggagcgggcgccatgaaccccagctcctcggcgggagaggagaaaggggcgacgggcggcagcagcagcagcggaagcggcgccgggagctgctgcctgggcgccgagggcggcgcggacccgcggggcgcagggtcagccgcggcggcgggggccgctgccctggacgagcccgcggccgccggccagaaggagaaggacgaagcgctggaggagaagctgaggaacttaactttccggaagcaggtctcgtacaggaaagcaatctcccgggcaggcctccagcatctggctcctgcacatcccctcagccttcctgtggcaaatggtccagccaaggagcccagagcgactttggactggagtgagaatgccgtgaatggagaacacctgtggctggagaccaacgtctcgggagacctctgctaccttggagaggagaactgccaagtcagatttgcaaaatcagctctcaggaggaagtgtgcagtctgtaaaatcgtcgtccacaccgcctgcattgagcagctagaaaagattaatttcagatgtaaaccaacatttcgagaaggaggctcaaggtcaccaagagaaaattttgtacgtcatcactgggtgcacaggcgtcggcaggaggggaaatgtaagcagtgtggtaagggcttccagcaaaagttctccttccacagtaaagagattgtggctatcagctgttcctggtgcaagcaggcgtttcacaataaggtgacctgcttcatgctgcatcacattgaagaaccctgctccctgggggctcatgctgctgttattgtcccgcccacttggatcattaaggtgaagaaacctcagaactccctgaaggcttcaaatcggaagaagaagagaacaagctttaaaagaaaagccagtaaaagagggatggaacaggaaaacaaaggtcgtccttttgtgataaaacccatctcttctcctctcatgaaacccttgcttgtatttgtgaatcccaagagtggaggcaaccagggaaccaaagtcctgcagatgttcatgtggtacctgaatccacggcaagtctttgatctttctcaggaagggccaaaagatgcgcttgaattgtataggaaagtaccaaatctgcgaattctggcctgtggtggggatggaacggtgggctggatcctttccatcctggatgaactgcagctgagccctcagcctcctgtgggggtccttcctctggggactgggaatgacctggctcgaactctcaactggggagggggctacactgatgaacctgtttctaagatcctgtgtcaagtggaagatgggacagttgtacagctagatcgctggaacctccatgtggaaagaaaccccgacttgcctccagaagaacttgaagatggcgtatgtaagctccctctgaatgttttcaataactacttcagccttggatttgatgcccatgtcacactggagttccatgaatccagagaagcaaatccagagaaattcaacagtcgttttcgaaataaaatgttctatgcaggggcagctttttctgacttcctacagagaagttctagagatctatccaaacatgttaaagttgtttgtgatggaacagatctcaccccaaagattcaggaactgaagttccagtgtatagtatttttaaatatacccagatattgtgctggcacaatgccctggggaaacccaggtgatcaccatgatttcgaacctcagcgtcatgatgatggttatattgaagtcattggatttaccatggcctctttggcagccctgcaagttgggggccatggagagaggctacaccagtgtcgagaagtcatgcttctaacttacaaatccatccccatgcaagtggatggggagccctgtaggttggccccagctatgattcggatctccctgaggaatcaggccaacatggtacagaagagcaagaggagaacatccatgcctttactcaatgatattcatcaggtgcaaactgcggacctgcggcgagtgtctgctccccccggctccttcaccattccccagtctgtcccagatcgtctgaggatccgggtgaacaaaatcagtttacaagactatgaaggattccactatgacaaggagaaactccgagaagcttcgatacctctgggtattctagttgtgcgtggagactgtgatttggagacttgccgtatgtacatagaccgcctacaggaggacctacagtcagtttcttctggctcccagagagttcattaccaggaccatgaaacctccttccccagggctctctcagcacagaggctctctcctcggtggtgcttcctagatgacagatctcaggaacatttgcactttgtgatggagatttcccaagatgagatttttattctggacccagatatggtggtgtcacagccggcggggacacctccgggcatgcctgacctggtggtggaacaagcctcggggatctcagactggtggaatcctgccctgcggaaacgcatgctgagtgacagtgggctggggatgatagctccctattatgaggactcagatctgaaagatctcagccactcccgcgtgctacagtcaccagtctcttcagaagatcatgcaattttgcaggcagtaatagctggtgatcttatgaagctaatagaaagctataaaaatggaggcagtctgctaattcagggaccagaccactgttcactccttcactacgcagctaaaaccggcaacggggagattgtgaaatatatccttgaccacggaccttccgagttattggatatggcagacagtgaaacgggtgagactgcactgcacaaggctgcctgccagcggaaccgggctgtgtgccagcttctggtggatgcaggagcatctctgagaaagacggactccaagggtaagacacctcaagaaagagcacagcaggctggggacccagacttggctgcttacctagaaagccgtcagaactataaggtcattggccatgaggacctggaaactgctgtttgaccctggtattcgggcaaagaggacatgagcaagcgtatcacatctgccctccctgcaattgggcagctcccctggaagaagctgatggaattcatatatctgtctctctcctgcaagaatctacctgagaccatgccactagcttttaagggctaccaagatgtacaacagaacatgatagcccattgagaaggaggcaggatacctggagatttgtggaatacagtacgagttccacaaaatttgatccttattgcttccagcaagtagcatgaacttctgtgttcacctgtataatttattttaaagattcaaaggatgttcgtataaatggcactgctccatcctccccctatgcattggtttttttccctgtaccatacaattctactgtaactacccatcaacttaaagaaaaatattatctcttctctttacattcagtcttggaagaccacaagattgtctgaaggccttctaaaaccttctgaatgtcctgcagaaatataactgtaaaaccacttccatttctaagactaaatatatcaagactatttagtgactctctctgcatgtccccctcacccgccaaccctccgtttcattatataggagctgggaagtgccacatggataatgtcaacttgtgtgctatatctctgaggaatggtgaggtggcatgggagatgtctgtgc

SEQ ID NO: 8263 - DNA, 4687 bp, Homo sapiens
gatggatgctgcgggaaggggctgccatttgctgcccctgccagcggcgcgcggacctgcccgcgctcctgcagccgccgccgccgccgccgccagcccgcccggcccctgcagcggcgccgcctgcgctccctccgcggccgccggagcgggcgccatgaaccccagctcctcggcgggagaggagaaaggggcgacgggcggcagcagcagcagcggaagcggcgccgggagctgctgcctgggcgccgagggcggcgcggacccgcggggcgcagggtcagccgcggcggcgggggccgctgccctggacgagcccgcggccgccggccagaaggagaaggacgaagcgctggaggagaagctgaggaacttaactttccggaagcaggtctcgtacaggaaagcaatctcccgggcaggcctccagcatctggctcctgcacatcccctcagccttcctgtggcaaatggtccagccaaggagcccagagcgactttggactggagtgagaatgccgtgaatggagaacacctgtggctggagaccaacgtctcgggagacctctgctaccttggagaggagaactgccaagtcagatttgcaaaatcagctctcaggaggaagtgtgcagtctgtaaaatcgtcgtccacaccgcctgcattgagcagctagaaaagattaatttcagatgtaaaccaacatttcgagaaggaggctcaaggtcaccaagagaaaattttgtacgtcatcactgggtgcacaggcgtcggcaggaggggaaatgtaagcagtgtggtaagggcttccagcaaaagttctccttccacagtaaagagattgtggctatcagctgttcctggtgcaagcaggcgtttcacaataaggtgacctgcttcatgctgcatcacattgaagaaccctgctccctgggggctcatgctgctgttattgtcccgcccacttggatcattaaggtgaagaaacctcagaactccctgaaggcttcaaatcggaagaagaagagaacaagctttaaaagaaaagccagtaaaagagggatggaacaggaaaacaaaggtcgtccttttgtgataaaacccatctcttctcctctcatgaaacccttgcttgtatttgtgaatcccaagagtggaggcaaccagggaaccaaagtcctgcagatgttcatgtggtacctgaatccacggcaagtctttgatctttctcaggaagggccaaaagatgcgcttgaattgtataggaaagtaccaaatctgcgaattctggcctgtggtggggatggaacggtgggctggatcctttccatcctggatgaactgcagctgagccctcagcctcctgtgggggtccttcctctggggactgggaatgacctggctcgaactctcaactggggagggggctacactgatgaacctgtttctaagatcctgtgtcaagtggaagatgggacagttgtacagctagatcgctggaacctccatgtggaaagaaaccccgacttgcctccagaagaacttgaagatggcgtatgtaagctccctctgaatgttttcaataactacttcagccttggatttgatgcccatgtcacactggagttccatgaatccagagaagcaaatccagagaaattcaacagtcgttttcgaaataaaatgttctatgcaggggcagctttttctgacttcctacagagaagttctagagatctatccaaacatgttaaagttgtttgtgatggaacagatctcaccccaaagattcaggaactgaagttccagtgtatagtatttttaaatatacccagatattgtgctggcacaatgccctggggaaacccaggtgatcaccatgatttcgaacctcagcgtcatgatgatggttatattgaagtcattggatttaccatggcctctttggcagccctgcaagttgggggccatggagagaggctacaccagtgtcgagaagtcatgcttctaacttacaaatccatccccatgcaagtggatggggagccctgtaggttggccccagctatgattcggatctccctgaggaatcaggccaacatggtacagaagagcaagaggagaacatccatgcctttactcaatgatccccagtctgtcccagatcgtctgaggatccgggtgaacaaaatcagtttacaagactatgaaggattccactatgacaaggagaaactccgagaagcttctatttcagactggttaagaaccattgctggggaactagtgcagtcatttggagcgatacctctgggtattctagttgtgcgtggagactgtgatttggagacttgccgtatgtacatagaccgcctacaggaggacctacagtcagtttcttctggctcccagagagttcattaccaggaccatgaaacctccttccccagggctctctcagcacagaggctctctcctcggtggtgcttcctagatgcaacttctgctgatcgcttttatcgaatagacagatctcaggaacatttgcactttgtgatggagatttcccaagatgagatttttattctggacccagatatggtggtgtcacagccggcggggacacctccgggcatgcctgacctggtggtggaacaagcctcggggtcaccagtctcttcagaagatcatgcaattttgcaggcagtaatagctggtgatcttatgaagctaatagaaagctataaaaatggaggcagtctgctaattcagggaccagaccactgttcactccttcactacgcagctaaaaccggcaacggggagattgtgaaatatatccttgaccacggaccttccgagttattggatatggcagacagtgaaacgggtgagactgcactgcacaaggctgcctgccagcggaaccgggctgtgtgccagcttctggtggatgcaggagcatctctgagaaagacggactccaagggtaagacacctcaagaaagagcacagcaggctggggacccagacttggctgcttacctagaaagccgtcagaactataaggtcattggccatgaggacctggaaactgctgtttgaccctggtattcgggcaaagaggacatgagcaagcgtatcacatctgccctccctgcaattgggcagctcccctggaagaagctgatggaattcatatatctgtctctctcctgcaagaatctacctgagaccatgccactagcttttaagggctaccaagatgtacaacagaacatgatagcccattgagaaggaggcaggatacctggagatttgtggaatacagtacgagttccacaaaatttgatccttattgcttccagcaagtagcatgaacttctgtgttcacctgtataatttattttaaagattcaaaggatgttcgtataaatggcactgctccatcctccccctatgcattggtttttttccctgtaccatacaattctactgtaactacccatcaacttaaagaaaaatattatctcttctctttacattcagtcttggaagaccacaagattgtctgaaggccttctaaaaccttctgaatgtcctgcagaaatataactgtaaaaccacttccatttctaagactaaatatatcaagactatttagtgactctctctgcatgtccccctcacccgccaaccctccgtttcattatataggagctgggaagtgccacatggataatgtcaacttgtgtgctatatctctgaggaatggtgaggtggcatgggagatgtctgtgcttggaggtacctcagagaggtaacccaggggtcagcccaggctgctgggctgtagccaatagccatgcaggactggttcagcttgggctgtctgtacagctccgtactgcctatgtgtagccatctttgccttttgctgcaatagaagatgagcaaaggattaaacagaggcccacagctagtttgcagaaccactcaattttaagtgctgtttaaattgcagagcaaataatcctgtgtgggaactgtggttacaggaaatggagcactctaacaatgtttacttctaaactttgttgaatgataatagaaagcaccctaattgacttggaaaaaaaaaacagcaaaagcaaaagtagcaacatatgtcaacatatgtcactgaaataggaaacagtcattggaatgttgcacagaggctaataactatagactgttggatacagtggtgagaggagccccattttaggtctttcttttaggtttttggttttcattactccaagtaatccttgacccaagaacaaaggcttgttgtatgagttccactgccagatttatgggatgcctggatcattcagaaggatgcttcaactattatttgtcaggtccaaaggtcgtacttaataaccccattttctatgtatggggtagtctaatatattattttatctactttatttttcccttttcagaaagtccttagtgcaaaccaccattggaatctagccagaaatgtctgtcagatagttagaattgtaacatctaaacctgccacggatcgaatggtacttacaggtacctctcttagggactctgtgatccctaaaatatcagaagaaaatgtctgtctttctgtccaaatatctacttgacttgggggta

SEQ ID NO: 8264 - DNA, 4636 bp, Homo sapiens
gtaccgggccgtggagcggcggctcctgtacccccggcgcggacctaaaggggctcgggccgctcgggccgggaatggcggcggcggccgagcccggggcccgcgcctggctgggcggcggctccccgcgccccggcagcccggcctgcagccccgtgctgggctcaggaggccgcgcgcgcccggggccggggccggggccgggacccgagcgggcgggcgtcagagccccgggccccgctgccgcgccgggacacagcttccggaaggtgacgctcaccaagcccaccttctgccacctctgctccgacttcatctgggggctggccggcttcctgtgcgacgtctgcaatttcatgtctcatgagaagtgcctgaagcacgtgaggatcccgtgcacgagtgtggcacccagcctggtccgggttcctgtagcccactgcttcggcccccgggggctccacaagcgcaagttctgtgctgtctgccgcaaggtcctggaggcaccggcgctccactgcgaagtgtgtgagctgcacctccacccagactgtgtgcccttcgcctgcagtgactgccgccagtgccaccaggatgggcaccaggatcacgacacccatcaccaccactggcgggaggggaacctgccctcgggagcgcgctgcgaggtctgcaggaagacgtgcggctcctctgacgtgctggccggcgtgcgctgcgagtggtgcggggtccaggcgcactccctctgctccgcggcgctggctcccgagtgtggcttcgggcgtctgcgctccctggtcctgcctcccgcgtgcgtgcgccttctgcccggcggcttcagcaagacgcagagcttccgcatcgtggaggccgcggagccgggcgaggggggcgacggcgccgacgggagcgctgccgtgggtccaggcagagagacacaggcaactccggagtccgggaagcaaacgctgaagatctttgatggcgacgacgcggtgagaagaagccagttccgcctcgtcacggtgtcccgcctggccggtgccgaggaggtgctggaggccgcactgcgggcccaccacatccccgaggaccctggccacctggagctgtgccggctgcccccttcctctcaggcctgtgacgcctgggctgggggcaaggctgggagtgctgtgatctcggaggagggcagaagccccgggtccggcgaggccacgccagaggcctgggtcatccgggctctgccgcgggcccaggaggtcctgaagatctaccctggctggctcaaggtgggcgtggcctacgtgtccgtgcgagtgaccccgaagagcacggcccgctctgtggtgctggaggtcctgccgctgctcggccgccaggccgagagtcccgagagcttccagctggtggaggtggcgatgggctgcaggcacgtccagcggacgatgctgatggacgaacagcccctgctggaccggctacaggacatccggcagatgtctgtgcggcaggtgagccagacgcggttctacgtggcagagagcagggatgtagccccgcacgtctccctgtttgttggcggcctgcctcccggcctgtctcccgaggagtacagcagcctgctgcatgaggccggggctaccaaagccaccgtggtgtccgtgagtcacatctactcctcccaaggcgcggtagtgttggacgttgcctgctttgcggaggccgagcggctgtacatgctgctgaaggacatggctgtgcggggccggctgctcactgccctggtgctccccgacctgctgcacgcgaagctgcccccagacagctgtcccctccttgtgttcgtgaaccccaagagtggaggcctcaagggccgagacctgctctgcagcttccggaagctactgaaccctcatcaggtcttcgacctgaccaacggaggtcctcttcccgggctccacctgttctcccaggtgccctgcttccgggtgctggtgtgtggtggcgatggcactgtgggctgggtgcttggcgccctggaggagacacggtaccgactggcctgcccggagccttctgtggccatcctgcccctgggcacagggaatgaccttggtcgagtcctccgctggggggcgggctacagcggcgaggacccgttctccgtactgctgtctgtggacgaggccgacgccgtgctcatggaccgctggaccatcctgctggatgcccacgaggctggcagtgcagagaacgacacggcagacgcagagccccccaagatcgtgcagatgagtaactactgtggcattggcatcgacgcggagctgagcctggacttccaccaggcacgggaagaggagcctggcaagttcacaagcaggctgcacaacaagggtgtgtacgtgcgggtggggctgcagaagatcagtcactctcggagcctgcacaagcagatccggctgcaggtggagcggcaggaggtggagctgcccagtattgaaggcctcatcttcatcaacatccccagctggggctcgggggccgacctgtggggctccgacagcgacaccaggtttgagaagccacgcatggacgacgggctgctggaggttgtgggcgtgacgggcgtcgtgcacatgggccaggtccagggtgggctgcgctccggaatccggattgcccagggttcctacttccgagtcacgctcctcaaggccaccccggtgcaggtggacggggagccctgggtccaggccccggggcacatgatcatctcagctgctggccctaaggtgcacatgctgaggaaggccaagcagaagccgaggagggccgggaccaccagggatgcccgggcggatgctgcgcctgcccctgagagcgatcctaggtaggggtggctggggcagcccaagggctcgagccatctctgctcccgccagccttgttttcaggtggtctggaggcagctccacgtccacacagtggccggccctgtggtcggacctggctacagccctgaccacagcatcttcccagtgacggagcgggacccgccctcatcccattggtgacacatgttggtgtcacagccctcatcccactggagactggtgtgcgggtggcagtgttaccccgtgtcccgggtgggcgcagggctctggatggtgagccctctgccctgtgggggcctggtcctctcctcaggggtgggcacccatccctctccccactgagccccttgagctggacagtgctggatgcaggccgtccaggtgggtctgatctcactttgtgcccctcgggccgtccccctggccagtccttaagagcagcaggctccctggtgtgtccctgccccagcagacacaggctgccagtccctccagcctcacctccccgccctgggcagcaggtgtgggcagcgtgtgaggctgccgggtggtggtgactggtgacttccttgtgttcagggaagggagaaggtgccttcccttgttttctggccttgttatatacagatggcagcttggatctcaggtacagctccaggggcaggcagtgcccagctggacctggtggccctttcctagtgcctctgcttggggaggagaacctctgtccacgtggaggctaggaggtctcaggtgctgccctggcagcaccagagtgtgggccgggcccgagtgtctgcccctcggccctcagggtggggcacttagcacccagaagggaccaaaagcagggcatggcggtgcagaggagtttgggaggtgtaaacagcccatgcacgtggaggaggagctggctttcagccccagaccccacgctagcactttccacgctgcttgcccgctgttgatgtgcagttcccagtgcctgtgtgagccgacatctgctcagtcctatccctcgtcagcgtgtggagacccagctcctgcagccctcctgctcccacgcccccagacagcttggtggagggtcctgcatctgggccaggctggggtgcacccagccaaagacaaagctgcctccacgtgcccaaggattcagatggtgcactggccccgggaggagtctgaccaaaaatggagcccgctctgtggggaagccccgactcccccacgagaaacggtcccacggtgcggatctcccccttcccttgtggggcacagctggcctgggcctccaatcctgcggagctttcctgggtgtggctttgacctcagaagtggctctggtttggcctcaggagtgtggcctggcccagcctgctgcagcctcctggggggcccttgatgccactaatcccccgaccccccgcatctgccaaactgcacagacacacgcattgtaaggccgcttgtggcctccagcgtgcactcttgtttacgtcattgtcatcttcaagaccagtcctttgtgattagttttgcttcgcgagccctggtgtggactgtggtctgtatgaatcgtgtgtaactgtggtgaggggcttgtcctgtatgtgagtctgtacccaggtggggtctgtgccctgcacaccgggcccctctgtatttatcgctgcctgaatgcaacagtaatttatatccaggacaaatacagtctgggcgtcactatccta

SEQ ID NO: 8265 - DNA, 2044 bp, Homo sapiens
ataatttggtggcggcgtccggagggtgctggtttgttctcggtgaacggcgcgcggggtctctcctgagtgcgagctacgggaccttcgccatgccggggatggtactcttcggccggcgctgggccatcgccagcgacgacttggtcttcccagggttcttcgagctggtcgtgcgagtgctgtggtggattggcattctgacgttgtatctcatgcacagaggaaagctggactgtgctggtggagccttgctcagcagttacttgatcgtcctcatgattctcctggcagttgtcatatgtactgtgtcagccatcatgtgtgtcagcatgagaggaacgatttgtaaccctggaccgcggaagtctatgtctaagctgctttacatccgcctggcgctgttttttccagagatggtctgggcctctctgggggctgcctgggtggcagatggtgttcagtgcgacaggacagttgtaaacggcatcatcgcaaccgtcgtggtcaggacacagatctggtgcccagcgacattgcggcgggcctcgccctgcttcatcagcaacaggacaatatcaggaacaaccaagagcctgcccaggtggtctgccatgccccagggagctcccagctgcagaagcagaaccacagactatgacttggtcggaggcgatcagctcaactgtcacttcggctccatcctgcacaccacagggctgcagtacagggacttcatccacgtcagcttccatgacaaggtttacgagctgccgtttttagtggctctggatcacaggaaagagtctgttgtggtcgctgtgagggggaccatgtctctgcaggatgtccttacggacctgtcagcggagagtgaggtgctggacgtggagtgtgaggtgcaggaccgcctggcacacaagggtatttctcaagctgccagatacgtttaccaacgactcatcaacgacgggattttgagccaagccttcagcattgctcctgagtaccggctggtcatagtgggccacagcctcgggggcggggcggccgccctgctggccaccatgctcagagccgcctacccgcaggtcaggtgctacgccttctccccaccccgggggctgtggagcaaagctctgcaggaatattctcagagcttcatcgtgtcactcgtcctggggaaggatgtgattcccaggctcagtgtgaccaacttggaagatctgaagagaagaatcttgcgagtggtcgcgcactgcaataaacccaagtacaagatcttgctgcacggtttgtggtacgaactgtttggaggaaaccccaacaacttgcccacggagctggacgggggcgaccaggaagtcctgacacagcctcttctgggggagcagagcctactgacgcgctggtccccggcctacagcttctccagcgactccccactggactcttctcccaagtacccccctctctaccctcccggcaggatcatccacctgcaggaggagggcgcctcggggcggtttggctgctgctctgctgctcactatagcgccaagtggtcacacgaagcggaattcagcaaaatactcataggtccgaagatgctcaccgaccacatgccagacatcctgatgcgggccttggacagcgtggtctccgacagagcggcctgcgtctcctgtccagcacaaggggtctccagtgtggacgtggcctgaccagggccactggaaactgtcccaggaacgatggactcacgcttttgtccttaaactgacttaccatccgaggagttcccatgacgccaaaacagcgaatgtccatcaacaggaatcggatgggaacagaattccatggtctcaatgacttaagtttatgggaagtcattgtggccataatggtagcagaagtagtgagcacgctcaggtgataggacgactcctgagacccagcgaccgtggagacagcctcgggaagccctggcccgtggatggatcccttggctgtctgaggactgctccagaagtgcgggaatcca

SEQ ID NO: 8266 - DNA, 5757 bp, Homo sapiens
atcggggccttggggagcccaggatggaggtggcggtcgcggcggcgggccgagccctgcggcgggcgggaggaggtgagcaccaggcccactgagcctctgcagagccaccagccatgcccgggatcgtggtgttccggcggcgctggtctgtgggcagtgatgacctcgtcctaccggccatcttcctctttctcctgcataccacctggtttgtgatcctgtccgtggtgctcttcggcctggtctataacccgcacgaggcctgctccctgaacctggtggaccacggccgcggctacctgggcatcctgctgagctgcatgatcgctgagatggccatcatctggctgagcatgcgcgggggcatcctctacacggagccccgtgactccatgcagtacgtgctctacgtgcgcctggccatcctggtgatcgagttcatctacgccatcgtgggcatcgtctggctcactcagtactacacctcctgcaacgacctcactgccaagaatgtcaccctcggaatggttgtctgcaactgggtagtcatcctcagtgtgtgcatcactgtcctctgcgtcttcgaccccacgggccgcacctttgtcaagctgagagccaccaagaggaggcagcgtaacctgcggacctacaacctgcggcaccgcttagaggagggtcaagccaccagctggtcgcgccggctcaaagtgttcctctgctgcacgcggacgaaggactcccagtcagatgcctactcagaaatcgcctacctctttgcggagttcttccgggaccttgacattgtgccatccgacatcattgctggcctggtgctgctccggcagcggcagcgggccaagcgcaacgccgtgctggacgaggcaaacaatgacatcttggccttcctgtctgggatgccggtgaccagaaacaccaagtacctcgacctcaagaattcacaagagatgctccgctacaaagaggtctgctactacatgctctttgccctggctgcctacgggtggcccatgtacctgatgcggaagcccgcctgcggcctctgccaactggctcggtcctgctcgtgttgcctgtgtcctgcgaggccgcggttcgcccctggagtcaccatcgaggaagacaactgctgtggctgtaatgccattgccatccggcgccacttcctggacgagaacatgactgcggtggacatcgtctatacctcctgccatgatgcggtctatgaaacgcccttctacgtggcggtggaccatgacaagaagaaagtggtgatcagtatccgggggaccctgtcccccaaggatgccctgactgacctgacgggtgatgctgagcgcctccccgtggaggggcaccacggcacctggctgggccacaagggtatggtcctctcagctgagtacatcaagaagaaactggagcaggagatggtcctgtcccaggcctttgggcgagacctgggccgcggaaccaaacactacggcctgattgtggtgggccactccctgggcgcgggcactgctgccatcctctccttccttctgcgcccacagtatccgaccctcaagtgctttgcctactccccgccagggggcctgctgagtgaggatgcgatggagtattccaaggagttcgtgactgctgtggttctgggcaaagacctcgtccccaggattggcctctctcagctggaaggcttccgcagacagctcctggatgtcctgcagcgaagcaccaagcccaaatggcggatcatcgtgggggccaccaaatgcatccccaagtcggagctgcctgaggaggtagaggtgaccaccctggccagcacgcggctctggacccaccccagcgacctaactatagccctctcagccagcactccactctacccgcccggccgcatcatccacgtggtccacaaccaccctgcagagcagtgctgctgctgtgagcaggaggagcccacatactttgccatctggggcgacaacaaggccttcaatgaggtgatcatctcgccagccatgctgcatgagcacctgccctatgtggtcatggaggggctcaacaaggtgctggagaactacaacaaggggaagaccgctctgctctctgcagccaaggtcatggtgagccctaccgaggtggacctgactcctgagctcatcttccagcagcagccactccccacggggccgcccatgcccactggccttgccctggagctgccgactgcagaccaccgcaacagcagcgtcaggagcaagtcccagtctgagatgagcctggagggcttctcggaggggcggctgctgtcgccagtggttgcggcggcggcccgccaggacccggtggagctgctgctgctgtctacccaggagcggctggcggcggagctgcaggcccggcgggcaccactggccaccatggagagcctctcggacactgagtccctgtacagcttcgactcgcgccgctcctcaggcttccgcagcatccggggctcccccagcctccacgctgtgctggagcgtgatgaaggccacctcttctacattgaccctgccatccccgaggaaaacccatccctgagctcgcgcactgagctgctggcggccgacagcctgtccaagcactcacaggacacgcagcccctggaggcggccctgggcagtggcggcgtcactcctgagcggccccccagtgctgcggccaatgacgaggaggaagaggttggcggtgggggtggcgggccggcctcccgcggggagctggcgctgcacaatgggcgcctgggggactcgcccagtcctcaggtgctggaattcgccgagttcatcgacagcctcttcaacctggacagcaagagcagctccttccaagacctctactgcatggtggtgcccgagagccccaccagtgactacgctgagggccccaagtcccccagccagcaagagatcctgctccgtgcccagttcgagcccaacctggtgcccaagcccccacggctctttgccggctcagccgacccctcctcgggcatctcactctcgccctccttcccgctcagctcctcgggtgagctcatggacctgacgcccacgggcctcagtagccaggaatgcctggcggctgacaagatccggacttctacccccactggccacggagccagccccgccaagcaagatgagctggtcatctcagcacgctagcaccccagttgcgtggccagccgggcccaggcaggagcaggtggccctgtgggcacctggtgcctgccccctgccgggcagctttaaggacagacccccaggggcagtttagcctcaggcacaggcatcgctgctgagctgggggtccgcatccctacctcagcttaggacccccagagccaaggtggctgggatctggccccacagatggggaaagatggggaagggtgtggagtggggaggagcctgggcagcctgctgggtgggccacactcagcctgactgccctccatgggggcattctggcaccccctgctccaggacaggccatgggcaagctgcctcccatcactgcctgctggctgctctcccaggggccaggtggagagcagtgccccccgacacatgtattctcatctgtggtccaggccggcatcgtcctggccaccccccagatctggtgcctgctggccggccccctggggtgcccctgccgaggtggcctgcagtgctgtacatgtttacagaagctgctgggcttggctcaggatgtgttctgggcttgcaagccccccgcccaatcatgtgttcagtagccgtcctctgagcagggcccaaggcagccaggggcctggaggggccagaggagggtggggtcagggccgccccttctctgccttgtgcctctcatgctgcctcctctgcccatgggtcctgggcacccaggcctgccctgcctgctggctacttcctggcttaccttctacccccaaggatcctcaccacccaaagggtggtgggcactgctgtgaccaccccagctgcagagtcagtgccctgggtggaaggaaggcactgagagcccccttcctctgagggccccacctcaccccttggtgtcacccccaccacgcctaggcagctctgggccctgggatctggaaccaacacacccctgttcccctcagctttccctcctcgctggcctgggcaccctcctgggagcaggccttcctccctcccacccccaatgtcctgttggtaggaggtggggccaagagtggggtatggtgggccttggctggagacctctgtccactgcccagggaggggcctggggctgggagcagtcccggtttagcctgaggtccccatagggcttcctcccctgctgggtttgggaagcagttagggagatagcgacccggagtttccccagaagcggggtgggagggtgtgcatgctagtgttggcgcgtatgcatgtgcatgagtgtgcaccgttcctaaggaaggggcctctggggctgcccaccctacctgccctgcctgcctgctgcccctcccagcctgccaagaaaacggtaggggagcatgatggggcctttgaggcagggtcgcagggacaagctcagctttaggcaccatctgttcccatcgcgcctgctgctgtgacccgttttggaaaactggtgtgtaccgaggcgctgactgcacggctgaccgcctgctcgtgccttcattctgcagcggcatggtccctcccattctggctccacctgcagcctccctgggtggcctaggctcccccgaccaagagacctccctctcatgatcactggtacctgggggcctgaattctggcccccggctccccacacagctgggactggcctggatggctgtcctgggagcccctgcccaccctgacagagggagctgggcctcccctcatcctctgtaactcccgccttcaccagactcaaggacaccctggccctgctgaggcatacagagcttcagcccagcacagaagcaagacaaaatcagtggctcttagagtttagaaaacaagacagactctcagatgaaagatctgacaagcaccgtggccagtcacagggagagacttgatgtctggccttttaattcctcctctgccagggtgggtcctgggacctctaatgtgggcatgtcgtccaccccaggacgagccatcagggacagaccccccacccccaaggctgcagccacaccatgtttcaggcttggggctggggcaggcttgggctcaatcctgggcacccaggggcagcccacccctaacctggctcctacccacctcgcccttgaaggatgggcctgctgcacgtctccctcctccaccccataccacactggggggtctgagccacccccctcagccccgttcggctcagaccgacccccactccatccccagacctgcagcacaagtgcgcgggcctgtcctcccaggggcctgggcgactccatatgcaatcagtagcgagcagccgggccccacagaccctcatgcactctcttacgtgccattctccccagactttttttgtacttaatgtatgaaagatccaaactaatattgctgtaaaaaggagagacaaattaatatagcttattctataaatatatctgtatataaaggtttctgtatattgtatagagctgtgtataaactggatgtagaagca

SEQ ID NO: 8267 - DNA, 2897 bp, Homo sapiens
agtgcgcttgcgccgatctcggcctcagcgtgagcatgcgcaggtccccgccctcgctgcgtttgcgcttgagcgccgataatttggtggcggcgtccggagggtgctggtttgttctcggtgaacggcgcgcggggtctctcctgagtgcgagctacgggaccttcgccatgccggggatggtactcttcggccggcgctgggccatcgccagcgacgacttggtcttcccagggttcttcgagctggtcgtgcgagtgctgtggtggattggcattctgacgttgtatctcatgcacagaggaaagctggactgtgctggtggagccttgctcagcagttacttgatcgtcctcatgattctcctggcagttgtcatatgtactgtgtcagccatcatgtgtgtcagcatgagaggaacgatttgtaaccctggaccgcggaagtctatgtctaagctgctttacatccgcctggcgctgttttttccagagatggtctgggcctctctgggggctgcctgggtggcagatggtgttcagtgcgacaggacagttgtaaacggcatcatcgcaaccgtcgtggtcagttggatcatcatcgctgccacagtggtttccattatcattgtctttgaccctcttggggggaaaatggctccatattcctctgccggccccagccacctggatagtcatgattcaagccagttacttaatggcctcaagacagcagctacaagcgtgtgggaaaccagaatcaagctcttgtgctgttgcattgggaaagacgaccatactcgggttgctttttcgagtacggcagagcttttctcaacctacttttcagacacagatctggtgcccagcgacattgcggcgggcctcgccctgcttcatcagcaacaggacaatatcaggaacaaccaagagcctgcccaggtggtctgccatgccccagggagctcccaggaagctgatctggatgcagaattagaaaactgccatcattacatgcagtttgcagcagcggcctatgggtggcccctctacatctacagaaaccccctcacggggctgtgcaggattggtggtgactgctgcagaagcagaaccacagactatgacttggtcggaggcgatcagctcaactgtcacttcggctccatcctgcacaccacagggctgcagtacagggacttcatccacgtcagcttccatgacaaggtttacgagctgccgtttttagtggctctggatcacaggaaagagtctgttgtggtcgctgtgagggggaccatgtctctgcaggatgtccttacggacctgtcagcggagagtgaggtgctggacgtggagtgtgaggtgcaggaccgcctggcacacaagggtatttctcaagctgccagatacgtttaccaacgactcatcaacgacgggattttgagccaagccttcagcattgctcctgagtaccggctggtcatagtgggccacagcctcgggggcggggcggccgccctgctggccaccatgctcagagccgcctacccgcaggtcaggtgctacgccttctccccaccccgggggctgtggagcaaagctctgcaggaatattctcagagcttcatcgtgtcactcgtcctggggaaggatgtgattcccaggctcagtgtgaccaacttggaagatctgaagagaagaatcttgcgagtggtcgcgcactgcaataaacccaagtacaagatcttgctgcacggtttgtggtacgaactgtttggaggaaaccccaacaacttgcccacggagctggacgggggcgaccaggaagtcctgacacagcctcttctgggggagcagagcctactgacgcgctggtccccggcctacagcttctccagcgactccccactggactcttctcccaagtacccccctctctaccctcccggcaggatcatccacctgcaggaggagggcgcctcggggcggtttggctgctgctctgctgctcactatagcgccaagtggtcacacgaagcggaattcagcaaaatactcataggtccgaagatgctcaccgaccacatgccagacatcctgatgcgggccttggacagcgtggtctccgacagagcggcctgcgtctcctgtccagcacaaggggtctccagtgtggacgtggcctgaccagggccactggaaactgtcccaggaacgatggactcacgcttttgtccttaaactgacttaccatccgaggagttcccatgacgccaaaacagcgaatgtccatcaacaggaatcggatgggaacagaattccatggtctcaatgacttaagtttatgggaagtcattgtggccataatggtagcagaagtagtgagcacgctcaggtgataggacgactcctgagacccagcgaccgtggagacagcctcgggaagccctggcccgtggatggatcccttggctgtctgaggactgctccagaagtgcgggaatccagggcccacccagaagaccgtgaacagttccttagcctcccacccccaaggcagctcttttcatccaactcagtttacaggcgtggtttgtttttcaaactgggcttcctggatgtacaaatggaactgtggtgagggtgcgggctggggttttctcctgggcgtcaccaagggcagccctgggctctggctggggatgaagacgaaacccgatcgggaaagtaagtggagcccccggccccgccgagccacagccccccaactgcctattcccactgcccagttgtttgtccacatcaggagttgctgattgaattcttgctactcttctggctctggggtcggccagtggattcaggagttgaaacaataaagcgcgcgtcaccata

SEQ ID NO: 8268 - DNA, 1374 bp, Homo sapiens
aatttggtggcggcgtccggagggtgctggtttgttctcggtgaacggcgcgcggggtctctcctgagtgcgagctacgggaccttcgccatgccggggatggtactcttcggccggcgctgggccatcgccagcgacgacttggtcttcccagggttcttcgagctggtcgtgcgagtgctgtggtggattggcattctgacgttgtatctcatgcacagaggaaagctggactgtgctggtggagccttgctcagcagttacttgatcgtcctcatgattctcctggcagttgtcatatgtactgtgtcagccatcatgtgtgtcagcatgagaggacacagatctggtgcccagcgacattgcggcgggcctcgccctgcttcatcagcaacaggacaatatcaggaacaaccaagagcctgcccaggtggtctgccatgccccagggagctcccagctgcagaagcagaaccacagactatgacttggtcggaggcgatcagctcaactgtcacttcggctccatcctgcacaccacagggctgcagtacagggacttcatccacgtcagcttccatgacaaggtttacgagctgccgtttttagtggctctggatcacaggaaagagtctgttgtggtcgctgtgagggggaccatgtctctgcaggatgtccttacggacctgtcagcggagagtgaggtgctggacgtggagtgtgaggtgcaggaccgcctggcacacaagggtatttctcaagctgccagatacgtttaccaacgactcatcaacgacgggattttgagccaagccttcagcattgctcctgagtaccggctggtcatagtgggccacagcctcgggggcggggcggccgccctgctggccaccatgctcagagccgcctacccgcaggtcaggtgctacgccttctccccaccccgggggctgtggaggtgagcctttgttttcctgctctaacagcttgctacttacaagtcatgtggtcaagactcatcttttttttcttttattttcctgagatgaagtcttgctctgtcgcccaggctggagtgcagtggcgtgatctcggctcactgcaagctccacctcccaggttcaggcggttcttctgcctcagcctcccgagttgctgggactacagacacccgccagcatgccggctaatttttgtatttttagtagtggtggggtttcaccatgttggccaggctggtcttgatctcctgacctcaagtgatctgcccgcctcggcctcccaaagtgcagggattacaggcgtgagccaccgcacccagctgagcaaagctctgcaggaatattctcagagcttcatcgtgtcactcgtcct

SEQ ID NO: 8269 - DNA, 1729 bp, Homo sapiens
aatttggtggcggcgtccggagggtgctggtttgttctcggtgaacggcgcgcggggtctctcctgagtgcgagctacgggaccttcgccatgccggggatggtactcttcggccggcgctgggccatcgccagcgacgacttggtcttcccagggttcttcgagctggtcgtgcgagtgctgtggtggattggcattctgacgttgtatctcatgcacagaggaaagctggactgtgctggtggagccttgctcagcagttacttgatcgtcctcatgattctcctggcagttgtcatatgtactgtgtcagccatcatgtgtgtcagcatgagagttggatcatcatcgctgccacagtggtttccattatcattgtctttgaccctcttggggggaaaatggctccatattcctctgccggccccagccacctggatagtcatgattcaagccagttacttaatggcctcaagacagcagctacaagcgtgtgggaaaccagaatcaagctcttgtgctgttgcattgggaaagacgaccatactcgggttgctttttcgagtacggcagagcttttctcaacctacttttcagacacagatctggtgcccagcgacattgcggcgggcctcgccctgcttcatcagcaacaggacaatatcaggaacaaccaagagcctgcccaggtggtctgccatgccccagggagctcccaggaagctgatctggatgcagaattagaaaactgccatcattacatgcagtttgcagcagcggcctatgggtggcccctctacatctacagaaaccccctcacggggctgtgcaggattggtggtgactgctgcagaagcagaaccacagactatgacttggtcggaggcgatcagctcaactgtcacttcggctccatcctgcacaccacagggctgcagtacagggacttcatccacgtcagcttccatgacaaggtttacgagctgccgtttttagtggctctggatcacaggaaagagtctgttgtggtcgctgtgagggggaccatgtctctgcaggatgtccttacggacctgtcagcggagagtgaggtgctggacgtggagtgtgaggtgcaggaccgcctggcacacaagggtatttctcaagctgccagatacgtttaccaacgactcatcaacgacgggattttgagccaagccttcagcattgctcctgagtaccggctggtcatagtgggccacagcctcgggggcggggcggccgccctgctggccaccatgctcagagccgcctacccgcagcaaagctctgcaggaatattctcagagcttcatcgtgtcactcgtcctggggaaggatgtgattcccaggctcagtgtgaccaacttggaagatctgaagagaagaatcttgcgagtggtcgcgcactgcaataaacccaagtacaagatcttgctgcacggtttgtggtacgaactgtttggaggaaaccccaacaacttgcccacggagctggacgggggcgaccaggaagtcctgacacagcctcttctgggggagcagagcctactgacgcgctggtccccggcctacagcttctccagcgactccccactggactcttctcccaagtacccccctctctaccctcccggcaggatcatccacctgcaggaggagggcgcctcggggcggtttggctgctgctctgctgctcactatagcg

SEQ ID NO: 8270 - DNA, 916 bp, Homo sapiens
gcgtttgcgcttgagcgccgataatttggtggcggcgtccggagggtgctggtttgttctcggtgaacggcgcgcggggtctctcctgagtgcgagctacgggaccttcgccatgccggggatggtactcttcggccggcgctgggccatcgccagcgacgacttggtcttcccagggttcttcgagctggtcgtgcgagtgctgtggtggattggcattctgacgttgtatctcatgcacagaggaaagctggactgtgctggtggagccttgctcagcagttacttgatcgtcctcatgattctcctggcagttgtcatatgtactgtgtcagccatcatgtgtgtcagcatgagaggaacgatttgtaaccctggaccgcggaagtctatgtctaagctgctttacatccgcctggcgctgttttttccagagatggtctgggcctctctgggggctgcctgggtggcagatggtgttcagtgcgacaggacagttgtaaacggcatcatcgcaaccgtcgtggtcagttggatcatcatcgctgccacagtggtttccattatcattgtctttgaccctcttggggggaaaatggctccatattcctctgccggccccagccacctggatagtcatgattcaagccagttacttaatggcctcaagacagcagctacaagcgtgtgggaaaccagaatcaagctcttgtgctgttgcattgggaaagacgaccatactcgggttgctttttcgagtacggcagagcttttctcaacctacttttcagacacagatctggtgcccagcgacattgcggcgggcctcgccctgcttcatcagcaacaggacaataccagggccactggaaactgtcccaggaacgatggactcacgcttttgtccttaaactga

SEQ ID NO: 8271 - DNA, 2004 bp, Homo sapiens
aggccccgcctcaggtcggccgcggactacaaatggacgagagaggcggccgtccattagttagcggctccggagcaacgcagccgttgtccttgaggccgacgggcctgacgcgggcgggttgaacgcgctggtgaggcggtcacccgggctacggcggccggcagggggcagtggcggccgttgtctagggcccggaggtggggccgcgcgcctcgggcgctacgaacccggcaggcccacgcttggctgcggccgggtgcgggctgaggccatgggcgaccgcggcagctcccggcgccggaggacagggtcgcggccctcgagccacggcggcggcgggcctgcggcggcggaagaggaggtgcgggacgccgctgcgggccccgacgtgggagccgcgggggacgcgccagccccggcccccaacaaggacggagacgccggcgtgggcagcggccactgggagctgaggtgccatcgcctgcaggattctttattcagctctgacagtggcttcagcaactaccgtggcatcctgaactggtgtgtggtgatgctgatcttgagcaatgcccggttatttctggagaacctcatcaagtatggcatcctggtggaccccatccaggtggtttctctgttcctgaaggatccctatagctggcccgccccatgcctggttattgcggccaatgtctttgctgtggctgcattccaggttgagaagcgcctggcggtgggtgccctgacggagcaggcgggactgctgctgcacgtggccaacctggccaccattctgtgtttcccagcggctgtggtcttactggttgagtctatcactccagtgggctccctgctggcgctgatggcgcacaccatcctcttcctcaagctcttctcctaccgcgacgtcaactcatggtgccgcagggccagggccaaggctgcctctgcagggaagaaggccagcagtgctgctgccccgcacaccgtgagctacccggacaatctgacctaccgcgatctctactacttcctcttcgcccccaccttgtgctacgagctcaactttccccgctctccccgcatccggaagcgctttctgctgcgacggatccttgagatgctgttcttcacccagctccaggtggggctgatccagcagtggatggtccccaccatccagaactccatgaagcccttcaaggacatggactactcacgcatcatcgagcgcctcctgaagctggcggtccccaatcacctcatctggctcatcttcttctactggctcttccactcctgcctgaatgccgtggctgagctcatgcagtttggagaccgggagttctaccgggactggtggaactccgagtctgtcacctacttctggcagaactggaacatccctgtgcacaagtggtgcatcagacacttctacaagcccatgcttcgacggggcagcagcaagtggatggccaggacaggggtgttcctggcctcggccttcttccacgagtacctggtgagcgtccctctgcgaatgttccgcctctgggcgttcacgggcatgatggctcagatcccactggcctggttcgtgggccgctttttccagggcaactatggcaacgcagctgtgtggctgtcgctcatcatcggacagccaatagccgtcctcatgtacgtccacgactactacgtgctcaactatgaggccccagcggcagaggcctgagctgcacctgagggcctggcttctcactgccacctcacacccgctgccagagcccacctctcctcctaggcctcgagtgctggggatgggcctggctgcacagcatcctcctctggtcccagggaggcctctctgcccctatggggctctgtcctgcacccctcagggatggcgacagcaggccagacacagtctgatgccagctgggagtcttgctgaccctgccccgggtccgagggtgtcaataaagtgctgtccagtga

SEQ ID NO: 8272 - DNA, 2453 bp, Homo sapiens
ctgccccgttgtgaggtgataaagtgttgcgctccgggacgccagcgccgcggctgccgcctctgctggggtctaggctgtttctctcgcgccaccactggccgccggccgcagctccaggtgtcctagccgcccagcctcgacgccgtcccgggacccctgtgctctgcgcgaagccctggccccgggggccggggcatgggccaggggcgcggggtgaagcggcttcccgcggggccgtgactgggcgggcttcagccatgaagaccctcatagccgcctactccggggtcctgcgcggcgagcgtcaggccgaggctgaccggagccagcgctctcacggaggacctgcgctgtcgcgcgaggggtctgggagatggggcactggatccagcatcctctccgccctccaggacctcttctctgtcacctggctcaataggtccaaggtggaaaagcagctacaggtcatctcagtgctccagtgggtcctgtccttccttgtactgggagtggcctgcagtgccatcctcatgtacatattctgcactgattgctggctcatcgctgtgctctacttcacttggctggtgtttgactggaacacacccaagaaaggtggcaggaggtcacagtgggtccgaaactgggctgtgtggcgctactttcgagactactttcccatccagctggtgaagacacacaacctgctgaccaccaggaactatatctttggataccacccccatggtatcatgggcctgggtgccttctgcaacttcagcacagaggccacagaagtgagcaagaagttcccaggcatacggccttacctggctacactggcaggcaacttccgaatgcctgtgttgagggagtacctgatgtctggaggtatctgccctgtcagccgggacaccatagactatttgctttcaaagaatgggagtggcaatgctatcatcatcgtggtcgggggtgcggctgagtctctgagctccatgcctggcaagaatgcagtcaccctgcggaaccgcaagggctttgtgaaactggccctgcgtcatggagctgacctggttcccatctactcctttggagagaatgaagtgtacaagcaggtgatcttcgaggagggctcctggggccgatgggtccagaagaagttccagaaatacattggtttcgccccatgcatcttccatggtcgaggcctcttctcctccgacacctgggggctggtgccctactccaagcccatcaccactgttgtgggagagcccatcaccatccccaagctggagcacccaacccagcaagacatcgacctgtaccacaccatgtacatggaggccctggtgaagctcttcgacaagcacaagaccaagttcggcctcccggagactgaggtcctggaggtgaactgagccagccttcggggccaattccctggaggaaccagctgcaaatcacttttttgctctgtaaatttggaagtgtcatgggtgtctgtgggttatttaaaagaaattataacaattttgctaaaccattacaatgttaggtcttttttaagaaggaaaaagtcagtatttcaagttctttcacttccagcttgccctgttctaggtggtggctaaatctgggcctaatctgggtggctcagctaacctctcttcttcccttcctgaagtgacaaaggaaactcagtcttcttggggaagaaggattgccattagtgacttggaccagttagatgattcactttttgcccctagggatgagaggcgaaagccacttctcatacaagcccctttattgccactaccccacgctcgtctagtcctgaaactgcaggaccagtttctctgccaaggggaggagttggagagcacagttgccccgttgtgtgagggcagtagtaggcatctggaatgctccagtttgatctcccttctgccacccctacctcacccctagtcactcatatcggagcctggactggcctccaggatgaggatgggggtggcaatgacaccctgcaggggaaaggactgccccccatgcaccattgcagggaggatgccgccaccatgagctaggtggagtaactggtttttcttgggtggctgatgacatggatgcagcacagactcagccttggcctggagcacatgcttactggtggcctcagtttaccttccccagatcctagattctggatgtgaggaagagatccctcttcagaaggggcctggccttctgagcagcagattagttccaaagcaggtggcccccgaacccaagcctcacttttctgtgccttcctgagggggttgggccggggaggaaacccaaccctctcctgtgtgttctgttatctcttgatgagatcattgcaccatgtcagacttttgtatatgccttgaaaataaatgaaagtgagaatcctc

SEQ ID NO: 8273 - DNA, 2202 bp, Homo sapiens
gtcctagccgcccagcctcgacgccgtcccgggacccctgtgctctgcgcgaagccctggccccgggggccggggcatgggccaggggcgcggggtgaagcggcttcccgcggggccgtgactgggcgggcttcagccatgaagaccctcatagccgcctactccggggtcctgcgcggcgagcgtcaggccgaggctgaccggagccagcgctctcacggaggacctgcgctgtcgcgcgaggggtctgggagatggggagtggcctgcagtgccatcctcatgtacatattctgcactgattgctggctcatcgctgtgctctacttcacttggctggtgtttgactggaacacacccaagaaaggtggcaggaggtcacagtgggtccgaaactgggctgtgtggcgctactttcgagactactttcccatccagctggtgaagacacacaacctgctgaccaccaggaactatatctttggataccacccccatggtatcatgggcctgggtgccttctgcaacttcagcacagaggccacagaagtgagcaagaagttcccaggcatacggccttacctggctacactggcaggcaacttccgaatgcctgtgttgagggagtacctgatgtctggaggtatctgccctgtcagccgggacaccatagactatttgctttcaaagaatgggagtggcaatgctatcatcatcgtggtcgggggtgcggctgagtctctgagctccatgcctggcaagaatgcagtcaccctgcggaaccgcaagggctttgtgaaactggccctgcgtcatggagctgacctggttcccatctactcctttggagagaatgaagtgtacaagcaggtgatcttcgaggagggctcctggggccgatgggtccagaagaagttccagaaatacattggtttcgccccatgcatcttccatggtcgaggcctcttctcctccgacacctgggggctggtgccctactccaagcccatcaccactgttgtgggagagcccatcaccatccccaagctggagcacccaacccagcaagacatcgacctgtaccacaccatgtacatggaggccctggtgaagctcttcgacaagcacaagaccaagttcggcctcccggagactgaggtcctggaggtgaactgagccagccttcggggccaattccctggaggaaccagctgcaaatcacttttttgctctgtaaatttggaagtgtcatgggtgtctgtgggttatttaaaagaaattataacaattttgctaaaccattacaatgttaggtcttttttaagaaggaaaaagtcagtatttcaagttctttcacttccagcttgccctgttctaggtggtggctaaatctgggcctaatctgggtggctcagctaacctctcttcttcccttcctgaagtgacaaaggaaactcagtcttcttggggaagaaggattgccattagtgacttggaccagttagatgattcactttttgcccctagggatgagaggcgaaagccacttctcatacaagcccctttattgccactaccccacgctcgtctagtcctgaaactgcaggaccagtttctctgccaaggggaggagttggagagcacagttgccccgttgtgtgagggcagtagtaggcatctggaatgctccagtttgatctcccttctgccacccctacctcacccctagtcactcatatcggagcctggactggcctccaggatgaggatgggggtggcaatgacaccctgcaggggaaaggactgccccccatgcaccattgcagggaggatgccgccaccatgagctaggtggagtaactggtttttcttgggtggctgatgacatggatgcagcacagactcagccttggcctggagcacatgcttactggtggcctcagtttaccttccccagatcctagattctggatgtgaggaagagatccctcttcagaaggggcctggccttctgagcagcagattagttccaaagcaggtggcccccgaacccaagcctcacttttctgtgccttcctgagggggttgggccggggaggaaacccaaccctctcctgtgtgttctgttatctcttgatgagatcattgcaccatgtcagacttttgtatatgccttgaaaataaatgaaagtgagaatcctc

SEQ ID NO: 8274 - DNA, 9333 bp, Homo sapiens
gggcactttgaagaatcacgtgtgttgaggccctcttaaagagataggcacctacttttccctccaccctaaacaccgccctgagggcggcggcgaccgtggtaattgcaactgctcaggggcagggcttgccccagcgccgagtagtggcaacggcgtggttgcgtcgggggtgcctgggagcctggagtcccgggggcctgaaatcggcagcttcccgggcagacactctctccctcaggaagaggtgccgccgagtcagcgcggggcagtgtgagcgccccgaggtgctttctcagttgaggagaggtggggttacagggcacaggtgacagggccggagaaagatggagcagcccggggcggcggcgtcgggagcgggaggcggcagcgaggaacccggtgggggccggagcaacaagcggagcgcggggaaccgggccgccaatgaagaggaaacgaaaaacaaacccaaattgaacattcaaataaaaactttggcagatgatgtgcgtgaccgaattacaagttttagaaaatctactgtcaaaaaagaaaaacctcttattcaacatcctattgattctcaagtcgcgatgagtgagtttcctgcagctcagccattatatgatgaacgatctttgaatttgtcagaaaaggaagtattggatctctttgaaaaaatgatggaggacatgaaccttaacgaagagaaaaaagctcctttacgaaacaaagactttaccaccaaacgtgagatggttgtccagtatatttctgccactgccaaatctggtgggctgaaaaacagcaaacatgaatgcaccctgtcttcacaagaatatgttcatgaattacgatcgggtatatcagatgagaaacttcttaattgcctagaatccctcagggtttctttaaccagcaatccggtcagctgggttaacaactttggccatgaaggtcttggactcttattggatgagctggaaaagcttctggacaaaaaacagcaagaaaatattgacaagaagaatcagtataaacttattcaatgcctcaaagcatttatgaataataagtttggattacaaaggattctaggagatgaaagaagtcttttactattggcaagagcaattgaccccaaacaacccaacatgatgactgaaatagtaaaaatactttctgctatttgcattgttggagaagagaacattctagataaacttttaggggctataacaacagcagcagaaagaaataacagggaacgattttcaccaattgtggaaggtttagaaaatcaggaagccttgcaattacaggtggcctgcatgcagtttataaatgcccttgtcacttctccttatgagcttgattttcgaatacatttaaggaatgaattcctccgttcaggactaaaaacaatgttaccagatctaaaagaaaaagagaatgatgagcttgatattcagttgaaagtatttgatgaaaacaaagaagatgacctaactgaattatcacaccgtctcaatgacattcgagcagaaatggatgatatgaatgaagtctaccatcttctatataatatgctgaaggacactgctgctgaaaattacttcttatctattctacaacattttttgcttatcagaaatgattattatatcaggccacaatattataaaataattgaggaatgtgtttcacagatagtgctacactgcagtggtatggatccagacttcaaatacaggcaaagattagacatcgatttaactcatctgatagattcttgtgtgaacaaggcgaaagttgaagaaagtgaacaaaaagctgcagagttttcaaagaagttcgatgaagaattcacagctcgacaggaagctcaagcagagcttcaaaaaagagatgagaaaatcaaagaacttgaagcagaaatccagcaacttcgaacccaggcacaagtactctcaagttcatcaggaattccaggtcctcctgcagcacctccattgccaggtgtagggccgcctccaccaccacccgcgccacctctacccggaggagctcctcttcctcctccaccacctcctttacctggaatgatggggataccaccaccacccccaccaccacttttatttgggggacctcctccaccaccaccccttggaggagttcctcctcccccaggaatatcacttaatctaccttatggaatgaagcagaaaaaaatgtataaacctgaagtgtccatgaagagaatcaattggtcaaagattgaacccacagaattatctgagaactgtttctggttaagagtcaaagaagacaagtttgagaatccagatctctttgccaaattggcattgaattttgctactcagataaaagttcaaaagaacgcagaagcattagaagaaaagaagactgggcctacaaagaagaaagtgaaagaactgagaattttggatcccaaaacagctcagaatctgtccatctttctgggatcatatcgcatgccatatgaagacataagaaacgttattctggaggttaatgaagacatgctgagtgaggctttaattcagaaccttgtgaaacatcttcctgagcagaagatactcaacgaattagcagagcttaagaatgaatatgatgacctctgtgagcctgaacaatttggagttgtgatgagctctgtgaaaatgttacagcctcgtctcagtagtatcctgttcaagctcacatttgaagaacacataaacaacatcaaaccaagcatcatagcagtaactcttgcctgtgaagaactgaagaaaagtgaaagctttaacagacttttagagttagttcttcttgttggaaactacatgaactcaggctcaagaaatgcccagtctttgggatttaagatcaacttcctttgtaagatcagagatactaaatcagcggatcaaaaaacaacccttttgcattttattgccgacatttgtgaggaaaaatatcgagatatcctaaaatttcctgaagaactggaacacgtagaaagtgcaagcaaagtttcagctcaaattctcaagagcaaccttgcatcaatggaacaacaaattgttcatctggaacgtgacatcaagaaattcccccaagcagaaaatcaacacgataagtttgtggaaaagatgaccagctttacaaagactgcccgagaacagtatgaaaaactctccaccatgcacaacaacatgatgaagctctatgagaatcttggagaatacttcatttttgactcaaagacagtgagcatagaagagttctttggtgatctcaacaacttccgaactttgtttttggaagcagtgagagaaaacaataagagaagagaaatggaagagaagaccaggagggcaaaacttgcaaaagagaaagctgaacaagaaaagttagaacgccagaagaaaaagaaacaactcattgatataaacaaagagggtgatgagactggtgtgatggataatcttctagaagccctacaatcaggtgcagcattcagagaccgtcgaaagcggattccaaggaatccagataacagacgagtacctttggaaaggtcacgctctcgccacaatggagctatctcatctaagtgattcctgatgccaaagaatatgaaaatatttaagtaaaaacaaaatgatgcattttgagaagaacaaagtgtgcactcagcggctggaaaggaaataagtgcatttctgcaaagatcaagataagctggatgaagtagtgtgcatttgtaatactattgcaagactcctcccacaattattctaatctgaacacagttatcaggattacaaaatgtgttccattttagtgtaaagatgtgtatcatttgtaattgtgtgtgacctgactgtgatgatggaagtgtaagaaattgaagagttctaaggctttcaaaaacactcagtcaaaaatttaaaatcttaaatgtgtaagtcacccccaccaaaaacaaaagagaagaaaaagaatagaaagaattatccagtgtcagcttccaatccctagtacatatataatagaaaagggccaagaaaaatatgcatcttgatttggagagaggctaatattatgcacactgtaagagaagccattttggaaattcacgaaagtactgctccaccccagttgagttatttagaattttatctcaagtgaaagctgatggattcatctgctttggctgaaattaaacttatcattagtctagctagcatttcagcatgatattgcaagcacttctcattgctaaaaataaataaaccaaagtttaaccgaatcagttagggaaagtgatttaaactttatttaaagaggtattttctaattatgcacagatatctactttatacaaatactttatatggctatttttgagaaaaccctcacattttaatgtttatgctagggatgaacctgaaaattctattacgtttatttagatttcaaaggcaaatattgattcctatgctctgtggtttatttcttttttctattgcttctttctcccttgagtcccttgaaggcagggaatagacttctagaaaacctgagaggaaaaagaattctttttacaggaggcagcagaaaactgtctgaaaggtcaattgttttatctccctttccactctctttccaatttcactttggtggtctgaagaagaaaaagaaattttatgtatgtatgtgtaaatatgtgtatatatttctatctcttgctacaataattccaactaagtgaacttctcaattatcatcatacttacttaccttatattaacaaattaagatgatgctgccaaaacaagtctagcagggaaaacaggttctacatttttcttaaataaattagggagtaaaagttatacttaacttgtctgtctattattttaaaatatgcattgaaataatgtggtataacttctctggagtgcaattttaagtctaattcatgcagatgattgattgtgattattgtaagaaatttcttacatgtatatttcttatgtagaaaatactgtttctactcattcaaagcacattgtagatattcagagagaagaacaaatggctggcttggcaaatccccatctgagataaagtaaacaagtgaccagcagcccacagatgattcctttatatagatgtataatgattcaaactgctgcctttgcctccagtgcatccttacttaggtattatacttctttaaaaagctctgaagctgctacaatagaaaaatcaaaaagggtaacagtatctgaaatttcacagtcctatccgatctgaaaacacacatacacaaatgcacacacatgcacacacacatttaagggacatagcagtaacactgttttttaacaacaacaaaagtttaggttctaatttatgtaaatacctagtatgtgtatttttgactttacaaagtctttcttttctgaaatcttcgtggtatggcttttttaattcttttgacagcttatcagtctgtaggagaatgatcttgaaatgttaaccctgactaaaatttgggagcatatgccttgctatattatcaagctggtcaaggtagaaatactgatatgtatcatcaccttttccagatacaaacttgccttattttctagtttgtgaacaagaacgaatgaagtactattattgataacttatatatttttatttagagcaatcccacatgcttttcacaaacattaaaaaaaaaaacctttcagggtctttcatgaagttccaatagttgagtgagttaaaaggtttgtttcccagatttgtaatggtcctgctctagccatttgcagttttgttttagatgattggaaagtatatcaccaaaaaaagtatatagtgacatttttagtatgaaaccaaattacactaaggtcttttgttggccatattactgccacacatgagaagcaccatttatgcagattttcttcagaatatttttaaaaggtacagaatccttaaaatattaacaactaattgcatccatcatctcctttggctgctgtaacaaattaccaccaataatatgatggcttaacacaacagaaacttatttgcttacatttttgaagggcagcaaagccatgctccctccagaggctctagaggagaatctttccttgccacgtccaccttttggtggctattggcattttttggcttatggccacatttctctttctgctgtgtcttcacatcaccctcctctgtatacctaatctgcctctgcctctgtttaataaggatccttatgatgacttttagggactacccagattactccaggataatctcctcacctcatgagtcttaacttaattacatctgcaaggcccccttctccaaataagataaattcatggttttggggattaggatgtggctatgtcttttaggaagccactcttagcccaccagagtctgccctttggcccaaaatttatgtctgtctcatgtgtaaaagacattcatcccatcctaacattaccaaaagtctcaacccattatatcaatcctaagtccaaaatttcattcaaatatcatcggttcaaaagttccaaagcttatcatttagatcatctaaatcaggtatgagtgaaactctgggtatggtctttcctgaggccaaattcctcttcctctgagaaccagtgaaacagaaaagttaatctgctttcaaattacaatggtgggaacaggcataggataacagttacagacatttctgtctcaaaaaggagagaatggaaattggaatggagtctcctgtcccaatcattttcaaaatctagccaggcaaatttctgttatatttcaaggcctggcagtaatcctctttctcagggctccaccctttgggcctgtagctcttctttcttggactatggattgggcctctgcctctgtgcctatgggttgcacttcttcctctgttcccacacttgggcctctgcctctgtacctgcagctctgctctcgggatggtgcttcctttatcttgaagggtggcacatgtttgcagctgagaagttttatcaacgggtttcctacctgtagaattctggcagtctcacaatcttctttcatttttttctgtctctgtcccttttaggcccagttggaagtgtttctgatggtagaacattctcaaaaatcttgtgggtcttctacgtatgtcacattgattcacacattcagaaaagagggtcctcacagatttttcctgaacaaccccatctctattcttggcttctgttgaaacagtcaaataaatccacaagttaatgcctaacctcttcagcactagccaaaggttgtcaagacacacccttgggcttatctacagagcacacttttctaacagtgaatctcctaattttagcatctttttttttttttacaatcattcagattgtgaattcaggctcagaatttacccagtcatcagatactgattccttttgtccacttatatagttattttctctttaaaaaaaaattttttttaatgtattagagatgaggtctcactctgtcacccaggctgcagtgtagtggtgcaaacatagctccctgtaacctcaaactcccaggctcaagggatcctcctgcatcagccttccaagtagctgggtctacaggtgcatgccaccatgcctggctaattttttgcatttttttgtagagacttgatcttgctatgttgtccaggctgctctcgaactcctagcctcaagcaatccacccatcttggcctcctaaagtgccggattacaggtgtaagccaccatgcccagcctgttttgtcaatgtatctgttttctgtcttattttactataagcactaagaagaaactaagctatatctctaacactagacttgaaaatttcctcagctaaacatccaagttcatcatttattcaacttttcacactactgtagtagacaatttagatagataaactttttgccactatatgacaaggattccctttcttccattttccaataaaatcttcatttccttctaaaccatcactagaaatgcctttaacattcatactactaccatctggtaaaggcaatctagttttttctatcacagccaccaaaattcttctagtctctacccattatccaattccaaagcctttttcacattttaagacatttgttacagaagtacccaatccgtcccagttccacaatctgcattagattcccatggctgctgtaacaaattaccctctagcccagtggcttaaaacaatagaaatttattatcttgttgttttggaggccaaaagtccaaaattgaggggttggcagggctgaacgtcttctggagactctaagggaaacactcttcccgtgtcttccagtttcttgtggctgccatcattccttggtttgtgactgcatctccctctcctctgtcttcacatcacttcccctctgtatatataatctacctctgcctctctcttataaggacacttgtgacgggacttagggcccatccagattacccatgataattcccttattccaagattcttaattatatctgaaaggaccttttttccaaataaggtactatcacaggttccagggagtaggatattgaatatcttttttggggagggggcaccatgcagctcactacactattcattgcacacaaatgaatttttcactttttaagatgcattcttggtgctcaaaccagatcgaagtttgtctctaaaagctattgtctgcacaggctgctgcatgctctgttgttaaatggatggacaggctattctaaattttggttgatacttttgctactatgggcaattaacttgaaaaaaataatcgatcccaactctgtgctctgatgtacctcttctgccccttttatgacacctttgaccaaatgccttctatggttcacagtgcaggcacaaaactacctctgatacagaagggttctttacaagcttattttacataccgtgaatccctcacctaaagggagaggtgaaagcaaagactgctttgaatgggtattgagggagattgtgtccataccaagccaccctgaagaagtatttcacttgcagtagaactgtggatttgtgctgtcatttcaccttggaataaacacctatctctaagcaggaccaagaatgacttgcaatctatatgtaatggctacttacttattcaataaagttaagatatacgttaaa

SEQ ID NO: 8275 - DNA, 3782 bp, Homo sapiens
ctcggctgcgggagtaggaagcagctttgcgcgcccgggcggccgatgcgggcactttgaagaatcacgtgtgttgaggccctcttaaagagataggcacctacttttccctccaccctaaacaccgccctgagggcggcggcgaccgtggtaattgcaactgctcaggggcagggcttgccccagcgccgagtagtggcaacggcgtggttgcgtcgggggtgcctgggagcctggagtcccgggggcctgaaatcggcagcttcccgggcagacactctctccctcaggaagaggtgccgccgagtcagcgcggggcagtgtgagcgccccgaggtgctttctcagttgaggagaggtggggttacagggcacaggtgacagggccggagaaagatggagcagcccggggcggcggcgtcgggagcgggaggcggcagcgaggaacccggtgggggccggagcaacaagcggagcgcggggaaccgggccgccaatgaagaggaaacgaaaaacaaacccaaattgaacattcaaataaaaactttggcagatgatgtgcgtgaccgaattacaagttttagaaaatctactgtcaaaaaagaaaaacctcttattcaacatcctattgattctcaagtcgcgatgagtgagtttcctgcagctcagccattatatgatgaacgatctttgaatttgtcagaaaaggaagtattggatctctttgaaaaaatgatggaggacatgaaccttaacgaagagaaaaaagctcctttacgaaacaaagactttaccaccaaacgtgagatggttgtccagtatatttctgccactgccaaatctggtgggctgaaaaacagcaaacatgaatgcaccctgtcttcacaagaatatgttcatgaattacgatcgggtatatcagatgagaaacttcttaattgcctagaatccctcagggtttctttaaccagcaatccggtcagctgggttaacaactttggccatgaaggtcttggactcttattggatgagctggaaaagcttctggacaaaaaacagcaagaaaatattgacaagaagaatcagtataaacttattcaatgcctcaaagcatttatgaataataagtttggattacaaaggattctaggagatgaaagaagtcttttactattggcaagagcaattgaccccaaacaacccaacatgatgactgaaatagtaaaaatactttctgctatttgcattgttggagaagagaacattctagataaacttttaggggctataacaacagcagcagaaagaaataacagggaacgattttcaccaattgtggaaggtttagaaaatcaggaagccttgcaattacaggtggcctgcatgcagtttataaatgcccttgtcacttctccttatgagcttgattttcgaatacatttaaggaatgaattcctccgttcaggactaaaaacaatgttaccagatctaaaagaaaaagagaatgatgagcttgatattcagttgaaagtatttgatgaaaacaaagaagatgacctaactgaattatcacaccgtctcaatgacattcgagcagaaatggatgatatgaatgaagtctaccatcttctatataatatgctgaaggacactgctgctgaaaattacttcttatctattctacaacattttttgcttatcagaaatgattattatatcaggccacaatattataaaataattgaggaatgtgtttcacagatagtgctacactgcagtggtatggatccagacttcaaatacaggcaaagattagacatcgatttaactcatctgatagattcttgtgtgaacaaggcgaaagttgaagaaagtgaacaaaaagctgcagagttttcaaagaagttcgatgaagaattcacagctcgacaggaagctcaagcagagcttcaaaaaagagatgagaaaatcaaagaacttgaagcagaaatccagcaacttcgaacccaggcacaagtactctcaagttcatcaggaattccaggtcctcctgcagcacctccattgccaggtgtagggccgcctccaccaccacccgcgccacctctacccggaggagctcctcttcctcctccaccacctcctttacctggaatgatggggataccaccaccacccccaccaccacttttatttgggggacctcctccaccaccaccccttggaggagttcctcctcccccaggaatatcacttaatctaccttatggaatgaagcagaaaaaaatgtataaacctgaagtgtccatgaagagaatcaattggtcaaagattgaacccacagaattatctgagaactgtttctggttaagagtcaaagaagacaagtttgagaatccagatctctttgccaaattggcattgaattttgctactcagataaaagttcaaaagaacgcagaagcattagaagaaaagaagactgggcctacaaagaagaaagtgaaagaactgagaattttggatcccaaaacagctcagaatctgtccatctttctgggatcatatcgcatgccatatgaagacataagaaacgttattctggaggttaatgaagacatgctgagtgaggctttaattcagaaccttgtgaaacatcttcctgagcagaagatactcaacgaattagcagagcttaagaatgaatatgatgacctctgtgagcctgaacaatttggagttgtgatgagctctgtgaaaatgttacagcctcgtctcagtagtatcctgttcaagctcacatttgaagaacacataaacaacatcaaaccaagcatcatagcagtaactcttgcctgtgaagaactgaagaaaagtgaaagctttaacagacttttagagttagttcttcttgttggaaactacatgaactcaggctcaagaaatgcccagtctttgggatttaagatcaacttcctttgtaagatcagagatactaaatcagcggatcaaaaaacaacccttttgcattttattgccgacatttgtgaggaaaaatatcgagatatcctaaaatttcctgaagaactggaacacgtagaaagtgcaagcaaagtttcagctcaaattctcaagagcaaccttgcatcaatggaacaacaaattgttcatctggaacgtgacatcaagaaattcccccaagcagaaaatcaacacgataagtttgtggaaaagatgaccatctttacaaagactgcccgagaacagtatgaaaaactctccaccatgcacaacaacatgatgaagctctatgagaatcttggagaatacttcatttttgactcaaagacagtgagcatagaagagttctttggtgatctcaacaacttccgaactttgtttttggaagcagtgagagaaaacaataagagaagagaaatggaagagaagaccaggagggcaaaacttgcaaaagagaaagctgaacaagaaaagttagaacgccagaagaaaaagaaacaactcattgatataaacaaagagggtgatgagactggtgtgatggataatcttctagaagccctacaatcaggtgcagcattcagagaccgtcgaaagcggattccaaggaatccagtggtaaatcatccctgtgcaacaagggctaatccaagatcagctacataaacggcctgagtgctgttttaaacaggattgggtgatggtacaacatgactttttaagataatcaagtagtaaaagtttctagtggaaacatgata

SEQ ID NO: 8276 - DNA, 3730 bp, Homo sapiens
gggcactttgaagaatcacgtgtgttgaggccctcttaaagagataggcacctacttttccctccaccctaaacaccgccctgagggcggcggcgaccgtggtaattgcaactgctcaggggcagggcttgccccagcgccgagtagtggcaacggcgtggttgcgtcgggggtgcctgggagcctggagtcccgggggcctgaaatcggcagcttcccgggcagacactctctccctcaggaagaggtgccgccgagtcagcgcggggcagtgtgagcgccccgaggtgctttctcagttgaggagaggtggggttacagggcacaggtgacagggccggagaaagatggagcagcccggggcggcggcgtcgggagcgggaggcggcagcgaggaacccggtgggggccggagcaacaagcggagcgcggggaaccgggccgccaatgaagaggaaacgaaaaacaaacccaaattgaacattcaaataaaaactttggcagatgatgtgcgtgaccgaattacaagttttagaaaatctactgtcaaaaaagaaaaacctcttattcaacatcctattgattctcaagtcgcgatgagtgagtttcctgcagctcagccattatatgatgaacgatctttgaatttgtcagaaaaggaagtattggatctctttgaaaaaatgatggaggacatgaaccttaacgaagagaaaaaagctcctttacgaaacaaagactttaccaccaaacgtgagatggttgtccagtatatttctgccactgccaaatctggtgggctgaaaaacagcaaacatgaatgcaccctgtcttcacaagaatatgttcatgaattacgatcgggtatatcagatgagaaacttcttaattgcctagaatccctcagggtttctttaaccagcaatccggtcagctgggttaacaactttggccatgaaggtcttggactcttattggatgagctggaaaagcttctggacaaaaaacagcaagaaaatattgacaagaagaatcagtataaacttattcaatgcctcaaagcatttatgaataataagtttggattacaaaggattctaggagatgaaagaagtcttttactattggcaagagcaattgaccccaaacaacccaacatgatgactgaaatagtaaaaatactttctgctatttgcattgttggagaagagaacattctagataaacttttaggggctataacaacagcagcagaaagaaataacagggaacgattttcaccaattgtggaaggtttagaaaatcaggaagccttgcaattacaggtggcctgcatgcagtttataaatgcccttgtcacttctccttatgagcttgattttcgaatacatttaaggaatgaattcctccgttcaggactaaaaacaatgttaccagatctaaaagaaaaagagaatgatgagcttgatattcagttgaaagtatttgatgaaaacaaagaagatgacctaactgaattatcacaccgtctcaatgacattcgagcagaaatggatgatatgaatgaagtctaccatcttctatataatatgctgaaggacactgctgctgaaaattacttcttatctattctacaacattttttgcttatcagaaatgattattatatcaggccacaatattataaaataattgaggaatgtgtttcacagatagtgctacactgcagtggtatggatccagacttcaaatacaggcaaagattagacatcgatttaactcatctgatagattcttgtgtgaacaaggcgaaagttgaagaaagtgaacaaaaagctgcagagttttcaaagaagttcgatgaagaattcacagctcgacaggaagctcaagcagagcttcaaaaaagagatgagaaaatcaaagaacttgaagcagaaatccagcaacttcgaacccaggcacaagtactctcaagttcatcaggaattccaggtcctcctgcagcacctccattgccaggtgtagggccgcctccaccaccacccgcgccacctctacccggaggagctcctcttcctcctccaccacctcctttacctggaatgatggggataccaccaccacccccaccaccacttttatttgggggacctcctccaccaccaccccttggaggagttcctcctcccccaggaatatcacttaatctaccttatggaatgaagcagaaaaaaatgtataaacctgaagtgtccatgaagagaatcaattggtcaaagattgaacccacagaattatctgagaactgtttctggttaagagtcaaagaagacaagtttgagaatccagatctctttgccaaattggcattgaattttgctactcagataaaagttcaaaagaacgcagaagcattagaagaaaagaagactgggcctacaaagaagaaagtgaaagaactgagaattttggatcccaaaacagctcagaatctgtccatctttctgggatcatatcgcatgccatatgaagacataagaaacgttattctggaggttaatgaagacatgctgagtgaggctttaattcagaaccttgtgaaacatcttcctgagcagaagatactcaacgaattagcagagcttaagaatgaatatgatgacctctgtgagcctgaacaatttggagttgtgatgagctctgtgaaaatgttacagcctcgtctcagtagtatcctgttcaagctcacatttgaagaacacataaacaacatcaaaccaagcatcatagcagtaactcttgcctgtgaagaactgaagaaaagtgaaagctttaacagacttttagagttagttcttcttgttggaaactacatgaactcaggctcaagaaatgcccagtctttgggatttaagatcaacttcctttgtaagatcagagatactaaatcagcggatcaaaaaacaacccttttgcattttattgccgacatttgtgaggaaaaatatcgagatatcctaaaatttcctgaagaactggaacacgtagaaagtgcaagcaaagtttcagctcaaattctcaagagcaaccttgcatcaatggaacaacaaattgttcatctggaacgtgacatcaagaaattcccccaagcagaaaatcaacacgataagtttgtggaaaagatgaccagctttacaaagactgcccgagaacagtatgaaaaactctccaccatgcacaacaacatgatgaagctctatgagaatcttggagaatacttcatttttgactcaaagacagtgagcatagaagagttctttggtgatctcaacaacttccgaactttgtttttggaagcagtgagagaaaacaataagagaagagaaatggaagagaagaccaggagggcaaaacttgcaaaagagaaagctgaacaagaaaagttagaacgccagaagaaaaagaaacaactcattgatataaacaaagagggtgatgagactggtgtgatggataatcttctagaagccctacaatcaggtgcagcattcagagaccgtcgaaagcggattccaaggaatccagtggtaaatcatccctgtgcaacaagggctaatccaagatcagctacataaacggcctgagtgctgttttaaacaggattgggtgatggtacaacatgactttttaagataatcaagtagtaaaagtttctagtggaaacatg

SEQ ID NO: 8277 - DNA, 3690 bp, Homo sapiens
ctcggctgcgggagtaggaagcagctttgcgcgcccgggcggccgatgcgggcactttgaagaatcacgtgtgttgaggccctcttaaagagataggcacctacttttccctccaccctaaacaccgccctgagggcggcggcgaccgtggtaattgcaactgctcaggggcagggcttgccccagcgccgagtagtggcaacggcgtggttgcgtcgggggtgcctgggagcctggagtcccgggggcctgaaatcggcagcttcccgggcagacactctctccctcaggaagaggtgccgccgagtcagcgcggggcagtgtgagcgccccgaggtgctttctcagttgaggagaggtggggttacagggcacaggtgacagggccggagaaagatggagcagcccggggcggcggcgtcgggagcgggaggcggcagcgaggaacccggtgggggccggagcaacaagcggagcgcggggaaccgggccgccaatgaagaggaaacgaaaaacaaacccaaattgcgtgaccgaattacaagttttagaaaatctactgtcaaaaaagaaaaacctcttattcaacatcctattgattctcaagtcgcgatgagtgagtttcctgcagctcagccattatatgatgaacgatctttgaatttgtcagaaaaggaagtattggatctctttgaaaaaatgatggaggacatgaaccttaacgaagagaaaaaagctcctttacgaaacaaagactttaccaccaaacgtgagatggttgtccagtatatttctgccactgccaaatctgtaatatcctcacatattaagggtgggctgaaaaacagcaaacatgaatgcaccctgtcttcacaagaatatgttcatgaattacgatcgggtatatcagatgagaaacttcttaattgcctagaatccctcagggtttctttaaccagcaatccggtcagctgggttaacaactttggccatgaaggtcttggactcttattggatgagctggaaaagcttctggacaaaaaacagcaagaaaatattgacaagaagaatcagtataaacttattcaatgcctcaaagcatttatgaataataagtttggattacaaaggattctaggagatgaaagaagtcttttactattggcaagagcaattgaccccaaacaacccaacatgatgactgaaatagtaaaaatactttctgctatttgcattgttggagaagagaacattctagataaacttttaggggctataacaacagcagcagaaagaaataacagggaacgattttcaccaattgtggaaggtttagaaaatcaggaagccttgcaattacaggtggcctgcatgcagtttataaatgcccttgtcacttctccttatgagcttgattttcgaatacatttaaggaatgaattcctccgttcaggactaaaaacaatgttaccagatctaaaagaaaaagagaatgatgagcttgatattcagttgaaagtatttgatgaaaacaaagaagatgacctaactgaattatcacaccgtctcaatgacattcgagcagaaatggatgatatgaatgaagtctaccatcttctatataatatgctgaaggacactgctgctgaaaattacttcttatctattctacaacattttttgcttatcagaaatgattattatatcaggccacaatattataaaataattgaggaatgtgtttcacagatagtgctacactgcagtggtatggatccagacttcaaatacaggcaaagattagacatcgatttaactcatctgatagattcttgtgtgaacaaggcgaaagttgaagaaagtgaacaaaaagctgcagagttttcaaagaagttcgatgaagaattcacagctcgacaggaagctcaagcagagcttcaaaaaagagatgagaaaatcaaagaacttgaagcagaaatccagcaacttcgaacccaggcacaagtactctcaagttcatcaggaattccaggtcctcctgcagcacctccattgccaggtgtagggccgcctccaccaccacccgcgccacctctacccggaggagctcctcttcctcctccaccacctcctttacctggaatgatggggataccaccaccacccccaccaccacttttatttgggggacctcctccaccaccaccccttggaggagttcctcctcccccaggaatatcacttaatctaccttatggaatgaagcagaaaaaaatgtataaacctgaagtgtccatgaagagaatcaattggtcaaagattgaacccacagaattatctgagaactgtttctggttaagagtcaaagaagacaagtttgagaatccagatctctttgccaaattggcattgaattttgctactcagataaaagttcaaaagaacgcagaagcattagaagaaaagaagactgggcctacaaagaagaaagtgaaagaactgagaattttggatcccaaaacagctcagaatctgtccatctttctgggatcatatcgcatgccatatgaagacataagaaacgttattctggaggttaatgaagacatgctgagtgaggctttaattcagaaccttgtgaaacatcttcctgagcagaagatactcaacgaattagcagagcttaagaatgaatatgatgacctctgtgagcctgaacaatttggagttgtgatgagctctgtgaaaatgttacagcctcgtctcagtagtatcctgttcaagctcacatttgaagaacacataaacaacatcaaaccaagcatcatagcagtaactcttgcctgtgaagaactgaagaaaagtgaaagctttaacagacttttagagttagttcttcttgttggaaactacatgaactcaggctcaagaaatgcccagtctttgggatttaagatcaacttcctttgtaagatcagagatactaaatcagcggatcaaaaaacaacccttttgcattttattgccgacatttgtgaggaaaaatatcgagatatcctaaaatttcctgaagaactggaacacgtagaaagtgcaagcaaagtttcagctcaaattctcaagagcaaccttgcatcaatggaacaacaaattgttcatctggaacgtgacatcaagaaattcccccaagcagaaaatcaacacgataagtttgtggaaaagatgaccatctttacaaagactgcccgagaacagtatgaaaaactctccaccatgcacaacaacatgatgaagctctatgagaatcttggagaatacttcatttttgactcaaagacagtgagcatagaagagttctttggtgatctcaacaacttccgaactttgtttttggaagcagtgagagaaaacaataagagaagagaaatggaagagaagaccaggagggcaaaacttgcaaaagagaaagctgaacaagaaaagttagaacgccagaagaaaaagaaacaactcattgatataaacaaagagggtgatgagactggtgtgatggataatcttctagaagccctacaatcaggtgcagcattcagagaccgtcgaaagcggattccaaggaatccagataacagacgagtacctttggaaaggtcacgctctcgccacaatggagctatctcatctaagtga

SEQ ID NO: 8278 - DNA, 4983 bp, Homo sapiens
ctcggctgcgggagtaggaagcagctttgcgcgcccgggcggccgatgcgggcactttgaagaatcacgtgtgttgaggccctcttaaagagataggcacctacttttccctccaccctaaacaccgccctgagggcggcggcgaccgtggtaattgcaactgctcaggggcagggcttgccccagcgccgagtagtggcaacggcgtggttgcgtcgggggtgcctgggagcctggagtcccgggggcctgaaatcggcagcttcccgggcagacactctctccctcaggaagaggtgccgccgagtcagcgcggggcagtgtgagcgccccgaggtgctttctcagttgaggagaggtggggttacagggcacaggtgacagggccggagaaagatggagcagcccggggcggcggcgtcgggagcgggaggcggcagcgaggaacccggtgggggccggagcaacaagcggagcgcggggaaccgggccgccaatgaagaggaaacgaaaaacaaacccaaattgaacattcaaataaaaactttggcagatgatgtgcgtgaccgaattacaagttttagaaaatctactgtcaaaaaagaaaaacctcttattcaacatcctattgattctcaagtcgcgatgagtgagtttcctgcagctcagccattatatgatgaacgatctttgaatttgtcagaaaaggaagtattggatctctttgaaaaaatgatggaggacatgaaccttaacgaagagaaaaaagctcctttacgaaacaaagactttaccaccaaacgtgagatggttgtccagtatatttctgccactgccaaatctggtgggctgaaaaacagcaaacatgaatgcaccctgtcttcacaagaatatgttcatgaattacgatcgggtatatcagatgagaaacttcttaattgcctagaatccctcagggtttctttaaccagcaatccggtcagctgggttaacaactttggccatgaaggtcttggactcttattggatgagctggaaaagcttctggacaaaaaacagcaagaaaatattgacaagaagaatcagtataaacttattcaatgcctcaaagcatttatgaataataagtttggattacaaaggattctaggagatgaaagaagtcttttactattggcaagagcaattgaccccaaacaacccaacatgatgactgaaatagtaaaaatactttctgctatttgcattgttggagaagagaacattctagataaacttttaggggctataacaacagcagcagaaagaaataacagggaacgattttcaccaattgtggaaggtttagaaaatcaggaagccttgcaattacaggtggcctgcatgcagtttataaatgcccttgtcacttctccttatgagcttgattttcgaatacatttaaggaatgaattcctccgttcaggactaaaaacaatgttaccagatctaaaagaaaaagagaatgatgagcttgatattcagttgaaagtatttgatgaaaacaaagaagatgacctaactgaattatcacaccgtctcaatgacattcgagcagaaatggatgatatgaatgaagtctaccatcttctatataatatgctgaaggacactgctgctgaaaattacttcttatctattctacaacattttttgcttatcagaaatgattattatatcaggccacaatattataaaataattgaggaatgtgtttcacagatagtgctacactgcagtggtatggatccagacttcaaatacaggcaaagattagacatcgatttaactcatctgatagattcttgtgtgaacaaggcgaaagttgaagaaagtgaacaaaaagctgcagagttttcaaagaagttcgatgaagaattcacagctcgacaggaagctcaagcagagcttcaaaaaagagatgagaaaatcaaagaacttgaagcagaaatccagcaacttcgaacccaggcacaagtactctcaagttcatcaggaattccaggtcctcctgcagcacctccattgccaggtgtagggccgcctccaccaccacccgcgccacctctacccggaggagctcctcttcctcctccaccacctcctttacctggaatgatggggataccaccaccacccccaccaccacttttatttgggggacctcctccaccaccaccccttggaggagttcctcctcccccaggaatatcacttaatctaccttatggaatgaagcagaaaaaaatgtataaacctgaagtgtccatgaagagaatcaattggtcaaagattgaacccacagaattatctgagaactgtttctggttaagagtcaaagaagacaagtttgagaatccagatctctttgccaaattggcattgaattttgctactcagataaaagttcaaaagaacgcagaagcattagaagaaaagaagactgggcctacaaagaagaaagtgaaagaactgagaattttggatcccaaaacagctcagaatctgtccatctttctgggatcatatcgcatgccatatgaagacataagaaacgttattctggaggttaatgaagacatgctgagtgaggctttaattcagaaccttgtgaaacatcttcctgagcagaagatactcaacgaattagcagagcttaagaatgaatatgatgacctctgtgagcctgaacaatttggagttgtgatgagctctgtgaaaatgttacagcctcgtctcagtagtatcctgttcaagctcacatttgaagaacacataaacaacatcaaaccaagcatcatagcagtaactcttgcctgtgaagaactgaagaaaagtgaaagctttaacagacttttagagttagttcttcttgttggaaactacatgaactcaggctcaagaaatgcccagtctttgggatttaagatcaacttcctttgtaagatcagagatactaaatcagcggatcaaaaaacaacccttttgcattttattgccgacatttgtgaggaaaaatatcgagatatcctaaaatttcctgaagaactggaacacgtagaaagtgcaagcaaagtttcagctcaaattctcaagagcaaccttgcatcaatggaacaacaaattgttcatctggaacgtgacatcaagaaattcccccaagcagaaaatcaacacgataagtttgtggaaaagatgaccatctttacaaagactgcccgagaacagtatgaaaaactctccaccatgcacaacaacatgatgaagctctatgagaatcttggagaatacttcatttttgactcaaagacagtgagcatagaagagttctttggtgatctcaacaacttccgaactttgtttttggaagcagtgagagaaaacaataagagaagagaaatggaagagaagaccaggagggcaaaacttgcaaaagagaaagctgaacaagaaaagttagaacgccagaagaaaaagaaacaactcattgatataaacaaagagggtgatgagactggtgtgatggataatcttctagaagccctacaatcaggtgcagcattcagagaccgtcgaaagcggattccaaggaatccagataacagacgagtacctttggaaaggtcacgctctcgccacaatggagctatctcatctaagtgattcctgatgccaaagaatatgaaaatatttaagtaaaaacaaaatgatgcattttgagaagaacaaagtgtgcactcagcggctggaaaggaaataagtgcatttctgcaaagatcaagataagctggatgaagtagtgtgcatttgtaatactattgcaagactcctcccacaattattctaatctgaacacagttatcaggattacaaaatgtgttccattttagtgtaaagatgtgtatcatttgtaattgtgtgtgacctgactgtgatgatggaagtgtaagaaattgaagagttctaaggctttcaaaaacactcagtcaaaaatttaaaatcttaaatgtgtaagtcacccccaccaaaaacaaaagagaagaaaaagaatagaaagaattatccagtgtcagcttccaatccctagtacatatataatagaaaagggccaagaaaaatatgcatcttgatttggagagaggctaatattatgcacactgtaagagaagccattttggaaattcacgaaagtactgctccaccccagttgagttatttagaattttatctcaagtgaaagctgatggattcatctgctttggctgaaattaaacttatcattagtctagctagcatttcagcatgatattgcaagcacttctcattgctaaaaataaataaaccaaagtttaaccgaatcagttagggaaagtgatttaaactttatttaaagaggtattttctaattatgcacagatatctactttatacaaatactttatatggctatttttgagaaaaccctcacattttaatgtttatgctagggatgaacctgaaaattctattacgtttatttagatttcaaaggcaaatattgattcctatgctctgtggtttatttcttttttctattgcttctttctcccttgagtcccttgaaggcagggaatagacttctagaaaacctgagaggaaaaagaattctttttacaggaggcagcagaaaactgtctgaaaggtcaattgttttatctccctttccactctctttccaatttcactttggtggtctgaagaagaaaaagaaattttatgtatgtatgtgtaaatatgtgtatatatttctatctcttgctacaataattccaactaagtgaacttctcaattatcatcatacttacttaccttatattaacaaattaagatgatgctgccaaaacaagtctagcagggaaaacaggttctacatttttcttaaataaattagggagtaaaagtta

SEQ ID NO: 8279 - DNA, 3376 bp, Homo sapiens
agaggtggggttacagggcacaggtgacagggccggagaaagatggagcagcccggggcggcggcgtcgggagcgggaggcggcagcgaggaacccggtgggggccggagcaacaagcggagcgcggggaaccgggccgccaatgaagaggaaacgaaaaacaaacccaaattgaacattcaaataaaaactttggcagatgatgtgcgtgaccgaattacaagttttagaaaatctactgtcaaaaaagaaaaacctcttattcaacatcctattgattctcaagtcgcgatgagtgagtttcctgcagctcagccattatatgatgaacgatctttgaatttgtcagaaaaggaagtattggatctctttgaaaaaatgatggaggacatgaaccttaacgaagagaaaaaagctcctttacgaaacaaagactttaccaccaaacgtgagatggttgtccagtatatttctgccactgccaaatctatagttggaagtaaagttacgggtgggctgaaaaacagcaaacatgaatgcaccctgtcttcacaagaatatgttcatgaattacgatcgggtatatcagatgagaaacttcttaattgcctagaatccctcagggtttctttaaccagcaatccggtcagctgggttaacaactttggccatgaaggtcttggactcttattggatgagctggaaaagcttctggacaaaaaacagcaagaaaatattgacaagaagaatcagtataaacttattcaatgcctcaaagcatttatgaataataagtttggattacaaaggattctaggagatgaaagaagtcttttactattggcaagagcaattgaccccaaacaacccaacatgatgactgaaatagtaaaaatactttctgctatttgcattgttggagaagagaacattctagataaacttttaggggctataacaacagcagcagaaagaaataacagggaacgattttcaccaattgtggaaggtttagaaaatcaggaagccttgcaattacaggtggcctgcatgcagtttataaatgcccttgtcacttctccttatgagcttgattttcgaatacatttaaggaatgaattcctccgttcaggactaaaaacaatgttaccagatctaaaagaaaaagagaatgatgagcttgatattcagttgaaagtatttgatgaaaacaaagaagatgacctaactgaattatcacaccgtctcaatgacattcgagcagaaatggatgatatgaatgaagtctaccatcttctatataatatgctgaaggacactgctgctgaaaattacttcttatctattctacaacattttttgcttatcagaaatgattattatatcaggccacaatattataaaataattgaggaatgtgtttcacagatagtgctacactgcagtggtatggatccagacttcaaatacaggcaaagattagacatcgatttaactcatctgatagattcttgtgtgaacaaggcgaaagttgaagaaagtgaacaaaaagctgcagagttttcaaagaagttcgatgaagaattcacagctcgacaggaagctcaagcagagcttcaaaaaagagatgagaaaatcaaagaacttgaagcagaaatccagcaacttcgaacccaggcacaagtactctcaagttcatcaggaattccaggtcctcctgcagcacctccattgccaggtgtagggccgcctccaccaccacccgcgccacctctacccggaggagctcctcttcctcctccaccacctcctttacctggaatgatggggataccaccaccacccccaccaccacttttatttgggggacctcctccaccaccaccccttggaggagttcctcctcccccaggaatatcacttaatctaccttatggaatgaagcagaaaaaaatgtataaacctgaagtgtccatgaagagaatcaattggtcaaagattgaacccacagaattatctgagaactgtttctggttaagagtcaaagaagacaagtttgagaatccagatctctttgccaaattggcattgaattttgctactcagataaaagttcaaaagaacgcagaagcattagaagaaaagaagactgggcctacaaagaagaaagtgaaagaactgagaattttggatcccaaaacagctcagaatctgtccatctttctgggatcatatcgcatgccatatgaagacataagaaacgttattctggaggttaatgaagacatgctgagtgaggctttaattcagaaccttgtgaaacatcttcctgagcagaagatactcaacgaattagcagagcttaagaatgaatatgatgacctctgtgagcctgaacaatttggagttgtgatgagctctgtgaaaatgttacagcctcgtctcagtagtatcctgttcaagctcacatttgaagaacacataaacaacatcaaaccaagcatcatagcagtaactcttgcctgtgaagaactgaagaaaagtgaaagctttaacagacttttagagttagttcttcttgttggaaactacatgaactcaggctcaagaaatgcccagtctttgggatttaagatcaacttcctttgtaagatcagagatactaaatcagcggatcaaaaaacaacccttttgcattttattgccgacatttgtgaggaaaaatatcgagatatcctaaaatttcctgaagaactggaacacgtagaaagtgcaagcaaagtttcagctcaaattctcaagagcaaccttgcatcaatggaacaacaaattgttcatctggaacgtgacatcaagaaattcccccaagcagaaaatcaacacgataagtttgtggaaaagatgaccatctttacaaagactgcccgagaacagtatgaaaaactctccaccatgcacaacaacatgatgaagctctatgagaatcttggagaatacttcatttttgactcaaagacagtgagcatagaagagttctttggtgatctcaacaacttccgaactttgtttttggaagcagtgagagaaaacaataagagaagagaaatggaagagaagaccaggagggcaaaacttgcaaaagagaaagctgaacaagaaaagttagaacgccagaagaaaaagaaacaactcattgatataaacaaagagggtgatgagactggtgtgatggataatcttctagaagccctacaatcaggtgcagcattcagagaccgtcgaaagcggattccaaggaatccagtggtaaatcatccctgtgcaacaagggctaatccaagatcagctacataaacggcctgagtgctgttttaaa

SEQ ID NO: 8280 - DNA, 829 bp, Homo sapiens
ggagactgcgccgacatggagctgttcctcgcgggccgccgggtgctggtcaccggggcaggcaaaggtatagggcgcggcacggtccaggcgctgcacgcgacgggcgcgcgggtggtggctgtgagccggactcaggcggatcttgacagccttgtccgcgagtgcccggggatagaacccgtgtgcgtggacctgggtgactgggaggccaccgagcgggcgctgggcagcgtgggccccgtggacctgctggtgaacaacgccgctgtcgccctgctgcagcccttcctggaggtcaccaaggaggcctttgacagatcctttgaggtgaacctgcgtgcggtcatccaggtgtcgcagattgtggccaggggcttaatagcccggggagtcccaggggccatcgtgaatgtctccagccagtgctcccagcgggcagtaactaaccatagcgtctactgctccaccaagggtgccctggacatgctgaccaaggtgatggccctagagctcgggccccacaagatccgagtgaatgcagtaaaccccacagtggtgatgacgtccatgggccaggccacctggagtgacccccacaaggccaagactatgctgaaccgaatcccacttggcaagtttgctgaggtagagcacgtggtgaacgccatcctctttctgctgagtgaccgaagtggcatgaccacgggttccactttgccggtggaagggggcttctgggcctgctgagctccctccacacacctcaagccccatgccgtgctcatcctacccccaatccctccaataaacctgattctgctgccca

SEQ ID NO: 8281 - DNA, 10277 bp, Homo sapiens
cggaggcgcggcgcaggctgctgcaggcccaggtgaatggagtaacctgacagcggggacgaggcgacggcgagcgcgaggaaatggcggcgggggcggcggcgccgggcggctccgggaggcctgggctgtgacgcgcgcgccggagcggggtccgatggttctcgaaggcccgcggcgccccgtgctgcagtaagctgtgctagaacaaaaatgcaatgaaagaaacactggatgaatgaaaagccctgctttgcaacccctcagcatggcaggcctgcagctcatgacccctgcttcctcaccaatgggtcctttctttggactgccatggcaacaagaagcaattcatgataacatttatacgccaagaaaatatcaggttgaactgcttgaagcagctctggatcataataccatcgtctgtttaaacactggctcagggaagacatttattgcagtactactcactaaagagctgtcctatcagatcaggggagacttcagcagaaatggaaaaaggacggtgttcttggtcaactctgcaaaccaggttgctcaacaagtgtcagctgtcagaactcattcagatctcaaggttggggaatactcaaacctagaagtaaatgcatcttggacaaaagagagatggaaccaagagtttactaagcaccaggttctcattatgacttgctatgtcgccttgaatgttttgaaaaatggttacttatcactgtcagacattaaccttttggtgtttgatgagtgtcatcttgcaatcctagaccacccctatcgagaaattatgaagctctgtgaaaattgtccatcatgtcctcgcattttgggactaactgcttccattttaaatgggaaatgtgatccagaggaattggaagaaaagattcagaaactagagaaaattcttaagagtaatgctgaaactgcaactgacctggtggtcttagacaggtatacttctcagccatgtgagattgtggtggattgtggaccatttactgacagaagtgggctttatgaaagactgctgatggaattagaagaagcacttaattttatcaatgattgtaatatatctgtacattcaaaagaaagagattctactttaatttcgaaacagatactatcagactgtcgtgccgtattggtagttctgggaccctggtgtgcagataaagtagctggaatgatggtaagagaactacagaaatacatcaaacatgagcaagaggagctgcacaggaaatttttattgtttacagacactttcctaaggaaaatacatgcactatgtgaagagcacttctcacctgcctcacttgacctgaaatttgtaactcctaaagtaatcaaactgctcgaaatcttacgcaaatataaaccatatgagcgacagcagtttgaaagcgttgagtggtataataatagaaatcaggataattatgtgtcatggagtgattctgaggatgatgatgaggatgaagaaattgaagaaaaagagaagccagagacaaattttccttctccttttaccaacattttgtgcggaattatttttgtggaaagaagatacacagcagttgtcttaaacagattgataaaggaagctggcaaacaagatccagagctggcttatatcagtagcaatttcataactggacatggcattgggaagaatcagcctcgcaacaaacagatggaagcagaattcagaaaacaggaagaggtacttaggaaatttcgagcacatgagaccaacctgcttattgcaacaagtattgtagaagagggtgttgatataccaaaatgcaacttggtggttcgttttgatttgcccacagaatatcgatcctatgttcaatctaaaggaagagcaagggcacccatctctaattatataatgttagcggatacagacaaaataaaaagttttgaagaagaccttaaaacctacaaagctattgaaaagatcttgagaaacaagtgttccaagtcggttgatactggtgagactgacattgatcctgtcatggatgatgatgacgttttcccaccatatgtgttgaggcctgacgatggtggtccacgagtcacaatcaacacggccattggacacatcaatagatactgtgctagattaccaagtgatccgtttactcatctagctcctaaatgcagaacccgagagttgcctgatggtacattttattcaactctttatctgccaattaactcacctcttcgagcctccattgttggtccaccaatgagctgtgtacgattggctgaaagagttgtagctctcatttgctgtgagaaactgcacaaaattggcgaactggatgaccatttgatgccagttgggaaagagactgttaaatatgaagaggagcttgatttgcatgatgaagaagagaccagtgttccaggaagaccaggttccacgaaacgaaggcagtgctacccaaaagcaattccagagtgtttgagggatagttatcccagacctgatcagccctgttacctgtatgtgataggaatggttttaactacacctttacctgatgaactcaactttagaaggcggaagctctatcctcctgaagataccacaagatgctttggaatactgacggccaaacccatacctcagattccacactttcctgtgtacacacgctctggagaggttaccatatccattgagttgaagaagtctggtttcatgttgtctctacaaatgcttgagttgattacaagacttcaccagtatatattctcacatattcttcggcttgaaaaacctgcactagaatttaaacctacagacgctgattcagcatactgtgttctacctcttaatgttgttaatgactccagcactttggatattgactttaaattcatggaagatattgagaagtctgaagctcgcataggcattcccagtacaaagtatacaaaagaaacaccctttgtttttaaattagaagattaccaagatgccgttatcattccaagatatcgcaattttgatcagcctcatcgattttatgtagctgatgtgtacactgatcttaccccactcagtaaatttccttcccctgagtatgaaacttttgcagaatattataaaacaaagtacaaccttgacctaaccaatctcaaccagccactgctggatgtggaccacacatcttcaagacttaatcttttgacacctcgacatttgaatcagaaggggaaagcgcttcctttaagcagtgctgagaagaggaaagccaaatgggaaagtctgcagaataaacagatactggttccagaactctgtgctatacatccaattccagcatcactgtggagaaaagctgtttgtctccccagcatactttatcgccttcactgccttttgactgcagaggagctaagagcccagactgccagcgatgctggcgtgggagtcagatcacttcctgcggattttagataccctaacttagacttcgggtggaaaaaatctattgacagcaaatctttcatctcaatttctaactcctcttcagctgaaaatgataattactgtaagcacagcacaattgtccctgaaaatgctgcacatcaaggtgctaatagaacctcctctctagaaaatcatgaccaaatgtctgtgaactgcagaacgttgctcagcgagtcccctggtaagctccacgttgaagtttcagcagatcttacagcaattaatggtctttcttacaatcaaaatctcgccaatggcagttatgatttagctaacagagacttttgccaaggaaatcagctaaattactacaagcaggaaatacccgtgcaaccaactacctcatattccattcagaatttatacagttacgagaaccagccccagcccagcgatgaatgtactctcctgagtaataaataccttgatggaaatgctaacaaatctacctcagatggaagtcctgtgatggccgtaatgcctggtacgacagacactattcaagtgctcaagggcaggatggattctgagcagagcccttctattgggtactcctcaaggactcttggccccaatcctggacttattcttcaggctttgactctgtcaaacgctagtgatggatttaacctggagcggcttgaaatgcttggcgactcctttttaaagcatgccatcaccacatatctattttgcacttaccctgatgcgcatgagggccgcctttcatatatgagaagcaaaaaggtcagcaactgtaatctgtatcgccttggaaaaaagaagggactacccagccgcatggtggtgtcaatatttgatccccctgtgaattggcttcctcctggttatgtagtaaatcaagacaaaagcaacacagataaatgggaaaaagatgaaatgacaaaagactgcatgctggcgaatggcaaactggatgaggattacgaggaggaggatgaggaggaggagagcctgatgtggagggctccgaaggaagaggctgactatgaagatgatttcctggagtatgatcaggaacatatcagatttatagataatatgttaatggggtcaggagcttttgtaaagaaaatctctctttctcctttttcaaccactgattctgcatatgaatggaaaatgcccaaaaaatcctccttaggtagtatgccattttcatcagattttgaggattttgactacagctcttgggatgcaatgtgctatctggatcctagcaaagctgttgaagaagatgactttgtggtggggttctggaatccatcagaagaaaactgtggtgttgacacgggaaagcagtccatttcttacgacttgcacactgagcagtgtattgctgacaaaagcatagcggactgtgtggaagccctgctgggctgctatttaaccagctgtggggagagggctgctcagcttttcctctgttcactggggctgaaggtgctcccggtaattaaaaggactgatcgggaaaaggccctgtgccctactcgggagaatttcaacagccaacaaaagaacctttcagtgagctgtgctgctgcttctgtggccagttcacgctcttctgtattgaaagactcggaatatggttgtttgaagattccaccaagatgtatgtttgatcatccagatgcagataaaacactgaatcaccttatatcggggtttgaaaattttgaaaagaaaatcaactacagattcaagaataaggcttaccttctccaggcttttacacatgcctcctaccactacaatactatcactgattgttaccagcgcttagaattcctgggagatgcgattttggactacctcataaccaagcacctttatgaagacccgcggcagcactccccgggggtcctgacagacctgcggtctgccctggtcaacaacaccatctttgcatcgctggctgtaaagtacgactaccacaagtacttcaaagctgtctctcctgagctcttccatgtcattgatgactttgtgcagtttcagcttgagaagaatgaaatgcaaggaatggattctgagcttaggagatctgaggaggatgaagagaaagaagaggatattgaagttccaaaggccatgggggatatttttgagtcgcttgctggtgccatttacatggatagtgggatgtcactggagacagtctggcaggtgtactatcccatgatgcggccactaatagaaaagttttctgcaaatgtaccccgttcccctgtgcgagaattgcttgaaatggaaccagaaactgccaaatttagcccggctgagagaacttacgacgggaaggtcagagtcactgtggaagtagtaggaaaggggaaatttaaaggtgttggtcgaagttacaggattgccaaatctgcagcagcaagaagagccctccgaagcctcaaagctaatcaacctcaggttcccaatagctgaaaccgctttttaaaattcaaaacaagaaacaaaacaaaaaaaattaaggggaaaattatttaaatcggaaaggaagacttaaagttgttagtgagtggaatgaattgaaggcagaatttaaagtttggttgataacaggatagataacagaataaaacatttaacatatgtataaaattttggaactaattgtagttttagttttttgcgcaaacacaatcttatcttctttcctcacttctgctttgtttaaatcacaagagtgctttaatgatgacatttagcaagtgctcaaaataattgacaggttttgtttttttttttttgagtttatgtcagctttgcttagtgttagaaggccatggagcttaaacctccagcagtccctaggatgatgtagattcttctccatctctccgtgtgtgcagtagtgccagtcctgcagtagttgataagctgaatagaaagataaggttttcgagaggagaagtgcgccaatgttgtcttttctttccacgttatactgtgtaaggtgatgttcccggtcgctgttgcacctgatagtaagggacagatttttaatgaacattggctggcatgttggtgaatcacattttagttttctgatgccacatagtcttgcataaaaaagggttcttgccttaaaagtgaaaccttcatggatagtctttaatctctgatctttttggaacaaactgttttacattcctttcattttattatgcattagacgttgagacagcgtgatacttacaactcactagtatagttgtaacttattacaggatcatactaaaatttctgtcatatgtatactgaagacattttaaaaaccagaatatgtagtctacggatattttttatcataaaaatgatctttggctaaacaccccattttactaaagtcctcctgccaggtagttcccactgatggaaatgtttatggcaaataattttgccttctaggctgttgctctaacaaaataaaccttagacatatcacacctaaaatatgctgcagattttataattgattggttacttatttaagaagcaaaacacagcacctttacccttagtctcctcacataaatttcttactatacttttcataatgttgcatgcatatttcacctaccaaagctgtgctgttaatgccgtgaaagtttaacgtttgcgataaactgccgtaattttgatacatctgtgatttaggtcattaatttagataaactagctcattatttccatctttggaaaaggaaaaaaaaaaaaacttctttaggcatttgcctaagtttctttaattagacttgtaggcactcttcacttaaatacctcagttcttcttttcttttgcatgcatttttcccctgtttggtgctatgtttatgtattatgcttgaaattttaatttttttttttttgcactgtaactataatacctcttaatttacctttttaaaagctgtgggtcagtcttgcactcccatcaacataccagtagaggtttgctgcaatttgccccgttaattatgcttgaagtttaagaaagctgagcagaggtgtctcatatttcccagcacatgattctgaacttgatgcttcgtggaatgctgcatttatatgtaagtgacatttgaatactgtccttcctgctttatctgcatcatccacccacagagaaatgcctctgtgcgagtgcaccgacagaaaactgtcagctctgctttctaaggaaccctgagtgaggggggtattaagcttctccagtgttttttgttgtctccaatcttaaacttaaattgagatctaaattattaaacgagtttttgagcaaattaggtgacttgttttaaaaatatttaattccgatttggaaccttagatgtctatttgattttttaaaaaaccttaatgtaagatatgaccagttaaaacaaagcaattcttgaattatataactgtaaaagtgtgcagttaacaaggctggatgtgaattttattctgagggtgatttgtgatcaagtttaatcacaaatctcttaatatttataaactacctgatgccaggagcttagggctttgcattgtgtctaatacattgatcccagtgttacgggattctcttgattcctggcaccaaaatcagattgttttcacagttatgattcccagtgggagaaaaatgcctcaatatatttgtaaccttaagaagagtatttttttgttaatactaagatgttcaaacttagacatgattaggtcatacattctcaggggttcaaatttccttctaccattcaaatgttttatcaacagcaaacttcagccgtttcactttttgttggagaaaaatagtagattttaatttgactcacagtttgaagcattctgtgatcccctggttactgagttaaaaaataaaaaagtacgagttagacatatgaaatggttatgaacgcttttgtgctgctgatttttaatgctgtaaagttttcctgtgtttagcttgttgaaatgttttgcatctgtcaattaaggaaaaaaaaaatcactctatgttgccccactttagagccctgtgtgccaccctgtgttcctgtgattgcaatgtgagaccgaatgtaatatggaaaacctaccagtggggtgtggttgtgccctgagcacgtgtgtaaaggactggggaggcgtgtcttgaaaaagcaactgcagaaattccttatgatgattgtgtgcaagttagttaacatgaaccttcatttgtaaattttttaaaatttcttttataatatgctttccgcagtcctaactatgctgcgttttataatagctttttcccttctgttctgttcatgtagcacagataagcattgcacttggtaccatgctttacctcatttcaagaaaatatgcttaacagagaggaaaaaaatgtggtttggccttgctgctgttttgatttatggaatttgaaaaagataattataatgcctgcaatgtgtcatatactcgcacaacttaaataggtcatttttgtctgtggcatttttactgtttgtgaaagtatgaaacagatttgttaactgaactcttaattatgtttttaaaatgtttgttatatttcttttcttttttcttttatattacgtgaagtgatgaaatttagaatgacctctaacactcctgtaattgtcttttaaaatactgatatttttatttgttaataatactttgccctcagaaagattctgataccctgccttgacaacatgaaacttgaggctgctttggttcatgaatccaggtgttcccccggcagtcggcttcttcagtcgctccctggaggcaggtgggcactgcagaggatcactggaatccagatcgagcgcagttcatgcacaaggccccgttgatttaaaatattggatcttgctctgttagggtgtctaatccctttacacaagattgaagccaccaaactgagaccttgatacctttttttaactgcatctgaaattatgttaagagtctttaacccatttgcattatctgcagaagagaaactcatgtcatgtttattacctatatggttgttttaattacatttgaataattatatttttccaaccactgattacttttcaggaatttaattatttccagataaatttctttattttatattgtacatgaaaagttttaaagatatgtttaagaccaagactattaaaatgatttttaaagttgttggagacgccaatagcaatatctaggaaatttgcattgagaccattgtattttccactagcagtgaaaatgatttttcacaactaacttgtaaatatattttaatcattacttctttttttctagtccatttttatttggacatcaaccacagacaatttaaattttatagatgcactaagaattcactgcagcagcaggttacatagcaaaaatgcaaaggtgaacaggaagtaaatttctggcttttctgctgtaaatagtgaaggaaaattactaaaatcaagtaaaactaatgcatattatttgattgacaataaaatatttaccatcacatgctgcagctgttttttaaggaacatgatgtcattcattcatacagtaatcatgctgcagaaatttgcagtctgcaccttatggatcacaattacctttagttgttttttttgtaataattgtagccaagtaaatctccaataaagttatcgtctgttca

SEQ ID NO: 8282 - DNA, 10220 bp, Homo sapiens
ggaaactctgaaagaacttagaatcagcattttgagagcagaagcttgggcatgctgtgattttccaataaactgctatcacaatgtcaaaatgcagttcagacaagagcaacacagagatctcaaacattaaaacgtaagctgtgctagaacaaaaatgcaatgaaagaaacactggatgaatgaaaagccctgctttgcaacccctcagcatggcaggcctgcagctcatgacccctgcttcctcaccaatgggtcctttctttggactgccatggcaacaagaagcaattcatgataacatttatacgccaagaaaatatcaggttgaactgcttgaagcagctctggatcataataccatcgtctgtttaaacactggctcagggaagacatttattgcagtactactcactaaagagctgtcctatcagatcaggggagacttcagcagaaatggaaaaaggacggtgttcttggtcaactctgcaaaccaggttgctcaacaagtgtcagctgtcagaactcattcagatctcaaggttggggaatactcaaacctagaagtaaatgcatcttggacaaaagagagatggaaccaagagtttactaagcaccaggttctcattatgacttgctatgtcgccttgaatgttttgaaaaatggttacttatcactgtcagacattaaccttttggtgtttgatgagtgtcatcttgcaatcctagaccacccctatcgagaaattatgaagctctgtgaaaattgtccatcatgtcctcgcattttgggactaactgcttccattttaaatgggaaatgtgatccagaggaattggaagaaaagattcagaaactagagaaaattcttaagagtaatgctgaaactgcaactgacctggtggtcttagacaggtatacttctcagccatgtgagattgtggtggattgtggaccatttactgacagaagtgggctttatgaaagactgctgatggaattagaagaagcacttaattttatcaatgattgtaatatatctgtacattcaaaagaaagagattctactttaatttcgaaacagatactatcagactgtcgtgccgtattggtagttctgggaccctggtgtgcagataaagtagctggaatgatggtaagagaactacagaaatacatcaaacatgagcaagaggagctgcacaggaaatttttattgtttacagacactttcctaaggaaaatacatgcactatgtgaagagcacttctcacctgcctcacttgacctgaaatttgtaactcctaaagtaatcaaactgctcgaaatcttacgcaaatataaaccatatgagcgacagcagtttgaaagcgttgagtggtataataatagaaatcaggataattatgtgtcatggagtgattctgaggatgatgatgaggatgaagaaattgaagaaaaagagaagccagagacaaattttccttctccttttaccaacattttgtgcggaattatttttgtggaaagaagatacacagcagttgtcttaaacagattgataaaggaagctggcaaacaagatccagagctggcttatatcagtagcaatttcataactggacatggcattgggaagaatcagcctcgcaacaaacagatggaagcagaattcagaaaacaggaagaggtacttaggaaatttcgagcacatgagaccaacctgcttattgcaacaagtattgtagaagagggtgttgatataccaaaatgcaacttggtggttcgttttgatttgcccacagaatatcgatcctatgttcaatctaaaggaagagcaagggcacccatctctaattatataatgttagcggatacagacaaaataaaaagttttgaagaagaccttaaaacctacaaagctattgaaaagatcttgagaaacaagtgttccaagtcggttgatactggtgagactgacattgatcctgtcatggatgatgatgacgttttcccaccatatgtgttgaggcctgacgatggtggtccacgagtcacaatcaacacggccattggacacatcaatagatactgtgctagattaccaagtgatccgtttactcatctagctcctaaatgcagaacccgagagttgcctgatggtacattttattcaactctttatctgccaattaactcacctcttcgagcctccattgttggtccaccaatgagctgtgtacgattggctgaaagagttgtagctctcatttgctgtgagaaactgcacaaaattggcgaactggatgaccatttgatgccagttgggaaagagactgttaaatatgaagaggagcttgatttgcatgatgaagaagagaccagtgttccaggaagaccaggttccacgaaacgaaggcagtgctacccaaaagcaattccagagtgtttgagggatagttatcccagacctgatcagccctgttacctgtatgtgataggaatggttttaactacacctttacctgatgaactcaactttagaaggcggaagctctatcctcctgaagataccacaagatgctttggaatactgacggccaaacccatacctcagattccacactttcctgtgtacacacgctctggagaggttaccatatccattgagttgaagaagtctggtttcatgttgtctctacaaatgcttgagttgattacaagacttcaccagtatatattctcacatattcttcggcttgaaaaacctgcactagaatttaaacctacagacgctgattcagcatactgtgttctacctcttaatgttgttaatgactccagcactttggatattgactttaaattcatggaagatattgagaagtctgaagctcgcataggcattcccagtacaaagtatacaaaagaaacaccctttgtttttaaattagaagattaccaagatgccgttatcattccaagatatcgcaattttgatcagcctcatcgattttatgtagctgatgtgtacactgatcttaccccactcagtaaatttccttcccctgagtatgaaacttttgcagaatattataaaacaaagtacaaccttgacctaaccaatctcaaccagccactgctggatgtggaccacacatcttcaagacttaatcttttgacacctcgacatttgaatcagaaggggaaagcgcttcctttaagcagtgctgagaagaggaaagccaaatgggaaagtctgcagaataaacagatactggttccagaactctgtgctatacatccaattccagcatcactgtggagaaaagctgtttgtctccccagcatactttatcgccttcactgccttttgactgcagaggagctaagagcccagactgccagcgatgctggcgtgggagtcagatcacttcctgcggattttagataccctaacttagacttcgggtggaaaaaatctattgacagcaaatctttcatctcaatttctaactcctcttcagctgaaaatgataattactgtaagcacagcacaattgtccctgaaaatgctgcacatcaaggtgctaatagaacctcctctctagaaaatcatgaccaaatgtctgtgaactgcagaacgttgctcagcgagtcccctggtaagctccacgttgaagtttcagcagatcttacagcaattaatggtctttcttacaatcaaaatctcgccaatggcagttatgatttagctaacagagacttttgccaaggaaatcagctaaattactacaagcaggaaatacccgtgcaaccaactacctcatattccattcagaatttatacagttacgagaaccagccccagcccagcgatgaatgtactctcctgagtaataaataccttgatggaaatgctaacaaatctacctcagatggaagtcctgtgatggccgtaatgcctggtacgacagacactattcaagtgctcaagggcaggatggattctgagcagagcccttctattgggtactcctcaaggactcttggccccaatcctggacttattcttcaggctttgactctgtcaaacgctagtgatggatttaacctggagcggcttgaaatgcttggcgactcctttttaaagcatgccatcaccacatatctattttgcacttaccctgatgcgcatgagggccgcctttcatatatgagaagcaaaaaggtcagcaactgtaatctgtatcgccttggaaaaaagaagggactacccagccgcatggtggtgtcaatatttgatccccctgtgaattggcttcctcctggttatgtagtaaatcaagacaaaagcaacacagataaatgggaaaaagatgaaatgacaaaagactgcatgctggcgaatggcaaactggatgaggattacgaggaggaggatgaggaggaggagagcctgatgtggagggctccgaaggaagaggctgactatgaagatgatttcctggagtatgatcaggaacatatcagatttatagataatatgttaatggggtcaggagcttttgtaaagaaaatctctctttctcctttttcaaccactgattctgcatatgaatggaaaatgcccaaaaaatcctccttaggtagtatgccattttcatcagattttgaggattttgactacagctcttgggatgcaatgtgctatctggatcctagcaaagctgttgaagaagatgactttgtggtggggttctggaatccatcagaagaaaactgtggtgttgacacgggaaagcagtccatttcttacgacttgcacactgagcagtgtattgctgacaaaagcatagcggactgtgtggaagccctgctgggctgctatttaaccagctgtggggagagggctgctcagcttttcctctgttcactggggctgaaggtgctcccggtaattaaaaggactgatcgggaaaaggccctgtgccctactcgggagaatttcaacagccaacaaaagaacctttcagtgagctgtgctgctgcttctgtggccagttcacgctcttctgtattgaaagactcggaatatggttgtttgaagattccaccaagatgtatgtttgatcatccagatgcagataaaacactgaatcaccttatatcggggtttgaaaattttgaaaagaaaatcaactacagattcaagaataaggcttaccttctccaggcttttacacatgcctcctaccactacaatactatcactgattgttaccagcgcttagaattcctgggagatgcgattttggactacctcataaccaagcacctttatgaagacccgcggcagcactccccgggggtcctgacagacctgcggtctgccctggtcaacaacaccatctttgcatcgctggctgtaaagtacgactaccacaagtacttcaaagctgtctctcctgagctcttccatgtcattgatgactttgtgcagtttcagcttgagaagaatgaaatgcaaggaatggattctgagcttaggagatctgaggaggatgaagagaaagaagaggatattgaagttccaaaggccatgggggatatttttgagtcgcttgctggtgccatttacatggatagtgggatgtcactggagacagtctggcaggtgtactatcccatgatgcggccactaatagaaaagttttctgcaaatgtaccccgttcccctgtgcgagaattgcttgaaatggaaccagaaactgccaaatttagcccggctgagagaacttacgacgggaaggtcagagtcactgtggaagtagtaggaaaggggaaatttaaaggtgttggtcgaagttacaggattgccaaatctgcagcagcaagaagagccctccgaagcctcaaagctaatcaacctcaggttcccaatagctgaaaccgctttttaaaattcaaaacaagaaacaaaacaaaaaaaattaaggggaaaattatttaaatcggaaaggaagacttaaagttgttagtgagtggaatgaattgaaggcagaatttaaagtttggttgataacaggatagataacagaataaaacatttaacatatgtataaaattttggaactaattgtagttttagttttttgcgcaaacacaatcttatcttctttcctcacttctgctttgtttaaatcacaagagtgctttaatgatgacatttagcaagtgctcaaaataattgacaggttttgtttttttttttttgagtttatgtcagctttgcttagtgttagaaggccatggagcttaaacctccagcagtccctaggatgatgtagattcttctccatctctccgtgtgtgcagtagtgccagtcctgcagtagttgataagctgaatagaaagataaggttttcgagaggagaagtgcgccaatgttgtcttttctttccacgttatactgtgtaaggtgatgttcccggtcgctgttgcacctgatagtaagggacagatttttaatgaacattggctggcatgttggtgaatcacattttagttttctgatgccacatagtcttgcataaaaaagggttcttgccttaaaagtgaaaccttcatggatagtctttaatctctgatctttttggaacaaactgttttacattcctttcattttattatgcattagacgttgagacagcgtgatacttacaactcactagtatagttgtaacttattacaggatcatactaaaatttctgtcatatgtatactgaagacattttaaaaaccagaatatgtagtctacggatattttttatcataaaaatgatctttggctaaacaccccattttactaaagtcctcctgccaggtagttcccactgatggaaatgtttatggcaaataattttgccttctaggctgttgctctaacaaaataaaccttagacatatcacacctaaaatatgctgcagattttataattgattggttacttatttaagaagcaaaacacagcacctttacccttagtctcctcacataaatttcttactatacttttcataatgttgcatgcatatttcacctaccaaagctgtgctgttaatgccgtgaaagtttaacgtttgcgataaactgccgtaattttgatacatctgtgatttaggtcattaatttagataaactagctcattatttccatctttggaaaaggaaaaaaaaaaaaacttctttaggcatttgcctaagtttctttaattagacttgtaggcactcttcacttaaatacctcagttcttcttttcttttgcatgcatttttcccctgtttggtgctatgtttatgtattatgcttgaaattttaatttttttttttttgcactgtaactataatacctcttaatttacctttttaaaagctgtgggtcagtcttgcactcccatcaacataccagtagaggtttgctgcaatttgccccgttaattatgcttgaagtttaagaaagctgagcagaggtgtctcatatttcccagcacatgattctgaacttgatgcttcgtggaatgctgcatttatatgtaagtgacatttgaatactgtccttcctgctttatctgcatcatccacccacagagaaatgcctctgtgcgagtgcaccgacagaaaactgtcagctctgctttctaaggaaccctgagtgaggggggtattaagcttctccagtgttttttgttgtctccaatcttaaacttaaattgagatctaaattattaaacgagtttttgagcaaattaggtgacttgttttaaaaatatttaattccgatttggaaccttagatgtctatttgattttttaaaaaaccttaatgtaagatatgaccagttaaaacaaagcaattcttgaattatataactgtaaaagtgtgcagttaacaaggctggatgtgaattttattctgagggtgatttgtgatcaagtttaatcacaaatctcttaatatttataaactacctgatgccaggagcttagggctttgcattgtgtctaatacattgatcccagtgttacgggattctcttgattcctggcaccaaaatcagattgttttcacagttatgattcccagtgggagaaaaatgcctcaatatatttgtaaccttaagaagagtatttttttgttaatactaagatgttcaaacttagacatgattaggtcatacattctcaggggttcaaatttccttctaccattcaaatgttttatcaacagcaaacttcagccgtttcactttttgttggagaaaaatagtagattttaatttgactcacagtttgaagcattctgtgatcccctggttactgagttaaaaaataaaaaagtacgagttagacatatgaaatggttatgaacgcttttgtgctgctgatttttaatgctgtaaagttttcctgtgtttagcttgttgaaatgttttgcatctgtcaattaaggaaaaaaaaaatcactctatgttgccccactttagagccctgtgtgccaccctgtgttcctgtgattgcaatgtgagaccgaatgtaatatggaaaacctaccagtggggtgtggttgtgccctgagcacgtgtgtaaaggactggggaggcgtgtcttgaaaaagcaactgcagaaattccttatgatgattgtgtgcaagttagttaacatgaaccttcatttgtaaattttttaaaatttcttttataatatgctttccgcagtcctaactatgctgcgttttataatagctttttcccttctgttctgttcatgtagcacagataagcattgcacttggtaccatgctttacctcatttcaagaaaatatgcttaacagagaggaaaaaaatgtggtttggccttgctgctgttttgatttatggaatttgaaaaagataattataatgcctgcaatgtgtcatatactcgcacaacttaaataggtcatttttgtctgtggcatttttactgtttgtgaaagtatgaaacagatttgttaactgaactcttaattatgtttttaaaatgtttgttatatttcttttcttttttcttttatattacgtgaagtgatgaaatttagaatgacctctaacactcctgtaattgtcttttaaaatactgatatttttatttgttaataatactttgccctcagaaagattctgataccctgccttgacaacatgaaacttgaggctgctttggttcatgaatccaggtgttcccccggcagtcggcttcttcagtcgctccctggaggcaggtgggcactgcagaggatcactggaatccagatcgagcgcagttcatgcacaaggccccgttgatttaaaatattggatcttgctctgttagggtgtctaatccctttacacaagattgaagccaccaaactgagaccttgatacctttttttaactgcatctgaaattatgttaagagtctttaacccatttgcattatctgcagaagagaaactcatgtcatgtttattacctatatggttgttttaattacatttgaataattatatttttccaaccactgattacttttcaggaatttaattatttccagataaatttctttattttatattgtacatgaaaagttttaaagatatgtttaagaccaagactattaaaatgatttttaaagttgttggagacgccaatagcaatatctaggaaatttgcattgagaccattgtattttccactagcagtgaaaatgatttttcacaactaacttgtaaatatattttaatcattacttctttttttctagtccatttttatttggacatcaaccacagacaatttaaattttatagatgcactaagaattcactgcagcagcaggttacatagcaaaaatgcaaaggtgaacaggaagtaaatttctggcttttctgctgtaaatagtgaaggaaaattactaaaatcaagtaaaactaatgcatattatttgattgacaataaaatatttaccatcacatgctgcagctgttttttaaggaacatgatgtcattcattcatacagtaatcatgctgcagaaatttgcagtctgcaccttatggatcacaattacctttagttgttttttttgtaataattgtagccaagtaaatctccaataaagttatcgtctgttc

SEQ ID NO: 8283 - DNA, 10331 bp, Homo sapiens
gcggaagtgggtgtttgttatttccccaaatgcggaggcccctgcaccactaacgcgaggaaacgcaggcgagtgggaaggttacctagggtatgaattaatacagacttggaaactctgaaagaacttagaatcagcattttgagagcagaagcttgggcatgctgtgattttccaataaactgctatcacaatgtcaaaatgcagttcagacaagagcaacacagagatctcaaacattaaaacgtaagctgtgctagaacaaaaatgcaatgaaagaaacactggatgaatgaaaagccctgctttgcaacccctcagcatggcaggcctgcagctcatgacccctgcttcctcaccaatgggtcctttctttggactgccatggcaacaagaagcaattcatgataacatttatacgccaagaaaatatcaggttgaactgcttgaagcagctctggatcataataccatcgtctgtttaaacactggctcagggaagacatttattgcagtactactcactaaagagctgtcctatcagatcaggggagacttcagcagaaatggaaaaaggacggtgttcttggtcaactctgcaaaccaggttgctcaacaagtgtcagctgtcagaactcattcagatctcaaggttggggaatactcaaacctagaagtaaatgcatcttggacaaaagagagatggaaccaagagtttactaagcaccaggttctcattatgacttgctatgtcgccttgaatgttttgaaaaatggttacttatcactgtcagacattaaccttttggtgtttgatgagtgtcatcttgcaatcctagaccacccctatcgagaaattatgaagctctgtgaaaattgtccatcatgtcctcgcattttgggactaactgcttccattttaaatgggaaatgtgatccagaggaattggaagaaaagattcagaaactagagaaaattcttaagagtaatgctgaaactgcaactgacctggtggtcttagacaggtatacttctcagccatgtgagattgtggtggattgtggaccatttactgacagaagtgggctttatgaaagactgctgatggaattagaagaagcacttaattttatcaatgattgtaatatatctgtacattcaaaagaaagagattctactttaatttcgaaacagatactatcagactgtcgtgccgtattggtagttctgggaccctggtgtgcagataaagtagctggaatgatggtaagagaactacagaaatacatcaaacatgagcaagaggagctgcacaggaaatttttattgtttacagacactttcctaaggaaaatacatgcactatgtgaagagcacttctcacctgcctcacttgacctgaaatttgtaactcctaaagtaatcaaactgctcgaaatcttacgcaaatataaaccatatgagcgacagcagtttgaaagcgttgagtggtataataatagaaatcaggataattatgtgtcatggagtgattctgaggatgatgatgaggatgaagaaattgaagaaaaagagaagccagagacaaattttccttctccttttaccaacattttgtgcggaattatttttgtggaaagaagatacacagcagttgtcttaaacagattgataaaggaagctggcaaacaagatccagagctggcttatatcagtagcaatttcataactggacatggcattgggaagaatcagcctcgcaacaaacagatggaagcagaattcagaaaacaggaagaggtacttaggaaatttcgagcacatgagaccaacctgcttattgcaacaagtattgtagaagagggtgttgatataccaaaatgcaacttggtggttcgttttgatttgcccacagaatatcgatcctatgttcaatctaaaggaagagcaagggcacccatctctaattatataatgttagcggatacagacaaaataaaaagttttgaagaagaccttaaaacctacaaagctattgaaaagatcttgagaaacaagtgttccaagtcggttgatactggtgagactgacattgatcctgtcatggatgatgatgacgttttcccaccatatgtgttgaggcctgacgatggtggtccacgagtcacaatcaacacggccattggacacatcaatagatactgtgctagattaccaagtgatccgtttactcatctagctcctaaatgcagaacccgagagttgcctgatggtacattttattcaactctttatctgccaattaactcacctcttcgagcctccattgttggtccaccaatgagctgtgtacgattggctgaaagagttgtagctctcatttgctgtgagaaactgcacaaaattggcgaactggatgaccatttgatgccagttgggaaagagactgttaaatatgaagaggagcttgatttgcatgatgaagaagagaccagtgttccaggaagaccaggttccacgaaacgaaggcagtgctacccaaaagcaattccagagtgtttgagggatagttatcccagacctgatcagccctgttacctgtatgtgataggaatggttttaactacacctttacctgatgaactcaactttagaaggcggaagctctatcctcctgaagataccacaagatgctttggaatactgacggccaaacccatacctcagattccacactttcctgtgtacacacgctctggagaggttaccatatccattgagttgaagaagtctggtttcatgttgtctctacaaatgcttgagttgattacaagacttcaccagtatatattctcacatattcttcggcttgaaaaacctgcactagaatttaaacctacagacgctgattcagcatactgtgttctacctcttaatgttgttaatgactccagcactttggatattgactttaaattcatggaagatattgagaagtctgaagctcgcataggcattcccagtacaaagtatacaaaagaaacaccctttgtttttaaattagaagattaccaagatgccgttatcattccaagatatcgcaattttgatcagcctcatcgattttatgtagctgatgtgtacactgatcttaccccactcagtaaatttccttcccctgagtatgaaacttttgcagaatattataaaacaaagtacaaccttgacctaaccaatctcaaccagccactgctggatgtggaccacacatcttcaagacttaatcttttgacacctcgacatttgaatcagaaggggaaagcgcttcctttaagcagtgctgagaagaggaaagccaaatgggaaagtctgcagaataaacagatactggttccagaactctgtgctatacatccaattccagcatcactgtggagaaaagctgtttgtctccccagcatactttatcgccttcactgccttttgactgcagaggagctaagagcccagactgccagcgatgctggcgtgggagtcagatcacttcctgcggattttagataccctaacttagacttcgggtggaaaaaatctattgacagcaaatctttcatctcaatttctaactcctcttcagctgaaaatgataattactgtaagcacagcacaattgtccctgaaaatgctgcacatcaaggtgctaatagaacctcctctctagaaaatcatgaccaaatgtctgtgaactgcagaacgttgctcagcgagtcccctggtaagctccacgttgaagtttcagcagatcttacagcaattaatggtctttcttacaatcaaaatctcgccaatggcagttatgatttagctaacagagacttttgccaaggaaatcagctaaattactacaagcaggaaatacccgtgcaaccaactacctcatattccattcagaatttatacagttacgagaaccagccccagcccagcgatgaatgtactctcctgagtaataaataccttgatggaaatgctaacaaatctacctcagatggaagtcctgtgatggccgtaatgcctggtacgacagacactattcaagtgctcaagggcaggatggattctgagcagagcccttctattgggtactcctcaaggactcttggccccaatcctggacttattcttcaggctttgactctgtcaaacgctagtgatggatttaacctggagcggcttgaaatgcttggcgactcctttttaaagcatgccatcaccacatatctattttgcacttaccctgatgcgcatgagggccgcctttcatatatgagaagcaaaaaggtcagcaactgtaatctgtatcgccttggaaaaaagaagggactacccagccgcatggtggtgtcaatatttgatccccctgtgaattggcttcctcctggttatgtagtaaatcaagacaaaagcaacacagataaatgggaaaaagatgaaatgacaaaagactgcatgctggcgaatggcaaactggatgaggattacgaggaggaggatgaggaggaggagagcctgatgtggagggctccgaaggaagaggctgactatgaagatgatttcctggagtatgatcaggaacatatcagatttatagataatatgttaatggggtcaggagcttttgtaaagaaaatctctctttctcctttttcaaccactgattctgcatatgaatggaaaatgcccaaaaaatcctccttaggtagtatgccattttcatcagattttgaggattttgactacagctcttgggatgcaatgtgctatctggatcctagcaaagctgttgaagaagatgactttgtggtggggttctggaatccatcagaagaaaactgtggtgttgacacgggaaagcagtccatttcttacgacttgcacactgagcagtgtattgctgacaaaagcatagcggactgtgtggaagccctgctgggctgctatttaaccagctgtggggagagggctgctcagcttttcctctgttcactggggctgaaggtgctcccggtaattaaaaggactgatcgggaaaaggccctgtgccctactcgggagaatttcaacagccaacaaaagaacctttcagtgagctgtgctgctgcttctgtggccagttcacgctcttctgtattgaaagactcggaatatggttgtttgaagattccaccaagatgtatgtttgatcatccagatgcagataaaacactgaatcaccttatatcggggtttgaaaattttgaaaagaaaatcaactacagattcaagaataaggcttaccttctccaggcttttacacatgcctcctaccactacaatactatcactgattgttaccagcgcttagaattcctgggagatgcgattttggactacctcataaccaagcacctttatgaagacccgcggcagcactccccgggggtcctgacagacctgcggtctgccctggtcaacaacaccatctttgcatcgctggctgtaaagtacgactaccacaagtacttcaaagctgtctctcctgagctcttccatgtcattgatgactttgtgcagtttcagcttgagaagaatgaaatgcaaggaatggattctgagcttaggagatctgaggaggatgaagagaaagaagaggatattgaagttccaaaggccatgggggatatttttgagtcgcttgctggtgccatttacatggatagtgggatgtcactggagacagtctggcaggtgtactatcccatgatgcggccactaatagaaaagttttctgcaaatgtaccccgttcccctgtgcgagaattgcttgaaatggaaccagaaactgccaaatttagcccggctgagagaacttacgacgggaaggtcagagtcactgtggaagtagtaggaaaggggaaatttaaaggtgttggtcgaagttacaggattgccaaatctgcagcagcaagaagagccctccgaagcctcaaagctaatcaacctcaggttcccaatagctgaaaccgctttttaaaattcaaaacaagaaacaaaacaaaaaaaattaaggggaaaattatttaaatcggaaaggaagacttaaagttgttagtgagtggaatgaattgaaggcagaatttaaagtttggttgataacaggatagataacagaataaaacatttaacatatgtataaaattttggaactaattgtagttttagttttttgcgcaaacacaatcttatcttctttcctcacttctgctttgtttaaatcacaagagtgctttaatgatgacatttagcaagtgctcaaaataattgacaggttttgtttttttttttttgagtttatgtcagctttgcttagtgttagaaggccatggagcttaaacctccagcagtccctaggatgatgtagattcttctccatctctccgtgtgtgcagtagtgccagtcctgcagtagttgataagctgaatagaaagataaggttttcgagaggagaagtgcgccaatgttgtcttttctttccacgttatactgtgtaaggtgatgttcccggtcgctgttgcacctgatagtaagggacagatttttaatgaacattggctggcatgttggtgaatcacattttagttttctgatgccacatagtcttgcataaaaaagggttcttgccttaaaagtgaaaccttcatggatagtctttaatctctgatctttttggaacaaactgttttacattcctttcattttattatgcattagacgttgagacagcgtgatacttacaactcactagtatagttgtaacttattacaggatcatactaaaatttctgtcatatgtatactgaagacattttaaaaaccagaatatgtagtctacggatattttttatcataaaaatgatctttggctaaacaccccattttactaaagtcctcctgccaggtagttcccactgatggaaatgtttatggcaaataattttgccttctaggctgttgctctaacaaaataaaccttagacatatcacacctaaaatatgctgcagattttataattgattggttacttatttaagaagcaaaacacagcacctttacccttagtctcctcacataaatttcttactatacttttcataatgttgcatgcatatttcacctaccaaagctgtgctgttaatgccgtgaaagtttaacgtttgcgataaactgccgtaattttgatacatctgtgatttaggtcattaatttagataaactagctcattatttccatctttggaaaaggaaaaaaaaaaaaacttctttaggcatttgcctaagtttctttaattagacttgtaggcactcttcacttaaatacctcagttcttcttttcttttgcatgcatttttcccctgtttggtgctatgtttatgtattatgcttgaaattttaatttttttttttttgcactgtaactataatacctcttaatttacctttttaaaagctgtgggtcagtcttgcactcccatcaacataccagtagaggtttgctgcaatttgccccgttaattatgcttgaagtttaagaaagctgagcagaggtgtctcatatttcccagcacatgattctgaacttgatgcttcgtggaatgctgcatttatatgtaagtgacatttgaatactgtccttcctgctttatctgcatcatccacccacagagaaatgcctctgtgcgagtgcaccgacagaaaactgtcagctctgctttctaaggaaccctgagtgaggggggtattaagcttctccagtgttttttgttgtctccaatcttaaacttaaattgagatctaaattattaaacgagtttttgagcaaattaggtgacttgttttaaaaatatttaattccgatttggaaccttagatgtctatttgattttttaaaaaaccttaatgtaagatatgaccagttaaaacaaagcaattcttgaattatataactgtaaaagtgtgcagttaacaaggctggatgtgaattttattctgagggtgatttgtgatcaagtttaatcacaaatctcttaatatttataaactacctgatgccaggagcttagggctttgcattgtgtctaatacattgatcccagtgttacgggattctcttgattcctggcaccaaaatcagattgttttcacagttatgattcccagtgggagaaaaatgcctcaatatatttgtaaccttaagaagagtatttttttgttaatactaagatgttcaaacttagacatgattaggtcatacattctcaggggttcaaatttccttctaccattcaaatgttttatcaacagcaaacttcagccgtttcactttttgttggagaaaaatagtagattttaatttgactcacagtttgaagcattctgtgatcccctggttactgagttaaaaaataaaaaagtacgagttagacatatgaaatggttatgaacgcttttgtgctgctgatttttaatgctgtaaagttttcctgtgtttagcttgttgaaatgttttgcatctgtcaattaaggaaaaaaaaaatcactctatgttgccccactttagagccctgtgtgccaccctgtgttcctgtgattgcaatgtgagaccgaatgtaatatggaaaacctaccagtggggtgtggttgtgccctgagcacgtgtgtaaaggactggggaggcgtgtcttgaaaaagcaactgcagaaattccttatgatgattgtgtgcaagttagttaacatgaaccttcatttgtaaattttttaaaatttcttttataatatgctttccgcagtcctaactatgctgcgttttataatagctttttcccttctgttctgttcatgtagcacagataagcattgcacttggtaccatgctttacctcatttcaagaaaatatgcttaacagagaggaaaaaaatgtggtttggccttgctgctgttttgatttatggaatttgaaaaagataattataatgcctgcaatgtgtcatatactcgcacaacttaaataggtcatttttgtctgtggcatttttactgtttgtgaaagtatgaaacagatttgttaactgaactcttaattatgtttttaaaatgtttgttatatttcttttcttttttcttttatattacgtgaagtgatgaaatttagaatgacctctaacactcctgtaattgtcttttaaaatactgatatttttatttgttaataatactttgccctcagaaagattctgataccctgccttgacaacatgaaacttgaggctgctttggttcatgaatccaggtgttcccccggcagtcggcttcttcagtcgctccctggaggcaggtgggcactgcagaggatcactggaatccagatcgagcgcagttcatgcacaaggccccgttgatttaaaatattggatcttgctctgttagggtgtctaatccctttacacaagattgaagccaccaaactgagaccttgatacctttttttaactgcatctgaaattatgttaagagtctttaacccatttgcattatctgcagaagagaaactcatgtcatgtttattacctatatggttgttttaattacatttgaataattatatttttccaaccactgattacttttcaggaatttaattatttccagataaatttctttattttatattgtacatgaaaagttttaaagatatgtttaagaccaagactattaaaatgatttttaaagttgttggagacgccaatagcaatatctaggaaatttgcattgagaccattgtattttccactagcagtgaaaatgatttttcacaactaacttgtaaatatattttaatcattacttctttttttctagtccatttttatttggacatcaaccacagacaatttaaattttatagatgcactaagaattcactgcagcagcaggttacatagcaaaaatgcaaaggtgaacaggaagtaaatttctggcttttctgctgtaaatagtgaaggaaaattactaaaatcaagtaaaactaatgcatattatttgattgacaataaaatatttaccatcacatgctgcagctgttttttaaggaacatgatgtcattcattcatacagtaatcatgctgcagaaatttgcagtctgcaccttatggatcacaattacctttagttgttttttttgtaataattgtagccaagtaaatctccaataaagttatcgtctgttca

SEQ ID NO: 8284 - DNA, 6179 bp, Homo sapiens
gctggtttcatcctaaggctggatcttttcatgggtctgtgtagtgtaattgcagcagcaaatgggactaataatttcatgagtcatctttagagggaaagaaagacaactgcttctcttcaaccatcaaatgaaagtcctaaattttttgctgttggatgagcatgaaccaattcctctggccagggtaagctgtgctagaacaaaaatgcaatgaaagaaacactggatgaatgaaaagccctgctttgcaacccctcagcatggcaggcctgcagctcatgacccctgcttcctcaccaatgggtcctttctttggactgccatggcaacaagaagcaattcatgataacatttatacgccaagaaaatatcaggttgaactgcttgaagcagctctggatcataataccatcgtctgtttaaacactggctcagggaagacatttattgcagtactactcactaaagagctgtcctatcagatcaggggagacttcagcagaaatggaaaaaggacggtgttcttggtcaactctgcaaaccaggttgctcaacaagtgtcagctgtcagaactcattcagatctcaaggttggggaatactcaaacctagaagtaaatgcatcttggacaaaagagagatggaaccaagagtttactaagcaccaggttctcattatgacttgctatgtcgccttgaatgttttgaaaaatggttacttatcactgtcagacattaaccttttggtgtttgatgagtgtcatcttgcaatcctagaccacccctatcgagaaattatgaagctctgtgaaaattgtccatcatgtcctcgcattttgggactaactgcttccattttaaatgggaaatgtgatccagaggaattggaagaaaagattcagaaactagagaaaattcttaagagtaatgctgaaactgcaactgacctggtggtcttagacaggtatacttctcagccatgtgagattgtggtggattgtggaccatttactgacagaagtgggctttatgaaagactgctgatggaattagaagaagcacttaattttatcaatgattgtaatatatctgtacattcaaaagaaagagattctactttaatttcgaaacagatactatcagactgtcgtgccgtattggtagttctgggaccctggtgtgcagataaagtagctggaatgatggtaagagaactacagaaatacatcaaacatgagcaagaggagctgcacaggaaatttttattgtttacagacactttcctaaggaaaatacatgcactatgtgaagagcacttctcacctgcctcacttgacctgaaatttgtaactcctaaagtaatcaaactgctcgaaatcttacgcaaatataaaccatatgagcgacagcagtttgaaagcgttgagtggtataataatagaaatcaggataattatgtgtcatggagtgattctgaggatgatgatgaggatgaagaaattgaagaaaaagagaagccagagacaaattttccttctccttttaccaacattttgtgcggaattatttttgtggaaagaagatacacagcagttgtcttaaacagattgataaaggaagctggcaaacaagatccagagctggcttatatcagtagcaatttcataactggacatggcattgggaagaatcagcctcgcaacaaacagatggaagcagaattcagaaaacaggaagaggtacttaggaaatttcgagcacatgagaccaacctgcttattgcaacaagtattgtagaagagggtgttgatataccaaaatgcaacttggtggttcgttttgatttgcccacagaatatcgatcctatgttcaatctaaaggaagagcaagggcacccatctctaattatataatgttagcggatacagacaaaataaaaagttttgaagaagaccttaaaacctacaaagctattgaaaagatcttgagaaacaagtgttccaagtcggttgatactggtgagactgacattgatcctgtcatggatgatgatgacgttttcccaccatatgtgttgaggcctgacgatggtggtccacgagtcacaatcaacacggccattggacacatcaatagatactgtgctagattaccaagtgatccgtttactcatctagctcctaaatgcagaacccgagagttgcctgatggtacattttattcaactctttatctgccaattaactcacctcttcgagcctccattgttggtccaccaatgagctgtgtacgattggctgaaagagttgtagctctcatttgctgtgagaaactgcacaaaattggcgaactggatgaccatttgatgccagttgggaaagagactgttaaatatgaagaggagcttgatttgcatgatgaagaagagaccagtgttccaggaagaccaggttccacgaaacgaaggcagtgctacccaaaagcaattccagagtgtttgagggatagttatcccagacctgatcagccctgttacctgtatgtgataggaatggttttaactacacctttacctgatgaactcaactttagaaggcggaagctctatcctcctgaagataccacaagatgctttggaatactgacggccaaacccatacctcagattccacactttcctgtgtacacacgctctggagaggttaccatatccattgagttgaagaagtctggtttcatgttgtctctacaaatgcttgagttgattacaagacttcaccagtatatattctcacatattcttcggcttgaaaaacctgcactagaatttaaacctacagacgctgattcagcatactgtgttctacctcttaatgttgttaatgactccagcactttggatattgactttaaattcatggaagatattgagaagtctgaagctcgcataggcattcccagtacaaagtatacaaaagaaacaccctttgtttttaaattagaagattaccaagatgccgttatcattccaagatatcgcaattttgatcagcctcatcgattttatgtagctgatgtgtacactgatcttaccccactcagtaaatttccttcccctgagtatgaaacttttgcagaatattataaaacaaagtacaaccttgacctaaccaatctcaaccagccactgctggatgtggaccacacatcttcaagacttaatcttttgacacctcgacatttgaatcagaaggggaaagcgcttcctttaagcagtgctgagaagaggaaagccaaatgggaaagtctgcagaataaacagatactggttccagaactctgtgctatacatccaattccagcatcactgtggagaaaagctgtttgtctccccagcatactttatcgccttcactgccttttgactgcagaggagctaagagcccagactgccagcgatgctggcgtgggagtcagatcacttcctgcggattttagataccctaacttagacttcgggtggaaaaaatctattgacagcaaatctttcatctcaatttctaactcctcttcagctgaaaatgataattactgtaagcacagcacaattgtccctgaaaatgctgcacatcaaggtgctaatagaacctcctctctagaaaatcatgaccaaatgtctgtgaactgcagaacgttgctcagcgagtcccctggtaagctccacgttgaagtttcagcagatcttacagcaattaatggtctttcttacaatcaaaatctcgccaatggcagttatgatttagctaacagagacttttgccaaggaaatcagctaaattactacaagcaggaaatacccgtgcaaccaactacctcatattccattcagaatttatacagttacgagaaccagccccagcccagcgatgaatgtactctcctgagtaataaataccttgatggaaatgctaacaaatctacctcagatggaagtcctgtgatggccgtaatgcctggtacgacagacactattcaagtgctcaagggcaggatggattctgagcagagcccttctattgggtactcctcaaggactcttggccccaatcctggacttattcttcaggctttgactctgtcaaacgctagtgatggatttaacctggagcggcttgaaatgcttggcgactcctttttaaagcatgccatcaccacatatctattttgcacttaccctgatgcgcatgagggccgcctttcatatatgagaagcaaaaaggtcagcaactgtaatctgtatcgccttggaaaaaagaagggactacccagccgcatggtggtgtcaatatttgatccccctgtgaattggcttcctcctggttatgtagtaaatcaagacaaaagcaacacagataaatgggaaaaagatgaaatgacaaaagactgcatgctggcgaatggcaaactggatgaggattacgaggaggaggatgaggaggaggagagcctgatgtggagggctccgaaggaagaggctgactatgaagatgatttcctggagtatgatcaggaacatatcagatttatagataatatgttaatggggtcaggagcttttgtaaagaaaatctctctttctcctttttcaaccactgattctgcatatgaatggaaaatgcccaaaaaatcctccttaggtagtatgccattttcatcagattttgaggattttgactacagctcttgggatgcaatgtgctatctggatcctagcaaagctgttgaagaagatgactttgtggtggggttctggaatccatcagaagaaaactgtggtgttgacacgggaaagcagtccatttcttacgacttgcacactgagcagtgtattgctgacaaaagcatagcggactgtgtggaagccctgctgggctgctatttaaccagctgtggggagagggctgctcagcttttcctctgttcactggggctgaaggtgctcccggtaattaaaaggactgatcgggaaaaggccctgtgccctactcgggagaatttcaacagccaacaaaagaacctttcagtgagctgtgctgctgcttctgtggccagttcacgctcttctgtattgaaagactcggaatatggttgtttgaagattccaccaagatgtatgtttgatcatccagatgcagataaaacactgaatcaccttatatcggggtttgaaaattttgaaaagaaaatcaactacagattcaagaataaggcttaccttctccaggcttttacacatgcctcctaccactacaatactatcactgattgttaccagcgcttagaattcctgggagatgcgattttggactacctcataaccaagcacctttatgaagacccgcggcagcactccccgggggtcctgacagacctgcggtctgccctggtcaacaacaccatctttgcatcgctggctgtaaagtacgactaccacaagtacttcaaagctgtctctcctgagctcttccatgtcattgatgactttgtgcagtttcagcttgagaagaatgaaatgcaaggaatggattctgagcttaggagatctgaggaggatgaagagaaagaagaggatattgaagttccaaaggccatgggggatatttttgagtcgcttgctggtgccatttacatggatagtgggatgtcactggagacagtctggcaggtgtactatcccatgatgcggccactaatagaaaagttttctgcaaatgtaccccgttcccctgtgcgagaattgcttgaaatggaaccagaaactgccaaatttagcccggctgagagaacttacgacgggaaggtcagagtcactgtggaagtagtaggaaaggggaaatttaaaggtgttggtcgaagttacaggattgccaaatctgcagcagcaagaagagccctccgaagcctcaaagctaatcaacctcaggttcccaatagctgaaaccgctttttaaaattcaaaacaagaaacaaaacaaaaaaaattaaggggaaaattatttaaatcggaaaggaagacttaaagttgttagtgagtggaatgaattgaaggcagaatttaaagtttggttgataacaggatagataacagaataaaacatttaacatatgtataaaa

SEQ ID NO: 8285 - DNA, 498 bp, Homo sapiens
gtccgatggttctcgaaggcccgcggcgccccgtgctgcaggttacctagggtatgaattaatacagacttggaaactctgaaagaacttagaatcagcattttgagagttactactgggttatttggatttctcagccaaagcagaagcttgggcatgctgtgattttccaataaactgctatcacaatgtcaaaatgcagttcagacaagagcaacacagagatctcaaacattaaaacgtaagctgtgctagaacaaaaatgcaatgaaagaaacactggatgaatgaaaagccctgctttgcaacccctcagcatggcaggcctgcagctcatgacccctgcttcctcaccaatgggtcctttctttggactgccatggcaacaagaagcaattcatgataacatttatacgccaagaaaatatcaggttgaactgcttgaagcagctctggatcataataccatcgtctgtttaaacactggctcagggaaga

SEQ ID NO: 8286 - DNA, 607 bp, Homo sapiens
gtccgatggttctcgaaggcccgcggcgccccgtgctgcaggttacctagggtatgaattaatacagacttggaaactctgaaagaacttagaatcagcattttgagagcagaagcttgggcatgctgtgattttccaataaactgctatcacaatgtcaaaatgcagttcagacaagagcaacacagagatctcaaacattaaaacgtttcatagagtaatagcaatgaacactccaaagcagtgcaagagaggaaattcccttctgtggggcgaggaaatcctgctgacagtaaagccagtggtaggctttcacacagatatttgaatccctgaccctctgtttgaaggtaagctgtgctagaacaaaaatgcaatgaaagaaacactggatgaatgaaaagccctgctttgcaacccctcagcatggcaggcctgcagctcatgacccctgcttcctcaccaatgggtcctttctttggactgccatggcaacaagaagcaattcatgataacatttatacgccaagaaaatatcaggttgaactgcttgaagcagctctggatcataataccatcgtctgtttaaacactggctcagggaaga

SEQ ID NO: 8287 - DNA, 5621 bp, Homo sapiens
actggatgaatgaaaagccctgctttgcaacccctcagcatggcaggcctgcagctcatgacccctgcttcctcaccaatgggtcctttctttggactgccatggcaacaagaagcaattcatgataacatttatacgccaagaaaatatcaggttgaactgcttgaagcagctctggatcataataccatcgtctgtttaaacactggctcagggaagacatttattgcagtactactcactaaagagctgtcctatcagatcaggggagacttcagcagaaatggaaaaaggacggtgttcttggtcaactctgcaaaccaggttgctcaacaagtgtcagctgtcagaactcattcagatctcaaggttggggaatactcaaacctagaagtaaatgcatcttggacaaaagagagatggaaccaagagtttactaagcaccaggttctcattatgacttgctatgtcgccttgaatgttttgaaaaatggttacttatcactgtcagacattaaccttttggtgtttgatgagtgtcatcttgcaatcctagaccacccctatcgagaaattatgaagctctgtgaaaattgtccatcatgtcctcgcattttgggactaactgcttccattttaaatgggaaatgtgatccagaggaattggaagaaaagattcagaaactagagaaaattcttaagagtaatgctgaaactgcaactgacctggtggtcttagacaggtatacttctcagccatgtgagattgtggtggattgtggaccatttactgacagaagtgggctttatgaaagactgctgatggaattagaagaagcacttaattttatcaatgattgtaatatatctgtacattcaaaagaaagagattctactttaatttcgaaacagatactatcagactgtcgtgccgtattggtagttctgggaccctggtgtgcagataaagtagctggaatgatggtaagagaactacagaaatacatcaaacatgagcaagaggagctgcacaggaaatttttattgtttacagacactttcctaaggaaaatacatgcactatgtgaagagcacttctcacctgcctcacttgacctgaaatttgtaactcctaaagtaatcaaactgctcgaaatcttacgcaaatataaaccatatgagcgacagcagtttgaaagcgttgagtggtataataatagaaatcaggataattatgtgtcatggagtgattctgaggatgatgatgaggatgaagaaattgaagaaaaagagaagccagagacaaattttccttctccttttaccaacattttgtgcggaattatttttgtggaaagaagatacacagcagttgtcttaaacagattgataaaggaagctggcaaacaagatccagagctggcttatatcagtagcaatttcataactggacatggcattgggaagaatcagcctcgcaacaaacagatggaagcagaattcagaaaacaggaagaggtacttaggaaatttcgagcacatgagaccaacctgcttattgcaacaagtattgtagaagagggtgttgatataccaaaatgcaacttggtggttcgttttgatttgcccacagaatatcgatcctatgttcaatctaaaggaagagcaagggcacccatctctaattatataatgttagcggatacagacaaaataaaaagttttgaagaagaccttaaaacctacaaagctattgaaaagatcttgagaaacaagtgttccaagtcggttgatactggtgagactgacattgatcctgtcatggatgatgatgacgttttcccaccatatgtgttgaggcctgacgatggtggtccacgagtcacaatcaacacggccattggacacatcaatagatactgtgctagattaccaagtgatccgtttactcatctagctcctaaatgcagaacccgagagttgcctgatggtacattttattcaactctttatctgccaattaactcacctcttcgagcctccattgttggtccaccaatgagctgtgtacgattggctgaaagagttgtagctctcatttgctgtgagaaactgcacaaaattggcgaactggatgaccatttgatgccagttgggaaagagactgttaaatatgaagaggagcttgatttgcatgatgaagaagagaccagtgttccaggaagaccaggttccacgaaacgaaggcagtgctacccaaaagcaattccagagtgtttgagggatagttatcccagacctgatcagccctgttacctgtatgtgataggaatggttttaactacacctttacctgatgaactcaactttagaaggcggaagctctatcctcctgaagataccacaagatgctttggaatactgacggccaaacccatacctcagattccacactttcctgtgtacacacgctctggagaggttaccatatccattgagttgaagaagtctggtttcatgttgtctctacaaatgcttgagttgattacaagacttcaccagtatatattctcacatattcttcggcttgaaaaacctgcactagaatttaaacctacagacgctgattcagcatactgtgttctacctcttaatgttgttaatgactccagcactttggatattgactttaaattcatggaagatattgagaagtctgaagctcgcataggcattcccagtacaaagtatacaaaagaaacaccctttgtttttaaattagaagattaccaagatgccgttatcattccaagatatcgcaattttgatcagcctcatcgattttatgtagctgatgtgtacactgatcttaccccactcagtaaatttccttcccctgagtatgaaacttttgcagaatattataaaacaaagtacaaccttgacctaaccaatctcaaccagccactgctggatgtggaccacacatcttcaagacttaatcttttgacacctcgacatttgaatcagaaggggaaagcgcttcctttaagcagtgctgagaagaggaaagccaaatgggaaagtctgcagaataaacagatactggttccagaactctgtgctatacatccaattccagcatcactgtggagaaaagctgtttgtctccccagcatactttatcgccttcactgccttttgactgcagaggagctaagagcccagactgccagcgatgctggcgtgggagtcagatcacttcctgcggattttagataccctaacttagacttcgggtggaaaaaatctattgacagcaaatctttcatctcaatttctaactcctcttcagctgaaaatgataattactgtaagcacagcacaattgtccctgaaaatgctgcacatcaaggtgctaatagaacctcctctctagaaaatcatgaccaaatgtctgtgaactgcagaacgttgctcagcgagtcccctggtaagctccacgttgaagtttcagcagatcttacagcaattaatggtctttcttacaatcaaaatctcgccaatggcagttatgatttagctaacagagacttttgccaaggaaatcagctaaattactacaagcaggaaatacccgtgcaaccaactacctcatattccattcagaatttatacagttacgagaaccagccccagcccagcgatgaatgtactctcctgagtaataaataccttgatggaaatgctaacaaatctacctcagatggaagtcctgtgatggccgtaatgcctggtacgacagacactattcaagtgctcaagggcaggatggattctgagcagagcccttctattgggtactcctcaaggactcttggccccaatcctggacttattcttcaggctttgactctgtcaaacgctagtgatggatttaacctggagcggcttgaaatgcttggcgactcctttttaaagcatgccatcaccacatatctattttgcacttaccctgatgcgcatgagggccgcctttcatatatgagaagcaaaaaggtcagcaactgtaatctgtatcgccttggaaaaaagaagggactacccagccgcatggtggtgtcaatatttgatccccctgtgaattggcttcctcctggttatgtagtaaatcaagacaaaagcaacacagataaatgggaaaaagatgaaatgacaaaagactgcatgctggcgaatggcaaactggatgaggattacgaggaggaggatgaggaggaggagagcctgatgtggagggctccgaaggaagaggctgactatgaagatgatttcctggagtatgatcaggaacatatcagatttatagataatatgttaatggggtcaggagcttttgtaaagaaaatctctctttctcctttttcaaccactgattctgcatatgaatggaaaatgcccaaaaaatcctccttaggtagtatgccattttcatcagattttgaggattttgactacagctcttgggatgcaatgtgctatctggatcctagcaaagctgttgaagaagatgactttgtggtggggttctggaatccatcagaagaaaactgtggtgttgacacgggaaagcagtccatttcttacgacttgcacactgagcagtgtattgctgacaaaagcatagcggactgtgtggaagccctgctgggctgctatttaaccagctgtggggagagggctgctcagcttttcctctgttcactggggctgaaggtgctcccggtaattaaaaggactgatcgggaaaaggccctgtgccctactcgggagaatttcaacagccaacaaaagaacctttcagtgagctgtgctgctgcttctgtggccagttcacgctcttctgtattgaaagactcggaatatggttgtttgaagattccaccaagatgtatgtttgatcatccagatgcagataaaacactgaatcaccttatatcggggtttgaaaattttgaaaagaaaatcaactacagattcaagaataaggcttaccttctccaggcttttacacatgcctcctaccactacaatactatcactgattgttaccagcgcttagaattcctgggagatgcgattttggactacctcataaccaagcacctttatgaagacccgcggcagcactccccgggggtcctgacagacctgcggtctgccctggtcaacaacaccatctttgcatcgctggctgtaaagtacgactaccacaagtacttcaaagctgtctctcctgagctcttccatgtcattgatgactttgtgcagtttcagcttgagaagaatgaaatgcaaggaatggattctgagaaaagttttctgcaaatgtaccccgttcccctgtgcgagaattgcttgaaatggaaccagaaactgccaaatttagcccggctgagagaacttacgacgggaaggtcagagtcactgtggaagtagtaggaaaggggaaatttaaaggtgttggtcgaagttacaggattgccaaatctgcagcagcaagaagagccctccgaagcctcaaagctaatcaacctcaggttcccaatagctgaaaccgc

SEQ ID NO: 8288 - DNA, 2776 bp, Homo sapiens
ctcaaccagccactgctggatgtggaccacacatcttcaagacttaatcttttgacacctcgacatttgaatcagaaggggaaagcgcttcctttaagcagtgctgagaagaggaaagccaaatgggaaagtctgcagaataaacagatactggttccagaactctgtgctatacatccaattccagcatcactgtggagaaaagctgtttgtctccccagcatactttatcgccttcactgccttttgactgcagaggagctaagagcccagactgccagcgatgctggcgtgggagtcagatcacttcctgcggattttagctgaaaatgataattactgtaagcacagcacaattgtccctgaaaatgctgcacatcaaggtgctaatagaacctcctctctagaaaatcatgaccaaatgtctgtgaactgcagaacgttgctcagcgagtcccctggtaagctccacgttgaagtttcagcagatcttacagcaattaatggtctttcttacaatcaaaatctcgccaatggcagttatgatttagctaacagagacttttgccaaggaaatcagctaaattactacaagcaggaaatacccgtgcaaccaactacctcatattccattcagaatttatacagttacgagaaccagccccagcccagcgatgaatgtactctcctgagtaataaataccttgatggaaatgctaacaaatctacctcagatggaagtcctgtgatggccgtaatgcctggtacgacagacactattcaagtgctcaagggcaggatggattctgagcagagcccttctattgggtactcctcaaggactcttggccccaatcctggacttattcttcaggctttgactctgtcaaacgctagtgatggatttaacctggagcggcttgaaatgcttggcgactcctttttaaagcatgccatcaccacatatctattttgcacttaccctgatgcgcatgagggccgcctttcatatatgagaagcaaaaaggtcagcaactgtaatctgtatcgccttggaaaaaagaagggactacccagccgcatggtggtgtcaatatttgatccccctgtgaattggcttcctcctggttatgtagtaaatcaagacaaaagcaacacagataaatgggaaaaagatgaaatgacaaaagactgcatgctggcgaatggcaaactggatgaggattacgaggaggaggatgaggaggaggagagcctgatgtggagggctccgaaggaagaggctgactatgaagatgatttcctggagtatgatcaggaacatatcagatttatagataatatgttaatggggtcaggagcttttgtaaagaaaatctctctttctcctttttcaaccactgattctgcatatgaatggaaaatgcccaaaaaatcctccttaggtagtatgccattttcatcagattttgaggattttgactacagctcttgggatgcaatgtgctatctggatcctagcaaagctgttgaagaagatgactttgtggtggggttctggaatccatcagaagaaaactgtggtgttgacacgggaaagcagtccatttcttacgacttgcacactgagcagtgtattgctgacaaaagcatagcggactgtgtggaagccctgctgggctgctatttaaccagctgtggggagagggctgctcagcttttcctctgttcactggggctgaaggtgctcccggtaattaaaaggactgatcgggaaaaggccctgtgccctactcgggagaatttcaacagccaacaaaagaacctttcagtgagctgtgctgctgcttctgtggccagttcacgctcttctgtattgaaagactcggaatatggttgtttgaagattccaccaagatgtatgtttgatcatccagatgcagataaaacactgaatcaccttatatcggggtttgaaaattttgaaaagaaaatcaactacagattcaagaataaggcttaccttctccaggcttttacacatgcctcctaccactacaatactatcactgattgttaccagcgcttagaattcctgggagatgcgattttggactacctcataaccaagcacctttatgaagacccgcggcagcactccccgggggtcctgacagacctgcggtctgccctggtcaacaacaccatctttgcatcgctggctgtaaagtacgactaccacaagtacttcaaagctgtctctcctgagctcttccatgtcattgatgactttgtgcagtttcagcttgagaagaatgaaatgcaaggaatggattctgagcttaggagatctgaggaggatgaagagaaagaagaggatattgaagttccaaaggccatgggggatatttttgagtcgcttgctggtgccatttacatggatagtgggatgtcactggagacagtctggcaggtgtactatcccatgatgcggccactaatagaaaagttttctgcaaatgtaccccgttcccctgtgcgagaattgcttgaaatggaaccagaaactgccaaatttagcccggctgagagaacttacgacgggaaggtcagagtcactgtggaagtagtaggaaaggggaaatttaaaggtgttggtcgaagttacaggattgccaaatctgcagcagcaagaagagccctccgaagcctcaaagctaatcaacctcaggttcccaatagctgaaaccgctttttaaaattcaaaacaagaaac

SEQ ID NO: 8289 - DNA, 1790 bp, Homo sapiens
ccctgcagtcaggactctgggaccgcagggggctcccggaccctgactctgcagccgaaccggcacggtttcgtggggacccaggcttgcaaagtgacggtcattttctctttctttctccctcttgagtccttctgagatgatggctctgggcgcagcgggagctacccgggtctttgtcgcgatggtagcggcggctctcggcggccaccctctgctgggagtgagcgccaccttgaactcggttctcaattccaacgctatcaagaacctgcccccaccgctgggcggcgctgcggggcacccaggctctgcagtcagcgccgcgccgggaatcctgtacccgggcgggaataagtaccagaccattgacaactaccagccgtacccgtgcgcagaggacgaggagtgcggcactgatgagtactgcgctagtcccacccgcggaggggacgcaggcgtgcaaatctgtctcgcctgcaggaagcgccgaaaacgctgcatgcgtcacgctatgtgctgccccgggaattactgcaaaaatggaatatgtgtgtcttctgatcaaaatcatttccgaggagaaattgaggaaaccatcactgaaagctttggtaatgatcatagcaccttggatgggtattccagaagaaccaccttgtcttcaaaaatgtatcacaccaaaggacaagaaggttctgtttgtctccggtcatcagactgtgcctcaggattgtgttgtgctagacacttctggtccaagatctgtaaacctgtcctgaaagaaggtcaagtgtgtaccaagcataggagaaaaggctctcatggactagaaatattccagcgttgttactgtggagaaggtctgtcttgccggatacagaaagatcaccatcaagccagtaattcttctaggcttcacacttgtcagagacactaaaccagctatccaaatgcagtgaactccttttatataatagatgctatgaaaaccttttatgaccttcatcaactcaatcctaaggatatacaagttctgtggtttcagttaagcattccaataacaccttccaaaaacctggagtgtaagagctttgtttctttatggaactcccctgtgattgcagtaaattactgtattgtaaattctcagtgtggcacttacctgtaaatgcaatgaaacttttaattatttttctaaaggtgctgcactgcctatttttcctcttgttatgtaaatttttgtacacattgattgttatcttgactgacaaatattctatattgaactgaagtaaatcatttcagcttatagttcttaaaagcataaccctttaccccatttaattctagagtctagaacgcaaggatctcttggaatgacaaatgataggtacctaaaatgtaacatgaaaatactagcttattttctgaaatgtactatcttaatgcttaaattatatttccctttaggctgtgatagtttttgaaataaaatttaacatttaatatcatgaaatgttataagtagacatacattttgggattgtgatcttagaggtttgtgtgtgtgtacgtatgtgtgtgttctacaagaacggaagtgtgatatgtttaaagatgatcagagaaaagacagtgtctaaatataagacaatattgatcagctctagaataactttaaagaaagacgtgttctgcattgataaactcaaatgatcatggcagaatgagagtgaatcttacattactactttcaaaaatagtttccaataaattaataataccta

SEQ ID NO: 8290 - DNA, 894 bp, Homo sapiens
gtcagactttgctcagccgatttcacgcaccttactcagactaaggtttacttctttcagaaaaagcagtgacaaacagacgacgtgctgagctgccagcttagtggaagctctgctctgggtggagagcagcctcgctttggtgacgcacagtgctgggaccctccaggagccccgggattgaaggatggtggcggccgtcctgctggggctgagctggctctgctctcccctgggagctctggtcctggacttcaacaacatcaggagctctgctgacctgcatggggcccggaagggctcacagtgcctgtctgacacggactgcaataccagaaagttctgcctccagccccgcgatgagaagccgttctgtgctacatgtcgtgggttgcggaggaggtgccagcgagatgccatgtgctgccctgggacactctgtgtgaacgatgtttgtactacgatggaagatgcaaccccaatattagaaaggcagcttgatgagcaagatggcacacatgcagaaggaacaactgggcacccagtccaggaaaaccaacccaaaaggaagccaagtattaagaaatcacaaggcaggaagggacaagagggagaaagttgtctgagaacttttgactgtggccctggactttgctgtgctcgtcatttttggacgaaaatttgtaagccagtccttttggagggacaggtctgctccagaagagggcataaagacactgctcaagctccagaaatcttccagcgttgcgactgtggccctggactactgtgtcgaagccaattgaccagcaatcggcagcatgctcgattaagagtatgccaaaaaatagaaaagctataaatatttcaaaataaagaagaatccacattgca

SEQ ID NO: 8291 - DNA, 999 bp, Homo sapiens
ctttgctcagccgatttcacgcaccttactcagactaaggtttacttctttcagaaaaagcagtgacaaacagacgacgtgctgagctgccagcttagtggaagctctgctctgggtggagagcagcctcgctttggtgacgcacagtgctgggaccctccaggagccccgggattgaaggatggtggcggccgtcctgctggggctgagctggctctgctctcccctgggagctctggtcctggacttcaacaacatcaggagctctgctgacctgcatggggcccggaagggctcacagtgcctgtctgacacggactgcaataccagaaagttctgcctccagccccgcgatgagaagccgttctgtgctacatgtcgtgggttgcggaggaggtgccagcgagatgccatgtgctgccctgggacactctgtgtgaacgatgtttgtactacgatggaagatgcaaccccaatattagaaaggcagcttgatgagcaagatggcacacatgcagaaggaacaactgggcacccagtccaggaaaaccaacccaaaaggaagccaagtattaagaaatcttccagcatgctcgattaagagtatgccaaaaaatagaaaagctataaatatttcaaaataaagaagaatccacattgcatttgagctcaatcttggacattaactttaaaatgcttccatacagatctctcttaaaatcaaatcttgtagcaagtgaaatagcctgaaactagagaactaagagatggcgaccttgtgatgaatgaaactagctttagccttttgtccgtttttccagaaaactgatgggactctgtaaccaaaaaaattatttctaatctagggactcaattaattcaaatctttaagaattgaagccaggcatggtggctcacgcctgtaatcccagcactttgggaggcagaggtgggtggatcacgaggtcaagagtttgagaccagactggccaacactgt

SEQ ID NO: 8292 - DNA, 1029 bp, Homo sapiens
ccgggctcctgggtgaggccggcaagtttggagcgtggtcagacaataggggcgtggctacggctcgcggagcgcaaccaacgctctagaccagacctgggctcgagaccataactgtttggctttaacagtacgtgggcggccggaatccgggagtccggtgacccgggctgtggtctagcataaaggcggagcccagaagaaggggcggggtatgggagaagcctccccacctgcccccgcaaggcggcatctgctggtcctgctgctgctcctctctaccctggtgatcccctccgctgcagctcctatccatgatgctgacgcccaagagagctccttgggtctcacaggcctccagagcctactccaaggcttcagccgacttttcctgaaaggtaacctgcttcggggcatagacagcttattctctgcccccatggacttccggggcctccctgggaactaccacaaagaggagaaccaggagcaccagctggggaacaacaccctctccagccacctccagatcgacaagatgaccgacaacaagacaggagaggtgctgatctccgagaatgtggtggcatccattcaaccagcggaggggagcttcgagggtgatttgaaggtacccaggatggaggagaaggaggccctggtacccatccagaaggccacggacagcttccacacagaactccatccccgggtggccttctggatcattaagctgccacggcggaggtcccaccaggatgccctggagggcggccactggctcagcgagaagcgacaccgcctgcaggccatccgggatggactccgcaaggggacccacaaggacgtcctagaagaggggaccgagagctcctcccactccaggctgtccccccgaaagacccacttactgtacatcctcaggccctctcggcagctgtaggggtggggaccggggagcacctgcctgtagcccccatcagaccctgccccaagcaccatatggaaataaagttctttcttacatct

SEQ ID NO: 8293 - DNA, 664 bp, Homo sapiens
ccgggagtccggtgacccgggctgtggtctagcataaaggcggagcccagaagaaggggcggggtatgggagaagcctccccacctgcccccgcaaggcggcatctgctggtcctgctgctgctcctctctaccctggtgatcccctccgctgcagctcctatccatgatgctgacgcccaagagagctccttgggtctcacaggcctccagagcctactccaaggcttcagccgacttttcctgaaaggtaacctgcttcggggcatagacagcttattctctgcccccatggacttccggggcctccctgggaactaccacaaagaggagaaccaggagcaccagctggggaacaacaccctctccagccacctccagatcgacaaggtacccaggatggaggagaaggaggccctggtacccatccagaaggccacggacagcttccacacagaactccatccccgggtggccttctggatcattaagctgccacggcggaggtcccaccaggatgccctggagggcggccactggctcagcgagaagcgacaccgcctgcaggccatccgggatggactccgcaaggggacccacaaggacgtcctagaagaggggaccgagagctcctcccactccaggctgtccccccgaaagaccca

SEQ ID NO: 8294 - DNA, 2262 bp, Homo sapiens
cagccatggccctgcgcaaggaactgctcaagtccatctggtacgcctttaccgcgctggacgtggagaagagtggcaaagtctccaagtcccagctcaaggtgctgtcccacaacctgtacacggtcctgcacatcccccatgaccccgtggccctggaggaacacttccgagatgatgatgacggccctgtgtccagccagggatacatgccctacctcaacaagtacatcctggacaaggtggaggagggggcttttgttaaagagcactttgatgagctgtgctggacgctgacggccaagaagaactatcgggcagatagcaacgggaacagtatgctctccaatcaggatgccttccgcctctggtgcctcttcaacttcctgtctgaggacaagtaccctctgatcatggttcctgatgaggtggaatacctgctgaaaaaggtactcagcagcatgagcttggaggtgagcttgggtgagctggaggagcttctggcccaggaggcccaggtggcccagaccaccggggggctcagcgtctggcagttcctggagctcttcaattcgggccgctgcctgcggggcgtgggccgggacaccctcagcatggccatccacgaggtctaccaggagctcatccaagatgtcctgaagcagggctacctgtggaagcgagggcacctgagaaggaactgggccgaacgctggttccagctgcagcccagctgcctctgctactttgggagtgaagagtgcaaagagaaaaggggcattatcccgctggatgcacactgctgcgtggaggtgctgccagaccgcgacggaaagcgctgcatgttctgtgtgaagacagccaaccgcacgtatgagatgagcgcctcagacacgcgccagcgccaggagtggacagctgccatccagatggcgatccggctgcaggccgaggggaagacgtccctacacaaggacctgaagcagaaacggcgcgagcagcgggagcagcgggagcggcgccgggcggccaaggaagaggagctgctgcggctgcagcagctgcaggaggagaaggagcggaagctgcaggagctggagctgctgcaggaggcgcagcggcaggccgagcggctgctgcaggaggaggaggaacggcgccgcagccagcaccgcgagctgcagcaggcgctcgagggccaactgcgcgaggcggagcaggcccgggcctccatgcaggctgagatggagctgaaggaggaggaggctgcccggcagcggcagcgcatcaaggagctggaggagatgcagcagcggttgcaggaggccctgcaactagaggtgaaagctcggcgagatgaagaatctgtgcgaatcgctcagaccagactgctggaagaggaggaagagaagctgaagcagttgatgcagctgaaggaggagcaggagcgctacatcgaacgggcgcagcaggagaaggaagagctgcagcaggagatggcacagcagagccgctccctgcagcaggcccagcagcagctggaggaggtgcggcagaaccggcagagggctgacgaggatgtggaggctgcccagagaaaactgcgccaggccagcaccaacgtgaaacactggaatgtccagatgaaccggctgatgcatccaattgagcctggagataagcgtccggtcaccagcagctccttctcaggcttccagccccctctgcttgcccaccgtgactcctccctaaagcgcctgacccgctggggatcccagggcaacaggaccccctcgcccaacagcaatgagcagcagaagtccctcaatggtggggatgaggctcctgccccggcttccacccctcaggaagataaactggatccagcaccagaaaattagcctctcttagccccttgttcttcccaatgtcatatccaccaggacctggccacagctggcctgtgggtgatcccagctcttactaggagagggagctgaggtcctggtgccaggggcccaggccctccaaccataaacagtccaggatggaacctggttcacccttcataccagctccaagccccagaccatgggagctgtctgggatgttgatccttgagaacttggccctgtgctttagacccaaggacccgattcttgggctaggaaagagagaacaagcaagccggggctacctgcccccaggtggccaccaagttgtggaagcacatttctaaataaaaactgctcttagaatgaa

SEQ ID NO: 8295 - DNA, 591 bp, Homo sapiens
agtgtcagagccgcccccagccgggcgggcgcctcagccatggccctgcgcaaggaactgctcaagtccatctggtacgcctttaccgcgctggacgtggagaagagtggcaaagtctccaagtcccagctcaaggtgctgtcccacaacctgtacacggtcctgcacatcccccatgaccccgtggccctggaggaacacttccgagatgatgatgacggccctgtgtccagccagggatacatgccctacctcaacaagtacatcctggacaaggatgccttccgcctctggtgcctcttcaacttcctgtctgaggacaagtaccctctgatcatggttcctgatgaggtggaatacctgctgaaaaaggtactcagcagcatgagcttggaggtgagcttgggtgagctggaggagcttctggcccaggaggcccaggtggcccagaccaccggggggctcagcgtctggcagttcctggagctcttcaattcgggccgctgcctgcggggcgtgggccgggacaccctcagcatggccatccacgaggtctaccaggagctcatccaagatgtcctgaagcagggt

SEQ ID NO: 8296 - DNA, 387 bp, Homo sapiens
ccgagatgatgatgacggccctgtgtccagccagggatacatgccctacctcaacaagtacatcctggacaaggatgccttccgcctctggtgcctcttcaacttcctgtctgaggacaagtaccctctgatcatggttcctgatgaggtggaatacctgctgaaaaaggtactcagcagcatgagcttggaggtgagcttgggtgagctggaggagcttctggcccaggaggcccaggtggcccagaccaccggggggctcagcgtctggcagttcctggagctcttcaattcgggccgctgcctgcggggcgtgggccgggacaccctcagcatggccatccacgaggtctaccaggagctcatccaagatgtcctgaagcaggg

SEQ ID NO: 8297 - DNA, 2006 bp, Homo sapiens
agtgtcagagccgcccccagccgggcgggcgcctcagccatggccctgcgcaaggaactgctcaagtccatctggtacgcctttaccgcgctggacgtggagaagagtggcaaagtctccaagtcccagctcaaggtgctgtcccacaacctgtacacggtcctgcacatcccccatgaccccgtggccctggaggaacacttccgagatgatgatgacggccctgtgtccagccagggatacatgccctacctcaacaagtacatcctggacaaggtggaggagggggcttttgttaaagagcactttgatgagctgtgctggacgctgacggccaagaagaactatcgggcagatagcaacgggaacagtatgctctccaatcaggatgccttccgcctctggtgcctcttcaacttcctgtctgaggacaagtaccctctgatcatggttcctgatgagtagagacagcatttcaccgtgttggccaggctggtctcaaactcctgacctcagatgatctgcccacctcggcctcccaaagtgctgggattacaggtgctgccagaccgcgacggaaagcgctgcatgttctgtgtgaagacagccaaccgcacgtatgagatgagcgcctcagacacgcgccagcgccaggagtggacagctgccatccagatggcgatccggctgcaggccgaggggaagacgtccctacacaaggacctgaagcagaaacggcgcgagcagcgggagcagcgggagcggcgccgggcggccaaggaagaggagctgctgcggctgcagcagctgcaggaggagaaggagcggaagctgcaggagctggagctgctgcaggaggcgcagcggcaggccgagcggctgctgcaggaggaggaggaacggcgccgcagccagcaccgcgagctgcagcaggcgctcgagggccaactgcgcgaggcggagcaggcccgggcctccatgcaggctgagatggagctgaaggaggaggaggctgcccggcagcggcagcgcatcaaggagctggaggagatgcagcagcggttgcaggaggccctgcaactagaggtgaaagctcggcgagatgaagaatctgtgcgaatcgctcagaccagactgctggaagaggaggaagagaagctgaagcagttgatgcagctgaaggaggagcaggagcgctacatcgaacgggcgcagcaggagaaggaagagctgcagcaggagatggcacagcagagccgctccctgcagcaggcccagcagcagctggaggaggtgcggcagaaccggcagagggctgacgaggatgtggaggctgcccagagaaaactgcgccaggccagcaccaacgtgaaacactggaatgtccagatgaaccggctgatgcatccaattgagcctggagataagcgtccggtcaccagcagctccttctcaggcttccagccccctctgcttgcccaccgtgactcctccctaaagcgcctgacccgctggggatcccagggcaacaggaccccctcgcccaacagcaatgagcagcagaagtccctcaatggtggggatgaggctcctgccccggcttccacccctcaggaagataaactggatccagcaccagaaaattagcctctcttagccccttgttcttcccaatgtcatatccaccaggacctggccacagctggcctgtgggtgatcccagctcttactaggagagggagctgaggtcctggtgccaggggcccaggccctccaaccataaacagtccaggatggaacctggttcacccttcataccagctccaagccccagaccatgggagctgtctgggatgttgatccttgagaacttggccctgtgctttagacccaaggacccgattcttgggctaggaaagagagaacaagcaagccggggctacctgcccccaggtggccaccaagttgtggaagcacatttctaaataaaaactgctcttagaatg

SEQ ID NO: 8298 - DNA, 5286 bp, Homo sapiens
atggcccagccggtccacagcctctgctccgcctttggcctccagtgctgcctcctcttccttctagcttcttggggggcaggtgctactacattccaagaatatcagaaaactggggaactctcaacatccgatcacatatttcccctcactccaggccttgtttatagtatcccttttgatcacattgttctgcattcaggacaaagacctccagagctccctaaatctacagaaatccatgagcaaaaacgccactgcaacaccacacgccattctaagccaactgacaagcctacaggcaactccaaaactatagaccacaaaagctctacagataatcatgaggctcctcccacttctgaagaaaactccagcaaccaagggaaagacccaatgatccggaaccagcgctctgttgatcctgctgactccactaccacacataaagaatccgctggaaaaaaacatataacgccagcacccaagagcaaaataaactgtcgtaagtccacaacaggcaaatcaacggtaacaagaaaatcagataaaactggaagacctttggaaaagtccatgagtactttggataagacaagtaccagctcacataagactacaacttccttccacaactcaggcaattcacagaccaagcaaaaaagcacatcttttccagaaaaaatcacagcagcctcaaaaacaacatacaagaccacaggaaccccagaagagtcagaaaaaactgaagattccagaacaacagttgcctcagacaagctcctgacaaaaactacaaaaaacatacaagagaccatatcagccaatgagctcacacaatctctagcagagcctacagaacatggaggaaggacagccaatgagaacaacacaccatccccagcagagcctacagaaaatagagaaaggacagccaatgagaacaccacactatccccagcagagcctatagaaaatagagaaaggacagccaatgagaacaccgcaccattcccagcagggcctacagaaaatagagaaatgacagccaatgagaataccacactattcccagcagagcctacagaacatggagaaaggacagccaatgagaacaccacaccatccccagcagagcctacagaacatggagaaaggacagccaatgagaacactacaccatccccagcagagcctacagaacatggagaaaggaccccatttgccaatgacaaaaccacatcatcctcagcagagtctacagaacatggagaaaggaccccactggccaacgagaacaccacaccatccccagcagagcctacagaaaatagagaaaggacagccaatgagaacaccacaccatccccagcagggcctacagaaaacagagaaacgacagccaacgagaagaccacactatccccagtagagcctacagaaaatagagaaacaacagccaatgagaagaccacaccatccccagcagagcctacagaaaatggacaaaggaccccatttgccaatgagaaaaccacatcatcctcagcagagcctacagaacacggagaaaggaccccactggccaatgagaacaccacaccatccccagcagagcctacagaaaatagagaaaggacagccaatgagaagaccacaccatccccagcagagcctacagaaaatggagacaggactcctttggccaatgagaagaccacgccatctctagcagagcctacagaaaatggacaaaggaccccatttgccaatgagaagaccacatcatcctcagcagagcctacagaacacgaagaaaggactccactggccaatgagaacaccacaccatccccggcagagcctacagaaaatagagaaaggacagccaatgagaacaccacaccatccccagcagggcctacagaaaatagagaaatgacagccaacgagaagaccacactattcccagcagagcctacagaaaatagagaaaggacagccaatgagaagaccacatcatccccagcagagcctacagaaaatggacaaaggaccccatttgccaatgagaaaaccacatcatcctcagcagagcctacagaacacggagaaaggaccccactggccaatgagaacaccacactatccccagcagagcctacagaaaatagagaaaggacagccaatgagaagaccacaccattcccagcagagcctacagaaaatagagaaaggacagccaatgagaacaccacaccatccccagcacagcctacagaaaatggagacaggactccattggccaatgagaagaccacaccatctctagcagagcctacagaaaatggaaaaaggaccccatttgccaatgagaagaccacatcatcctcagcagagcctacagaacacgcagaaaggactccactggccaatgagaacaccacatcatccccagcagagcctacagaaaatagagaaaggacagccaatgagaagaccacacaattcccagcagagcctacagaaaatagagaaagcacagccaatgagaagaccacaccattcccagcagagcctacagaaaatagagaatggacagccaatgagaacaccacactatccccagcagagcctacagaacatgaagaaatgaccccattggccaatgagaagaccacactatccccagcagagcctacagaaaatggagaaaggaccccatttaccaatgagaagaccacaccatcctcagcagagcctacagaacatggagaaaggaccccactggccaatgagatcaccacaccatcccgagcagagcctacagaacatggagaaaggatagccaatgagaaggccacaccatccccagcaaagcctacagaacatggagaaacgacagtcaatgaggacaccacaccatcctcagcagagcctacagaaaatggagaaaggaccccactggccaatgagaacaccacaacatccccaacagagtctacagaacatggagaaaggacagccaatgagaagaccacaccatccccagcagagcctacagaacatggagaaaggacaccatcagccaatgagaagaccataccatctccagcaaagcctacagaacacgaagaaatgaccccatcggccaatgagaacaccacaccatccccagtaaagcctacagaacatggagaaaagactacattggccaatgagaagatcacactatccccagaagggcctacagaacatggagcaaaaactacgtcggccaatgagaagatcacaccatccctagcaaagcctacagaacatggagaaaggaccacatcacccaatgacaagatcacctcatctgcagcagagtctacagaacatagagatagggctacatcagccaatgtgatcacaccagccccagcagagcctataaaacatgcaaaaaggaccacattggcccatgagaagatgacacaagtcacagaaaagtccacagaacacccagaaaagaccacgtcaaccacagagaaaaccacaagaaccccagaaaagcctacgctatactcagagaagaccatatgcaccaaagggaaaaacacaccagtcccagaaaagcctacagaaaacctggggaacaccacactgaccactgagaccataaaagccccagtaaagtccacagaaaacccagaaaaaacagcagcagtcacaaagactataaaaccttcagtcaaggtcacaggagacaaatctctcactactacctcttctcatctaaataaaactgaagttactcatcaggtgcccactggttctttcaccctcattacatctagaacgaagctgagttctatcacatcagaagccacaggaaacgagagccatccatacctcaataaagatggctcacagaaaggtatccacgctggacagatgggagagaatgattcattccctgcatgggccatagttattgtggtcctggtggctgtgattctcctcctggtgttccttggcctgatcttcttggtctcctatatgatgcggacacgccgcacactaacccagaacacccagtacaatgatgcagaggatgagggtggccccaattcctacccggtctacctgatggagcagcagaatcttggcatgggccagatcccttccccacggtgatcttggagtaggcgcccagccctggctcttccatgctctgcccctttcctggatgaggaaccggactcacaatttctatttccgggactacaggaagggcagagaatactgacggttaccagtattaacccttcatctgttcttgaaactggttggggaatgaggtgataagcaaggagggtgtaagtttaggggacaaagaagaaagaatgaataatacgagcagacattctctgtagaaggtaatggtctgagaatgaaaaggtgtttgatggacatgttgtgggggcaccaatgcagaacactgcactgagtcctaaaggaaggacaggagccttataggcaatgccccagactgacttgtgagtggggtttatggggaaagggagggactgagggcagagtctctgggtttcaggacagcattatgttatttccattcactattacttaagagtttgtgtgtaaacaggctcatctctgagttctcaggacccttgcccccacccccatttttttaatgaaaaaaaaaaacaaaaaaaacggatccaagaagaaaagagaatttatttccttctccactctctccatgccctggagaaaaaaaagtccagaagaaatcataaatatctctcatctacatggttgcttcctcttcctcccaaatcccttagttttcctaaatgtctacagtggacgccctgttggtttggcttgctgggttgtgggtggacacgcaaggaggggatttttatttggccagcagtctcacccactgatctccaccccagaccttccctgattggtgtctcagcatttattttcctgtctcttccaccaaaagccagctgtagctttatctcgtaaaagttacccatcttctctactgtccccattctctctcctcccaccttcaccccagattcaagttttcctccttgtaggcatttcatctgtgtgtgttttctggattttctctctctcttcttatggccatttcaccttattactgattgggtagagggggaaaaggagaatgatgatgatagtttccttctgtctattgaccttttttataataaagtataacatgtttataaaggg

SEQ ID NO: 8299 - DNA, 2627 bp, Homo sapiens
ccattggccaatgagaagaccacactatccccagcagagcctacagaaaatggagaaaggaccccatttaccaatgagaagaccacaccatcctcagcagagcctacagaacatggagaaaggaccccactggccaatgagatcaccacaccatcccgagcagagcctacagaacatggagaaaggatagccaatgagaaggccacaccatccccagcaaagcctacagaacatggagaaacgacagtcaatgaggacaccacaccatcctcagcagagcctacagaaaatggagaaaggaccccactggccaatgagaacaccacaacatccccaacagagtctacagaacatggagaaaggacagccaatgagaagaccacaccatccccagcagagcctacagaacatggagaaaggacaccatcagccaatgagaagaccataccatctccagcaaagcctacagaacacgaagaaatgaccccatcggccaatgagaacaccacaccatccccagtaaagcctacagaacatggagaaaagactacattggccaatgagaagatcacactatccccagaagggcctacagaacatggagcaaaaactacgtcggccaatgagaagatcacaccatccctagcaaagcctacagaacatggagaaaggaccacatcacccaatgacaagatcacctcatctgcagcagagtctacagaacatagagatagggctacatcagccaatgtgatcacaccagccccagcagagcctataaaacatgcaaaaaggaccacactggcccatgagaagatgacacaagtcacagaaaagtccacagaacacccagaaaagaccacgtcaaccacagagaaaaccacaagaaccccagaaaagcctacgctatactcagagaagaccatatgcaccaaagggaaaaacacaccagtcccagaaaagcctacagaaaacctggggaacaccacactgaccactgagaccataaaagccccagtaaagtccacagaaaacccagaaaaaacagcagcagtcacaaagactataaaaccttcagtcaaggtcacaggagacaaatctctcactactacctcttctcatctaaataaaactgaagttactcatcaggtgcccactggttctttcaccctcattacatctagaacgaagctgagttctatcacatcagaagccacaggaaacgagagccatccatacctcaataaagatggctcacagaaaggtatccacgctggacagatgggagagaatgattcattccctgcatgggccatagttattgtggtcctggtggctgtgattctcctcctggtgttccttggcctgatcttcttggtctcctatatgatgcggacacgccgcacactaacccagaacacccagtacaatgatgcagaggatgagggtggccccaattcctacccggtctacctgatggagcagcagaatcttggcatgggccagatcccttccccacggtgatcttggagtaggcgcccagccctggctcttccatgctctgcccctttcctggatgaggaaccggactcacaatttctatttccgggactacaggaagggcagagaatactgacggttaccagtattaacccttcatctgttcttgaaactggttggggaatgaggtgataagcaaggagggtgtaagtttaggggacaaagaagaaagaatgaataatacgagcagacattctctgtagaaggtaatggtctgagaatgaaaaggtgtttgatggacatgttgtgggggcaccaatgcagaacactgcactgagtcctaaaggaaggacaggagccttataggcaatgccccagactgacttgtgagtggggtttatggggaaagggagggactgagggcagagtctctgggtttcaggacagcattatgttatttccattcactattacttaagagtttgtgtgtaaacaggctcatctctgagttctcaggacccttgcccccacccccatttttttaatgaaaaaaaaaacaaaaaaaacggatccaagaagaaaagagaatttatttccttctccactctctccatgccctggagaaaaaaaagtccagaagaaatcataaatatctctcatctacatggttgcttcctcttcctcccaaatcccttagttttcctaaatgtctacagtggacgccctgttggtttggcttgctgggttgtgggtggacacgcaaggaggggatttttatttggccagcagtctcacccactgatctccaccccagaccttccctgattggtgtctcagcatttattttcctgtctcttccaccaaaagccagctgtagctttatctcgtaaaagttacccatcttctctactgtccccattctctctcctcccaccttcaccccagattcaagttttcctccttgtaggcatttcatctgtgtgtgttttctggattttctctctctcttcttatggccatttcaccttattactgattgggtagagggggaaaaggagaatgatgatgatagtttccttctgtctattgaccttttttataataaagtataacatgtttataaaggg

SEQ ID NO: 8300 - DNA, 2627 bp, Homo sapiens
ccattggccaatgagaagaccacactatccccagcagagcctacagaaaatggagaaaggaccccatttaccaatgagaagaccacaccatcctcagcagagcctacagaacatggagaaaggaccccactggccaatgagatcaccacaccatcccgagcagagcctacagaacatggagaaaggatagccaatgagaaggccacaccatccccagcaaagcctacagaacatggagaaacgacagtcaatgaggacaccacaccatcctcagcagagcctacagaaaatggagaaaggaccccactggccaatgagaacaccacaacatccccaacagagtctacagaacatggagaaaggacagccaatgagaagaccacaccatccccagcagagcctacagaacatggagaaaggacaccatcagccaatgagaagaccataccatctccagcaaagcctacagaacacgaagaaatgaccccatcagccaatgagaacaccacaccatccccagtaaagcctacagaacatggagaaaagactacattggccaatgagaagatcacactatccccagaagggcctacagaacatggagcaaaaactacgtcggccaatgagaagatcacaccatccctagcaaagcctacagaacatggagaaaggaccacatcacccaatgacaagatcacctcatctgcagcagagtctacagaacatagagatagggctacatcagccaatgtgatcacaccagccccagcagagcctataaaacatgcaaaaaggaccacattggcccatgagaagatgacacaagtcacagaaaagtccacagaacacccagaaaagaccacgtcaaccacagagaaaaccacaagaaccccagaaaagcctacgctatactcagagaagaccatatgcaccaaagggaaaaacacaccagtcccagaaaagcctacagaaaacctggggaacaccacactgaccactgagaccataaaagccccagtaaagtccacagaaaacccagaaaaaacagcagcagtcacaaagactataaaaccttcagtcaaggtcacaggagacaaatctctcactactacctcttctcatctaaataaaactgaagttactcatcaggtgcccactggttctttcaccctcattacatctagaacgaagctgagttctatcacatcagaagccacaggaaacaagagccatccatacctcaataaagatggctcacagaaaggtatccacgctggacagatgggagagaatgattcattccctgcatgggccatagttattgtggtcctggtggctgtgattctcctcctggtgttccttggcctgatcttcttggtctcctatatgatgcggacacgccgcacactaacccagaacacccagtacaatgatgcagaggatgagggtggccccaattcctacccggtctacctgatggagcagcagaatcttggcatgggccagatcccttccccacggtgatcttggagtaggcgcccagccctggctcttccatgctctgcccctttcctggatgaggaaccggactcacaatttctatttccgggactacaggaagggcagagaatactgacggttaccagtattaacccttcatctgttcttgaaactggttggggaatgaggtgataagcaaggagggtgtaagtttaggggacaaagaagaaagaatgaataatacgagcagacattctctgtagaaggtaatggtctgagaatgaaaaggtgtttgatggacatgttgtgggggcaccaatgcagaacactgcactgagtcctaaaggaaggacaggagccttataggcaatgccccagactgacttgtgagtggggtttatggggaaagggagggactgagggcagagtctctgggtttcaggacagcattatgttatttccattcactattacttaagagtttgtgtgtaaacaggctcatctctgagttctcaggacccttgcccccacccccatttttttaatgaaaaaaaaaacaaaaaaaacggatccaagaagaaaagagaatttatttccttctccactctctccatgccctggagaaaaaaaagtccagaagaaatcataaatatctctcatctacatggttgcttcctcttcctcccaaatcccttagttttcctaaatgtctacagtggacgccctgttggtttggcttgctgggttgtgggtggacacgcaaggaggggatttttatttggccagcagtctcacccactgatctccaccccagaccttccctgattggtgtctcagcatttattttcctgtctcttccaccaaaagccagctgtagctttatctcgtaaaagttacccatcttctctactgtccccattctctctcctcccaccttcaccccagattcaagttttcctccttgtaggcatttcatctgtgtgtgttttctggattttctctctctcttcttatggccatttcaccttattactgattgggtagagggggaaaaggagaatgatgatgatagtttccttctgtctattgaccttttttataataaagtataacatgtttataaaggg

SEQ ID NO: 8301 - DNA, 2627 bp, Homo sapiens
ccattggccaatgagaagaccacactatccccagcagagcctacagaaaatggagaaaggaccccatttaccaatgagaagaccacaccatcctcagcagagcctacagaacatggagaaaggaccccactggccaatgagatcaccacaccatcccgagcagagcctacagaacatggagaaaggatagccaatgagaaggccacaccatccccagcaaagcctacagaacatggagaaacgacagtcaatgaggacaccacaccatcctcagcagagcctacagaaaatggagaaaggaccccactggccaatgagaacaccacaacatccccaacagagtctacagaacatggagaaaggacagccaatgagaagaccacaccatccccagcagagcctacagaacatggagaaaggacaccatcagccaatgagaagaccataccatctccagcaaagcctacagaacacgaagaaatgaccccatcggccaatgagaacaccacaccatccccagtaaagcctacagaacatggagaaaagactacattggccaatgagaagatcacactatccccagaagggcctacagaacatggagcaaaaactacgtcggccaatgagaagatcacaccatccctagcaaagcctacagaacatggagaaaggaccacatcacccaatgacaagatcacctcatctgcagcagagtctacagaacatagagatagggctacatcagccaatgtgatcacaccagccccagcagagcctataaaacatgcaaaaaggaccacattggcccatgagaagatgacacaagtcacagaaaagtccacagaacacccagaaaagaccacgtcaaccacagagaaaaccacaagaaccccagaaaagcctacgctatactcagagaagaccatatgcaccaaagggaaaaacacaccagtcccagaaaagcctacagaaaacctggggaacaccacactgaccactgagaccataaaagccccagtaaagtccacagaaaacccagaaaaaacagcagcagtcacaaagactataaaaccttcagtcaaggtcacaggagacaaatctctcactactacctcttctcatctaaataaaactgaagttactcatcaggtgcccactggttctttcaccctcattacatctagaacgaagctgagttctatcacatcagaagccacaggaaacgagagccatccatacctcaataaagatggctcacagaaaggtatccacgctggacagatgggagagaatgattcattccctgcatgggccatagttattgtggtcctggtggctgtgattctcctcctggtgttccttggcctgatcttcttggtctcctatatgatgcggacacgccgcacactaacccagaacacccagtacaatgatgcagaggatgagggtggccccaattcctacccggtctacctgatggagcagcagaatcttggcatgggccagatcccttccccacggtgatcttggagtaggcgcccagccctggctcttccatgctctgcccctttcctggatgaggaaccagactcacaatttctatttccgggactacaggaagggcagagaatactgacggttaccagtattaacccttcatctgttcttgaaactggttggggaatgaggtgataagcaaggagggtgtaagtttaggggacaaagaagaaagaatgaataatacgagcagacattctctgtagaaggtaatggtctgagaatgaaaaggtgtttgatggacatgttgtgggggcaccaatgcagaacactgcactgagtcctaaaggaaggacaggagccttataggcaatgccccagactgacttgtgagtggggtttatggggaaagggagggactgagggcagagtctctgggtttcaggacagcattatgttatttccattcactattacttaagagtttgtgtgtaaataggctcatctctgagttctcaggacccttgcccccacccccatttttttaatgaaaaaaaaaacaaaaaaaacggatccaagaagaaaagagaatttatttccttctccactctctccatgccctggagaaaaaaaagtccagaagaaatcataaatatctctcatctacatggttgcttcctcttcctcccaaatcccttagttttcctaaatgtctacagtggacgccctgttggtttggcttgctgggttgtgggtggacacgcaaggaggggatttttatttggccagcagtctcacccactgatctccaccccagaccttccctgattggtgtctcagcatttattttcctgtctcttccaccaaaagccagctgtagctttatctcgtaaaagttacccatcttctctactgtccccattctctctcctcccaccttcaccccagattcaagttttcctccttgtaggcatttcatctgtgtgtgttttctggattttctctctctcttcctatggccatttcaccttattactgattgggtagagggggaaaaggagaatgatgatgatagtttccttctgtctattgaccttttttataataaagtataacatgtttataaaggg

SEQ ID NO: 8302 - DNA, 2658 bp, Homo sapiens
atggcccagccggtccacagcctctgctccgcctttggcctccagtgctgcctcctcttccttctagcttcttggggggcaggtgctactacattccaagaatatcagaaaactggggaactctcaacatccgatcacatatttcccctcactccaggccttgtttatagtatcccttttgatcacattgttctgcattcaggacaaagacctccagagctccctaaatctacagaaatccatgagcaaaaacgccactgcaacaccacacgccattctaagccaactgacaagcctacaggcaactccaaaactatagaccacaaaagctctacagataatcatgaggctcctcccacttctgaagaaaactccagcaaccaagggaaagacccaatgatccggaaccagcgctctgttgatcctgctgactccactaccacacataaagaatccgctggaaaaaaacatataacgccagcacccaagagcaaaataaactgtcgtaagtccacaacaggcaaatcaacggtaacaagaaaatcagataaaactggaagacctttggaaaagtccatgagtactttggataagacaagtaccagctcacataagactacaacttccttccacaactcaggcaattcacagaccaagcaaaaaagcacatcttttccagaaaaaatcacagcagcctcaaaaacaacatacaagaccacaggaaccccagaagagtcagaaaaaactgaagattccagaacaacagttgcctcagacaagctcctgacaaaaactacaaaaaacatacaagagaccatatcagccaatgagctcacacaatctctagcagagcctacagaacatggaggaaggacagccaatgagaacaacacaccatccccagcagagcctacagaaaatagagaaaggacagccaatgagaacaagaagaccatatgcaccaaagggaaaaacacaccagtcccagaaaagcctacagaaaacctggggaacaccacactgaccactgagaccataaaagccccagtaaagtccacagaaaacccagaaaaaacagcagcagtcacaaagactataaaaccttcagtcaaggtcacaggagacaaatctctcactactacctcttctcatctaaataaaactgaagttactcatcaggtgcccactggttctttcaccctcattacatctagaacgaagctgagttctatcacatcagaagccacaggaaacgagagccatccatacctcaataaagatggctcacagaaaggtatccacgctggacagatgggagagaatgattcattccctgcatgggccatagttattgtggtcctggtggctgtgattctcctcctggtgttccttggcctgatcttcttggtctcctatatgatgcggacacgccgcacactaacccagaacacccagtacaatgatgcagaggatgagggtggccccaattcctacccggtctacctgatggagcagcagaatcttggcatgggccagatcccttccccacggtgatcttggagtaggcgcccagccctggctcttccatgctctgcccctttcctggatgaggaaccggactcacaatttctatttccgggactacaggaagggcagagaatactgacggttaccagtattaacccttcatctgttcttgaaactggttggggaatgaggtgataagcaaggagggtgtaagtttaggggacaaagaagaaagaatgaataatacgagcagacattctctgtagaaggtaatggtctgagaatgaaaaggtgtttgatggacatgttgtgggggcaccaatgcagaacactgcactgagtcctaaaggaaggacaggagccttataggcaatgccccagactgacttgtgagtggggtttatggggaaagggagggactgagggcagagtctctgggtttcaggacagcattatgttatttccattcactattacttaagagtttgtgtgtaaacaggctcatctctgagttctcaggacccttgcccccacccccatttttttaatgaaaaaaaaaaacaaaaaaaacggatccaagaagaaaagagaatttatttccttctccactctctccatgccctggagaaaaaaaagtccagaagaaatcataaatatctctcatctacatggttgcttcctcttcctcccaaatcccttagttttcctaaatgtctacagtggacgccctgttggtttggcttgctgggttgtgggtggacacgcaaggaggggatttttatttggccagcagtctcacccactgatctccaccccagaccttccctgattggtgtctcagcatttattttcctgtctcttccaccaaaagccagctgtagctttatctcgtaaaagttacccatcttctctactgtccccattctctctcctcccaccttcaccccagattcaagttttcctccttgtaggcatttcatctgtgtgtgttttctggattttctctctctcttcttatggccatttcaccttattactgattgggtagagggggaaaaggagaatgatgatgatagtttccttctgtctattgaccttttttataataaagtataacatgtttataaaggg

SEQ ID NO: 8303 - DNA, 1689 bp, Homo sapiens
atggcccagccggtccacagcctctgctccgcctttggcctccagtgctgcctcctcttccttctagcttcttggggggcaggtgctactacattccaagaatatcagaaaactggggaactctcaacatccgatcacatatttcccctcactccaggccttgtttatagtatcccttttgatcacattgttctgcattcaggacaaagacctccagagctccctaaatctacagaaatccatgagcaaaaacgccactgcaacaccacacgccattctaagccaactgacaagcctacaggcaactccaaaactatagaccacaaaagctctacagataatcatgaggctcctcccacttctgaagaaaactccagcaaccaagggaaagacccaatgatccggaaccagcgctctgttgatcctgctgactccactaccacacataaagaatccgctggaaaaaaacatataacgccagcacccaagagcaaaataaactgtcgtaagtccacaacaggcaaatcaacggtaacaagaaaatcagataaaactggaagacctttggaaaagtccatgagtactttggataagacaagtaccagctcacataagactacaacttccttccacaactcaggcaattcacagaccaagcaaaaaagcacatcttttccagaaaaaatcacagcagcctcaaaaacaacatacaagaccacaggaaccccagaagagtcagaaaaaactgaagattccagaacaacagttgcctcagacaagctcctgacaaaaactacaaaaaacatacaagagaccatatcagccaatgagctcacacaatctctagcagagcctacagaacatggaggaaggacagccaatgagaacaacacaccatccccagcagagcctacagaaaatagagaaaggacagccaatgagaacaagaagaccatatgcaccaaagggaaaaacacaccagtcccagaaaagcctacagaaaacctggggaacaccacactgaccactgagaccataaaagccccagtaaagtccacagaaaacccagaaaaaacagcagcagtcacaaagactataaaaccttcagtcaaggtcacaggagacaaatctctcactactacctcttctcatctaaataaaactgaagttactcatcaggtgcccactggttctttcaccctcattacatctagaacgaagctgagttctatcacatcagaagccacaggaaacgagagccatccatacctcaataaagatggctcacagaaaggtatccacgctggacagatgggagagaatgattcattccctgcatgggccatagttattgtggtcctggtggctgtgattctcctcctggtgttccttggcctgatcttcttggtctcctatatgatgcggacacgccgcacactaacccagaacacccagtacaatgatgcagaggatgagggtggccccaattcctacccggtctacctgatggagcagcagaatcttggcatgggccagatcccttccccacggtgatcttggagtaggcgcccagccctggctcttccatgctctgcccctttcctggatgaggaaccagactcacaatttctatttccgggactacaggaagggcagagaatactgacggttaccagtattaacccttca

SEQ ID NO: 8304 - DNA, 1689 bp, Homo sapiens
atggcccagccggtccacagcctctgctccgcctttggcctccagtgctgcctcctcttccttctagcttcttggggggcaggtgctactacattccaagaatatcagaaaactggggaactctcaacatccgatcacatatttcccctcactccaggccttgtttatagtatcccttttgatcacattgttctgcattcaggacaaagacctccagagctccctaaatctacagaaatccatgagcaaaaacgccactgcaacaccacacgccattctaagccaactgacaagcctacaggcaactccaaaactatagaccacaaaagctctacagataatcatgaggctcctcccacttctgaagaaaactccagcaaccaagggaaagacccaatgatccggaaccagcgctctgttgatcctgctgactccactaccacacataaagaatccgctggaaaaaaacatataacaccagcacccaagagcaaaataaactgtcgtaagtccacaacaggcaaatcaacggtaacaagaaaatcagataaaactggaagacctttggaaaagtccatgagtactttggataagacaagtaccagctcacataagactacaacttccttccacaactcaggcaattcacagaccaagcaaaaaagcacatcttttccagaaaaaatcacagcagcctcaaaaacaacatacaagaccacaggaaccccagaagagtcagaaaaaactgaagattccagaacaacagttgcctcagacaagctcctgacaaaaactacaaaaaacatacaagagaccatatcagccaatgagctcacacaatctctagcagagcctacagaacatggaggaaggacagccaatgagaacaacacaccatccccagcagagcctacagaaaatagagaaaggacagccaatgagaacaagaagaccatatgcaccaaagggaaaaacacaccagtcccagaaaagcctacagaaaacctggggaacaccacactgaccactgagaccataaaagccccagtaaagtccacagaaaacccagaaaaaacagcagcagtcacaaagactataaaaccttcagtcaaggtcacaggagacaaatctctcactactacctcttctcatctaaataaaactgaagttactcatcaggtgcccactggttctttcaccctcattacatctagaacgaagctgagttctatcacatcagaagccacaggaaacgagagccatccatacctcaataaagatggctcacagaaaggtatccacgctggacagatgggagagaatgattcattccctgcatgggccatagttattgtggtcctggtggctgtgattctcctcctggtgttccttggcctgatcttcttggtctcctatatgatgcggacacgccgcacactaacccagaacacccagtacaatgatgcagaggatgagggtggccccaattcctacccggtctacctgatggagcagcagaatcttggcatgggccagatcccttccccacggtgatcttggagtaggcgcccagccctggctcttccatgctctgcccctttcctggatgaggaaccggactcacaatttctatttccgggactacaggaagggcagagaatactgacggttaccagtattaacccttca

SEQ ID NO: 8305 - DNA, 4317 bp, Homo sapiens
atggcccagccggtccacagcctctgctccgcctttggcctccagtgctgcctcctcttccttctagcttcttggggggcaggtgctactacattccaagaatatcagaaaactggggaactctcaacatccgatcacatatttcccctcactccaggccttgtttatagtatcccttttgatcacattgttctgcattcaggacaaagacctccagagctccctaaatctacagaaatccatgagcaaaaacgccactgcaacaccacacgccattctaagccaactgacaagcctacaggcaactccaaaactatagaccacaaaagctctacagataatcatgaggctcctcccacttctgaagaaaactccagcaaccaagggaaagacccaatgatccggaaccagcgctctgttgatcctgctgactccactaccacacataaagaatccgctggaaaaaaacatataacgccagcacccaagagcaaaataaactgtcgtaagtccacaacaggcaaatcaacggtaacaagaaaatcagataaaactggaagacctttggaaaagtccatgagtactttggataagacaagtaccagctcacataagactacaacttccttccacaactcaggcaattcacagaccaagcaaaaaagcacatcttttccagaaaaaatcacagcagcctcaaaaacaacatacaagaccacaggaaccccagaagagtcagaaaaaactgaagattccagaacaacagttgcctcagacaagctcctgacaaaaactacaaaaaacatacaagagaccatatcagccaatgagctcacacaatctctagcagagcctacagaacatggaggaaggacagccaatgagaacaacacaccatccccagcagagcctacagaaaatagagaaaggacagccaatgagaacaccacactatccccagcagagcctacagaaaatagagaaaggacagccaatgagaacaccgcaccattcccagcagggcctacagaaaatagagaaatgacagccaatgagaataccacactattcccagcagagcctacagaacatggagaaaggacagccaatgagaacaccacaccatccccagcagagcctacagaacatggagaaaggacagccaatgagaacactacaccatccccagcagagcctacagaacatggagaaaggaccccatttgccaatgacaaaaccacatcatcctcagcagagtctacagaacatggagaaaggaccccactggccaacgagaacaccacaccatccccagcagagcctacagaaaatagagaaaggacagccaatgagaacaccacaccatccccagcagggcctacagaaaacagagaaacgacagccaacgagaagaccacactatccccagtagagcctacagaaaatagagaaacaacagccaatgagaagaccacaccatccccagcagagcctacagaaaatggacaaaggaccccatttgccaatgagaaaaccacatcatcctcagcagagcctacagaacacggagaaaggaccccactggccaatgagaacaccacaccatccccagcagagcctacagaaaatagagaaaggacagccaatgagaagaccacaccatccccagcagagcctacagaaaatggagacaggactcctttggccaatgagaagaccacgccatctctagcagagcctacagaaaatggacaaaggaccccatttgccaatgagaagaccacatcatcctcagcagagcctacagaacacgaagaaaggactccactggccaatgagaacaccacaccatccccggcagagcctacagaaaatagagaaaggacagccaatgagaacaccacaccatccccagcagggcctacagaaaatagagaaatgacagccaacgagaagaccacactattcccagcagagcctacagaaaatagagaaaggacagccaatgagaagaccacatcatccccagcagagcctacagaaaatggacaaaggaccccatttgccaatgagaaaaccacatcatcctcagcagagcctacagaacacggagaaaggaccccactggccaatgagaacaccacactatccccagcagagcctacagaaaatagagaaaggacagccaatgagaagaccacaccattcccagcagagcctacagaaaatagagaaaggacagccaatgagaacaccacaccatccccagcacagcctacagaaaatggagacaggactccattggccaatgagaagaccacaccatctctagcagagcctacagaaaatggaaaaaggaccccatttgccaatgagaagaccacatcatcctcagcagagcctacagaacacgcagaaaggactccactggccaatgagaacaccacatcatccccagcagagcctacagaaaatagagaaaggacagccaatgagaagaccacacaattcccagcagagcctacagaaaatagagaaagcacagccaatgagaagaccacaccattcccagcagagcctacagaaaatagagaatggacagccaatgagaacaccacactatccccagcagagcctacagaacatgaagaaatgaccccattggccaatgagaagaccacactatccccagcagagcctacagaaaatggagaaaggaccccatttaccaatgagaagaccacaccatcctcagcagagcctacagaacatggagaaaggaccccactggccaatgagatcaccacaccatcccgagcagagcctacagaacatggagaaaggatagccaatgagaaggccacaccatccccagcaaagcctacagaacatggagaaacgacagtcaatgaggacaccacaccatcctcagcagagcctacagaaaatggagaaaggaccccactggccaatgagaacaccacaacatccccaacagagtctacagaacatggagaaaggacagccaatgagaagaccacaccatccccagcagagcctacagaacatggagaaaggacaccatcagccaatgagaagaccataccatctccagcaaagcctacagaacacgaagaaatgaccccatcggccaatgagaacaccacaccatccccagtaaagcctacagaacatggagaaaagactacattggccaatgagaagatcacactatccccagaagggcctacagaacatggagcaaaaactacgtcggccaatgagaagatcacaccatccctagcaaagcctacagaacatggagaaaggaccacatcacccaatgacaagatcacctcatctgcagcagagtctacagaacatagagatagggctacatcagccaatgtgatcacaccagccccagcagagcctataaaacatgcaaaaaggaccacattggcccatgagaagatgacacaagtcacagaaaagtccacagaacacccagaaaagaccacgtcaaccacagagaaaaccacaagaaccccagaaaagcctacgctatactcagagaagaccatatgcaccaaagggaaaaacacaccagtcccagaaaagcctacagaaaacctggggaacaccacactgaccactgagaccataaaagccccagtaaagtccacagaaaacccagaaaaaacagcagcagtcacaaagactataaaaccttcagtcaaggtcacaggagacaaatctctcactactacctcttctcatctaaataaaactgaagttactcatcaggtgcccactggttctttcaccctcattacatctagaacgaagctgagttctatcacatcagaagccacaggaaacgagagccatccatacctcaataaagatggctcacagaaaggtatccacgctggacagatgggagagaatgattcattccctgcatgggccatagttattgtggtcctggtggctgtgattctcctcctggtgttccttggcctgatcttcttggtctcctatatgatgcggacacgccgcacactaacccagaacacccagtacaatgatgcagaggatgagggtggccccaattcctacccggtctacctgatggagcagcagaatcttggcatgggccagatcccttccccacggtgatcttggagtaggcgcccagccctggctcttccatgctctgcccctttcctggatgaggaaccagactcacaatttctatttccgggactacaggaagggcagagaatactgacggttaccagtattaacccttca

SEQ ID NO: 8306 - DNA, 2695 bp, Homo sapiens
ggtccccaagcagccacccagctccgacatggcccagccggtccacagcctctgctccgcctttggcctccagtgctgcctcctcttccttctagcttcttggggggcaggtgctactacattccaagaatatcagaaaactggggaactctcaacatccgatcacatatttcccctcactccaggccttgtttatagtatcccttttgatcacattgttctgcattcaggacaaagacctccagagctccctaaatctacagaaatccatgagcaaaaacgccactgcaacaccacacgccattctaagccaactgacaagcctacaggcaactccaaaactatagaccacaaaagctctacagataatcatgaggctcctcccacttctgaagaaaactccagcaaccaagggaaagacccaatgatccggaaccagcgctctgttgatcctgctgactccactaccacacataaagaatccgctggaaaaaaacatataacgccagcacccaagagcaaaataaactgtcgtaagtccacaacaggcaaatcaacggtaacaagaaaatcagataaaactggaagacctttggaaaagtccatgagtactttggataagacaagtaccagctcacataagactacaacttccttccacaactcaggcaattcacagaccaagcaaaaaagcacatcttttccagaaaaaatcacagcagcctcaaaaacaacatacaagaccacaggaaccccagaagagtcagaaaaaactgaagattccagaacaacagttgcctcagacaagctcctgacaaaaactacaaaaaacatacaagagaccatatcagccaatgagctcacacaatctctagcagagcctacagaacatggaggaaggacagccaatgagaacaacacaccatccccagcagagcctacagaaaatagagaaaggacagccaatgagaacaccacactatccccagcagagcctacagaaaatagagaaaggacagccaatgagaacaccgcaccattcccagcagggcctacagaaaatagagaaatgacagccaatgagaataccacactattcccagcagagcctacagaacatggagaaaggacagccaatgagaacaccacaccatccccagcagagcctacagaacatggagaaaggacagccaatgagaacactacaccatccccagcagagcctacagaacatggagaaaggaccccatttgccaatgacaaaaccacatcatcctcagcagagtctacagaacatggagaaaggaccccactggccaacgagaacaccacaccatccccagcagagcctacagaaaatagagaaaggacagccaatgagaacaccacaccatccccagcagggcctacagaaaacagagaaacgacagccaacgagaagaccacactatccccagtagagcctacagaaaatagagaaacaacagccaatgagaagaccacaccatccccagcagagcctacagaaaatggacaaaggaccccatttgccaatgagaaaaccacatcatcctcagcagagcctacagaacacggagaaaggaccccactggccaatgagaacaccacaccatccccagcagagcctacagaaaatagagaaaggacagccaatgagaagaccacaccatccccagcagagcctacagaaaatggagacaggactcctttggccaatgagaagaccacgccatctctagcagagcctacagaaaatggacaaaggaccccatttgccaatgagaagaccacatcatcctcagcagagcctacagaacacgaagaaaggactccactggccaatgagaacaccacaccatccccggcagagcctacagaaaatagagaaaggacagccaatgagaacaccacaccatccccagcagggcctacagaaaatagagaaatgacagccaacgagaagaccacactattcccagcagagcctacagaaaatagagaaaggacagccaatgagaagaccacatcatccccagcagagcctacagaaaatggacaaaggaccccatttgccaatgagaaaaccacatcatcctcagcagagcctacagaacacggagaaaggaccccactggccaatgagaacaccacactatccccagcagggcctacagaaaatagagaaaggacagccaatgagaagaccacaccattcccagcagagcctacagaaaatagagaaaggacagccaatgagaacaccacaccatccccagcacagcctacagaaaatggagacaggactccattggccaatgagaagaccacaccatctctagcagagcctacagaaaatggaaaaaggaccccatttgccaatgagaagaccacatcatcctcagcagagcctacagaacacgcagaaaggactccactggccaatgagaacaccacatcatccccagcagagcctacagaaaatagagaaaggacagccaatgagaagaccacacaattcccagcagagcctacagaaaatagagaaagcacagccaatgagaagaccacaccattcccagcagagcctacagaaaatagagaatggacagccaatgagaacaccacactatccccagcagagcctacagaacatgaagaaatgaccccattggcc

SEQ ID NO: 8307 - DNA, 4480 bp, Homo sapiens
ggggcggggcggcgcggcgcggagccgagcaggacggccgccatcttgcgcgcagctggagtcggtgcctgaggttgcagccgagagtgtgcgccagcccgcggcccagccgaagctctttcccgccgcctctccgcgcctcgcccaggttcagctccgcctgaccctccgcttggcacggtcccctgaccctcagtccggcctggtccggccttccagccgccccggggacgatgaacggaggataaatggtgcccaaggcagacagcggcgccttcctgctgctcttcctgctcgtgctcactgtcaccgagccgctgcggccagagctgcggtgcaaccctgggcagtttgcgtgtcgcagcggcaccatccagtgcatccccctcccctggcagtgtgacggctgggcgacttgcgaggatgagagcgacgaagccaactgtccagaagtgaccggggaggtgcgtcctcatcatgggaaggaggctgtggatccgcggcaggggcgggccagaggaggcgacccttcgcacttccacgcggtgaacgtggcgcagcccgttcgcttcagcagtttcctagggaagtgcccgacagggtggcaccactacgaaggcacggccagctgctaccgggtctacctgagcggggagaactactgggatgccgcgcagacctgccagcgcctgaatggctctctcgccaccttctccactgaccaggagctgcgctttgtcctggcccaggaatgggaccagcccgagcggagctttggttggaaggaccagcgcaagttgtgggttggctatcagtatgttatcactggccggaaccgctccttggaaggtcgctgggaggtggcattcaaaggctcttcagaggtgttcctgcccccagaccccatctttgcctcggccatgtctgagaacgacaacgtgttctgtgcccagcttcagtgcttccatttccccaccctgcggcaccacgacctccacagctggcacgccgagagctgctacgagaagtcttcatttctgtgtaaaagaagtcaaacatgtgttgacatcaaggacaacgtggtggatgaagggttctacttcacccctaagggggacgacccatgcctgagctgcacctgccatggaggggagcctgagatgtgtgtggctgctctctgtgagaggccccagggctgccaacagtaccgcaaggaccccaaagagtgctgcaagttcatgtgtctggacccagatggcaacagtctgtttgactccatggccagcgggatgcgcctggtcgtcagctgcatctcctccttcctcatcctgtcactgctgctcttcatggtccaccggctgcgccagcggcgccgggagcgcatcgagtccctgattggagcaaacttgcaccacttcaacctcggccgcaggatccctggctttgattacggcccagacgggtttggcacgggcctcacgccgctgcatctttctgacgacggagagggtgggactttccatttccacgaccctccacctccctacacggcatacaagtacccggacatcggccagcccgacgaccctccgccgccctacgaggcctccatccacccggacagtgtgttctatgaccctgcagacgatgatgcttttgagcctgtggaggtcagcctgccagcccctggggatggtgggagtgaaggtgcattactccggcgcctggagcagcctctgcccactgcgggggcctctctggcagacctggaagactctgccgacagcagcagcgccctgctcgtgccccctgaccctgcccagagcgggagcaccccagctgcagaggcactgccagggggtggccgccacagccgcagctccctcaatactgtggtgtagacggcctggcctgtaccccaacggtctgggagcacctgtctgttgtagaaaacaccggtccctggggagacttgaaaggcccctgtcccagcctggacgccacgcactgccgcacgtcactggcgggctcgcgtgtgtacatagagaccacagcccgccttctgccaaaagaagtgatggcctgcaccgagcttccttgagggcttcagaaacatgcatagctttggatcactgtcttctcctttataaatggcagaagagtgacaaaattcattcagaccgcacatgttagaggcagggaatgaagaaggtactgtgggccatggccacacctgatgcgtttttggtgggcttacttggtgcagtgtgctgtccagagagacctgctgacccagtctgggacaggcacagtgggagctgccacagtgccccttgctggccgccctcaggagggggcctctggaccgtcagtgtggcgtaggcagtgggtctgcttcagggaggcagcctcttgactttgtcacaacggttgcactgaagatggcccccacaagcccagttgtgaatatcaaggtgaccctgcccctggctgggagctcccctggggctctggaacctgaagccctgagaaggagagcttggaaggaggttgagctcttcactgtgtctttccatctgggctctgcagcccagctctgtggcaggaggcctgaccccaccccatcagtccctctcccagcattgctgtgcatggctccctcaggaagaagctctggagtggggccgaggccccagatgctctgctggggtctggggactgagctgcctcctgtctctccactctggagccctgggctcttgcctcctgttgaattgcccctgggcctgcccccggccccatttgtgccataaagggttgcttcattgcaggaggggtggctgaaaccaccatcctgggctgcatctatctccttaaagtccactccttacatcaccgccactactgcagctcagtgcccagcggccgcatgcacacctcccggcccctcctcagcagcgcaggggctgggggcccttcctggcacccttttgcctgacggaccctgttgcctgctcctgggcagtggttttgttgcctgacacagggcctttaacatttctgaggtttggagattaagcgggttctgtgcgatttttagcacatccatatcttttctacgttgaatgtctggatctttcctttgtatgtttgtgtctctgtgtgtgtatgtggccaagcgtctgcaggtgagggtggcacatggaacttcacgggtcactgggggcccactcttccagggtcatcgatgcatcctgggctgtgctgaggcagtgctgtctcgctcagtctttccagaccagcggggcagcacctgggaggcctgtctgaagcatgcagttctgtggtgctgctcggggatggactccatgcacagtccacttcttgacacattctcacactgtggctggagacccattttttccatcccatgtggaatgagaatcttgagttgcccacagacagacttgacctttgtgccagaactgtccagagctgtgagttttgttactgaattgcctgtccctgagcttggcctgctggagcatgatgctggaggctgtgtgcgggcaggcttgtgctccccttggagaagggctgctacttaacaaggaagtcctggccacaggagtcccctactggctgcagaggacgaagcaggaagcatgccgtggatcccacatgcactggggcagggcagccaggttccagagcagcaggcatgtgcattatgggtgccaggtggccagtgagggcccgaggaccacgcagcagagtcccccacgggcctgagcctgagagctcagaggattcctgccaggcctcagaactgtgtgtgcgggacagggtggctggcacgagatgtgtgggactgggacgcttcctttggggaccagaggaacattaggggccggtcagacacgtagggggcagtgaggaaacggggtaaagtggaccatgcaggctgcagagggtgggccttgggctggccggggttgctgggtggccccttccccatgggcctccacaagcactcaggccactggcacgttgggccaggcagaaggtccacatggcagggctgcctggaacaccgctgccactgtggctccaggaggcccttgggagcatgaggagagctggactcgctcatctgttcttgcaccaccatccagaatgccccctttgcaaggcctgctgcagtccccagtctgaccagcaagtcccggggtcacccttgctgaaccttgtgctccaggggtcctcctcctctaggaccagcttgccacggtttctcagagcccaggtgccctctgacctgccatgcggaggtgggatttgatactgtacattgtcttgatgcctgtttttttatgttttcattaagggtttttagtttttggttgggttgacactaacttttcttaagatgctgtgagaatcatttcatccaaatgccaaataaacttgtgttccggaa

SEQ ID NO: 8308 - DNA, 1135 bp, Homo sapiens
atggtgcccaaggcagacagcggcgccttcctgctgctcttcctgctcgtgctcactgtcaccgagccgctgcggccagagctgcggtgcaaccctgggcagtttgcgtgtcgcagcggcaccatccagtgcatccccctcccctggcagtgtgacggctgggcgacttgcgaggatgagagcgacgaagccaactgtccagaagtgaccggggaggtgcgtcctcatcatgggaaggaggctgtggatccgcggcaggggcgggccagaggaggcgacccttcgcacttccacgcggtgaacgtggcgcagcccgttcgcttcagcagtttcctagggaagtgcccgacagggtggcaccactacgaaggcacggccagctgctaccgggtctacctgagcggggagaactactgggatgccgcgcagacctgccagcgcctgaatggctctctcgccaccttctccactgaccaggagctgcgctttgtcctggcccaggaatgggaccagcccgagcggagctttggttggaaggaccagcgcaagttgtgggttggctatcagtatgttatcactggccggaaccgctccttggaaggtcgctgggaggtggcattcaaaggctcttcagaggtgttcctgcccccagaccccatctttgcctcggccatgtctgagaacgacaacgtgttctgtgcccagcttcagtgcttccatttccccaccctgcggcaccacgacctccacagctggcacgccgagagctgctacgagaagtcttcatttctgtgtaaaagaagtcaaacatgtgttgacatcaaggacaacgtggtggatgaagggttctacttcacccctaagggggacgacccatgcctgagctgcacctgccatggaggggagcctgagatgtgtgtggctgctctctgtgagaggccccagggctgcagccctctctcctgcacggccagagcgacttagctgggccctgctctgcctgccctgtggccatgcttccatgggctcctgactctcctagggccttcttctggaaagtgctcaagaaccgagacactatcaccaaaactggagactctgggaataggatgtcatgtgttaagcatcagaatgt

SEQ ID NO: 8309 - DNA, 4361 bp, Homo sapiens
ggggcggggcggcgcggcgcggagccgagcaggacggccgccatcttgcgcgcagctggagtcggtgcctgaggttgcagccgagagtgtgcgccagcccgcggcccagccgaagctctttcccgccgcctctccgcgcctcgcccaggttcagctccgcctgaccctccgcttggcacggtcccctgaccctcagtccggcctggtccggccttccagccgccccggggacgatgaacggaggataaatggtgcccaaggcagacagcggcgccttcctgctgctcttcctgctcgtgctcactgtcaccgagccgctgcggccagaagtgaccggggaggtgcgtcctcatcatgggaaggaggctgtggatccgcggcaggggcgggccagaggaggcgacccttcgcacttccacgcggtgaacgtggcgcagcccgttcgcttcagcagtttcctagggaagtgcccgacagggtggcaccactacgaaggcacggccagctgctaccgggtctacctgagcggggagaactactgggatgccgcgcagacctgccagcgcctgaatggctctctcgccaccttctccactgaccaggagctgcgctttgtcctggcccaggaatgggaccagcccgagcggagctttggttggaaggaccagcgcaagttgtgggttggctatcagtatgttatcactggccggaaccgctccttggaaggtcgctgggaggtggcattcaaaggctcttcagaggtgttcctgcccccagaccccatctttgcctcggccatgtctgagaacgacaacgtgttctgtgcccagcttcagtgcttccatttccccaccctgcggcaccacgacctccacagctggcacgccgagagctgctacgagaagtcttcatttctgtgtaaaagaagtcaaacatgtgttgacatcaaggacaacgtggtggatgaagggttctacttcacccctaagggggacgacccatgcctgagctgcacctgccatggaggggagcctgagatgtgtgtggctgctctctgtgagaggccccagggctgccaacagtaccgcaaggaccccaaagagtgctgcaagttcatgtgtctggacccagatggcaacagtctgtttgactccatggccagcgggatgcgcctggtcgtcagctgcatctcctccttcctcatcctgtcactgctgctcttcatggtccaccggctgcgccagcggcgccgggagcgcatcgagtccctgattggagcaaacttgcaccacttcaacctcggccgcaggatccctggctttgattacggcccagacgggtttggcacgggcctcacgccgctgcatctttctgacgacggagagggtgggactttccatttccacgaccctccacctccctacacggcatacaagtacccggacatcggccagcccgacgaccctccgccgccctacgaggcctccatccacccggacagtgtgttctatgaccctgcagacgatgatgcttttgagcctgtggaggtcagcctgccagcccctggggatggtgggagtgaaggtgcattactccggcgcctggagcagcctctgcccactgcgggggcctctctggcagacctggaagactctgccgacagcagcagcgccctgctcgtgccccctgaccctgcccagagcgggagcaccccagctgcagaggcactgccagggggtggccgccacagccgcagctccctcaatactgtggtgtagacggcctggcctgtaccccaacggtctgggagcacctgtctgttgtagaaaacaccggtccctggggagacttgaaaggcccctgtcccagcctggacgccacgcactgccgcacgtcactggcgggctcgcgtgtgtacatagagaccacagcccgccttctgccaaaagaagtgatggcctgcaccgagcttccttgagggcttcagaaacatgcatagctttggatcactgtcttctcctttataaatggcagaagagtgacaaaattcattcagaccgcacatgttagaggcagggaatgaagaaggtactgtgggccatggccacacctgatgcgtttttggtgggcttacttggtgcagtgtgctgtccagagagacctgctgacccagtctgggacaggcacagtgggagctgccacagtgccccttgctggccgccctcaggagggggcctctggaccgtcagtgtggcgtaggcagtgggtctgcttcagggaggcagcctcttgactttgtcacaacggttgcactgaagatggcccccacaagcccagttgtgaatatcaaggtgaccctgcccctggctgggagctcccctggggctctggaacctgaagccctgagaaggagagcttggaaggaggttgagctcttcactgtgtctttccatctgggctctgcagcccagctctgtggcaggaggcctgaccccaccccatcagtccctctcccagcattgctgtgcatggctccctcaggaagaagctctggagtggggccgaggccccagatgctctgctggggtctggggactgagctgcctcctgtctctccactctggagccctgggctcttgcctcctgttgaattgcccctgggcctgcccccggccccatttgtgccataaagggttgcttcattgcaggaggggtggctgaaaccaccatcctgggctgcatctatctccttaaagtccactccttacatcaccgccactactgcagctcagtgcccagcggccgcatgcacacctcccggcccctcctcagcagcgcaggggctgggggcccttcctggcacccttttgcctgacggaccctgttgcctgctcctgggcagtggttttgttgcctgacacagggcctttaacatttctgaggtttggagattaagcgggttctgtgcgatttttagcacatccatatcttttctacgttgaatgtctggatctttcctttgtatgtttgtgtctctgtgtgtgtatgtggccaagcgtctgcaggtgagggtggcacatggaacttcacgggtcactgggggcccactcttccagggtcatcgatgcatcctgggctgtgctgaggcagtgctgtctcgctcagtctttccagaccagcggggcagcacctgggaggcctgtctgaagcatgcagttctgtggtgctgctcggggatggactccatgcacagtccacttcttgacacattctcacactgtggctggagacccattttttccatcccatgtggaatgagaatcttgagttgcccacagacagacttgacctttgtgccagaactgtccagagctgtgagttttgttactgaattgcctgtccctgagcttggcctgctggagcatgatgctggaggctgtgtgcgggcaggcttgtgctccccttggagaagggctgctacttaacaaggaagtcctggccacaggagtcccctactggctgcagaggacgaagcaggaagcatgccgtggatcccacatgcactggggcagggcagccaggttccagagcagcaggcatgtgcattatgggtgccaggtggccagtgagggcccgaggaccacgcagcagagtcccccacgggcctgagcctgagagctcagaggattcctgccaggcctcagaactgtgtgtgcgggacagggtggctggcacgagatgtgtgggactgggacgcttcctttggggaccagaggaacattaggggccggtcagacacgtagggggcagtgaggaaacggggtaaagtggaccatgcaggctgcagagggtgggccttgggctggccggggttgctgggtggccccttccccatgggcctccacaagcactcaggccactggcacgttgggccaggcagaaggtccacatggcagggctgcctggaacaccgctgccactgtggctccaggaggcccttgggagcatgaggagagctggactcgctcatctgttcttgcaccaccatccagaatgccccctttgcaaggcctgctgcagtccccagtctgaccagcaagtcccggggtcacccttgctgaaccttgtgctccaggggtcctcctcctctaggaccagcttgccacggtttctcagagcccaggtgccctctgacctgccatgcggaggtgggatttgatactgtacattgtcttgatgcctgtttttttatgttttcattaagggtttttagtttttggttgggttgacactaacttttcttaagatgctgtgagaatcatttcatccaaatgccaaataaacttgtgttccggaagagg

SEQ ID NO: 8310 - DNA, 4812 bp, Homo sapiens
gcgcgcagctggagtcggtgcctgaggttgcagccgagagtgtgcgccagcccgcggcccagccgaagctctttcccgccgcctctccgcgcctcgcccaggttcagctccgcctgaccctccgcttggcacggtcccctgaccctcagtccggcctggtccggccttccagccgccccggggacgatgaacggaggataaatggtgcccaaggcagacagcggcgccttcctgctgctcttcctgctcgtgctcactgtcaccgagccgctgcggccagagctgcggtgcaaccctgggcagtttgcgtgtcgcagcggcaccatccagtgcatccccctcccctggcagtgtgacggctgggcgacttgcgaggatgagagcgacgaagccaactgtccagaagtgaccggggaggtgcgtcctcatcatgggaaggaggctgtggatccgcggcaggggcgggccagaggaggcgacccttcgcacttccacgcggtgaacgtggcgcagcccgttcgcttcagcaggaagtgcccgacagggtggcaccactacgaaggcacggccagctgctaccgggtctacctgagcggggagaactactgggatgccgcgcagacctgccagcgcctgaatggctctctcgccaccttctccactgaccaggagctgcgctttgtcctggcccaggaatgggaccagcccgagcggagctttggttggaaggaccagcgcaagttgtgggttggctatcagtatgttatcactggccggaaccgctccttggaaggtcgctgggaggtggcattcaaagattggggtgtgagtgataccatggtacatagacgcttactatgcccatgtgtcggtaccctgcacacacatttgaagttgggagctcgtttccgcagggttcctgtgcgccttggtggagcgctctccaggcgctcccccaggcccacaccagcctgtgagccccgcctgggggccaagaccctgcaggtttgacagcaccaggtcatgatgtgccctggagacagaactgccgctgctgctgccagaagacatgaggccaggatttctgtaacatttgtgcagaaaggttgaaaaagtacagatccttgtgtagggagaatcatccacaccgccccacgtgctgctcccagggccttcccgtcagcaccagcagtgtagcttctgtctggctcttcagaggtgttcctgcccccagaccccatctttgcctcggccatgtctgagaacgacaacgtgttctgtgcccagcttcagtgcttccatttccccaccctgcggcaccacgacctccacagctggcacgccgagagctgctacgagaagtcttcatttctgtgtaaaagaagtcaaacatgtgttgacatcaaggacaacgtggtggatgaagggttctacttcacccctaagggggacgacccatgcctgagctgcacctgccatggaggggagcctgagatgtgtgtggctgctctctgtgagaggccccagggctgccaacagtaccgcaaggaccccaaagagtgctgcaagttcatgtgtctggacccagatggcaacagtctgtttgactccatggccagcgggatgcgcctggtcgtcagctgcatctcctccttcctcatcctgtcactgctgctcttcatggtccaccggctgcgccagcggcgccgggagcgcatcgagtccctgattggagcaaacttgcaccacttcaacctcggccgcaggatccctggctttgattacggcccagacgggtttggcacgggcctcacgccgctgcatctttctgacgacggagagggtgggactttccatttccacgaccctccacctccctacacggcatacaagtacccggacatcggccagcccgacgaccctccgccgccctacgaggcctccatccacccggacagtgtgttctatgaccctgcagacgatgatgcttttgagcctgtggaggtcagcctgccagcccctggggatggtgggagtgaaggtgcattactccggcgcctggagcagcctctgcccactgcgggggcctctctggcagacctggaagactctgccgacagcagcagcgccctgctcgtgccccctgaccctgcccagagcgggagcaccccagctgcagaggcactgccagggggtggccgccacagccgcagctccctcaatactgtggtgtagacggcctggcctgtaccccaacggtctgggagcacctgtctgttgtagaaaacaccggtccctggggagacttgaaaggcccctgtcccagcctggacgccacgcactgccgcacgtcactggcgggctcgcgtgtgtacatagagaccacagcccgccttctgccaaaagaagtgatggcctgcaccgagcttccttgagggcttcagaaacatgcatagctttggatcactgtcttctcctttataaatggcagaagagtgacaaaattcattcagaccgcacatgttagaggcagggaatgaagaaggtactgtgggccatggccacacctgatgcgtttttggtgggcttacttggtgcagtgtgctgtccagagagacctgctgacccagtctgggacaggcacagtgggagctgccacagtgccccttgctggccgccctcaggagggggcctctggaccgtcagtgtggcgtaggcagtgggtctgcttcagggaggcagcctcttgactttgtcacaacggttgcactgaagatggcccccacaagcccagttgtgaatatcaaggtgaccctgcccctggctgggagctcccctggggctctggaacctgaagccctgagaaggagagcttggaaggaggttgagctcttcactgtgtctttccatctgggctctgcagcccagctctgtggcaggaggcctgaccccaccccatcagtccctctcccagcattgctgtgcatggctccctcaggaagaagctctggagtggggccgaggccccagatgctctgctggggtctggggactgagctgcctcctgtctctccactctggagccctgggctcttgcctcctgttgaattgcccctgggcctgcccccggccccatttgtgccataaagggttgcttcattgcaggaggggtggctgaaaccaccatcctgggctgcatctatctccttaaagtccactccttacatcaccgccactactgcagctcagtgcccagcggccgcatgcacacctcccggcccctcctcagcagcgcaggggctgggggcccttcctggcacccttttgcctgacggaccctgttgcctgctcctgggcagtggttttgttgcctgacacagggcctttaacatttctgaggtttggagattaagcgggttctgtgcgatttttagcacatccatatcttttctacgttgaatgtctggatctttcctttgtatgtttgtgtctctgtgtgtgtatgtggccaagcgtctgcaggtgagggtggcacatggaacttcacgggtcactgggggcccactcttccagggtcatcgatgcatcctgggctgtgctgaggcagtgctgtctcgctcagtctttccagaccagcggggcagcacctgggaggcctgtctgaagcatgcagttctgtggtgctgctcggggatggactccatgcacagtccacttcttgacacattctcacactgtggctggagacccattttttccatcccatgtggaatgagaatcttgagttgcccacagacagacttgacctttgtgccagaactgtccagagctgtgagttttgttactgaattgcctgtccctgagcttggcctgctggagcatgatgctggaggctgtgtgcgggcaggcttgtgctccccttggagaagggctgctacttaacaaggaagtcctggccacaggagtcccctactggctgcagaggacgaagcaggaagcatgccgtggatcccacatgcactggggcagggcagccaggttccagagcagcaggcatgtgcattatgggtgccaggtggccagtgagggcccgaggaccacgcagcagagtcccccacgggcctgagcctgagagctcagaggattcctgccaggcctcagaactgtgtgtgcgggacagggtggctggcacgagatgtgtgggactgggacgcttcctttggggaccagaggaacattaggggccggtcagacacgtagggggcagtgaggaaacggggtaaagtggaccatgcaggctgcagagggtgggccttgggctggccggggttgctgggtggccccttccccatgggcctccacaagcactcaggccactggcacgttgggccaggcagaaggtccacatggcagggctgcctggaacaccgctgccactgtggctccaggaggcccttgggagcatgaggagagctggactcgctcatctgttcttgcaccaccatccagaatgccccctttgcaaggcctgctgcagtccccagtctgaccagcaagtcccggggtcacccttgctgaaccttgtgctccaggggtcctcctcctctaggaccagcttgccacggtttctcagagcccaggtgccctctgacctgccatgcggaggtgggatttgatactgtacattgtcttgatgcctgtttttttatgttttcattaagggtttttagtttttggttgggttgacactaacttttcttaagatgctgtgagaatcatttcatccaaatgccaaataaacttgtgttccgg

SEQ ID NO: 8311 - DNA, 1214 bp, Homo sapiens
cgcgaggcgcgccgcgatcggggactgtcctaagacgggcggggcgcgctgcgctagggactgtcataaaaggggcgggacgcgccgcggtcgggatgacgtgagctgggggcgctcgtcgctgcagccggcggctagcgggcgtccgcgccatggagcgctacgcgggcgccttggaggaggtggcggacggtgcccggcagcaggagcgacactaccagctgctgtcggcgttacagagcctggtgaaggagttgcccagctcattccagcagcgcttgtcctacaccacgctgagcgacctggccctggcgcttctcgacggcaccgtgttcgaaatcgtgcaggggctactggagatccagcacctcaccgaaaagagcctgtacaaccagcgcctgcgcctacagaacgagcatcgagtgctcaggcaggcgctgcggcagaagcaccaggaagcccagcaggcctgccggccccataacctgcctgtgcttcaggcggctcagcagcgagaactagaggcggtggagcaccggatccgtgaggagcagcgggcgatggaccagaagatcgtcctggagctggaccggaaggtggctgaccagcagagcacactggagaaggcgggggtggctggcttctacgtgaccaccaacccacaggagctgatgctgcagatgaacctgctggaactcatccggaagctgcagcagaggggctgctgggcagggaaggcagccctggggctaggaggtccctggcagttgcctgctgcccagtgtgaccagaaaggcagccctgtcccaccatagccacaggcagcagaagtctgggcagagttcatcttcttgacctttggccactgccttcccagctgcccgcagggggttccccctgctgaggagagaccaggtggaccccagctgcctgtcacccttcatctgggacttgctgtcaaaccctaggatagtctcataaaggggaggctgggccagcctgctgctgtctgcttcagggccaggcagagagtgaggctgggggttctcacaccttactccaccgggcacatcccaacctgcactggggcccactcgagcgcttgttctggtctcagccgctcccttggcagctgcagcccccatgcagaagaggctcccaggcccaagctctgtgtgacccagagaaataaagatgcctcagtgtggcccgca

SEQ ID NO: 8312 - DNA, 1154 bp, Homo sapiens
aatcgtaaaaggggcgggacgcgccgcgctcgggatgtcgtgaagctgggggagctcgtcgccgccgccggcggctagcgggcgtccgcgccatggagcgctacgcggccgccttggaggaggtggcggacggtgcccggcagcaggagcgacactaccagttgctgtcggcgctacagagcctggtgaaggagttgcccagctctttccagcagcgcctgtcctacaccacgctcagcgacctggccctggcgcttctcgacggcaccgtgttcgaaatcgtgcaggggctactggagatccagcacctcaccgaaaagagcctgtacaaccagcgcctgcgcctacagaacgagcaccgagtgctcaggcaggcgctgcggcagaagcaccaggaagcccagcaggcctgccggccccacaacctgcctgtggttcaggcggctcagcagcgagaactagaggccgtggaacaccggatccgtgaggagcagcgggcgatggaccagaagatcatcctggagctggaccggaaggtggctgaccagcagagcacactggagaaggcgggggtggctggcttctacgtgaccaccaacccacaggagctgatgctgcagatgaacctgctggaactcatccgaaagctgcagcagaggggctgccgggcagggaatgcagccctgggactgggaggtccctggcagtcgcctgctgcccagtgtgaccagaaaggcagccctgtcccaccatagccacaggcagcagaagtctgggcagagttcatcttcttgacctttggccactgccttcccagctgcccgcagggggttccccctgctgaggagagaccaggtggaccccagctgcctgtcacccttcatctgggacttgctgtcaaaccctaggatagtctcataaaggggaggctgggccagcctgctgctgtctgcttcaggaccaggcagagagtgaggctgggggttctcacaccttactccaccgggcacatcccaacctgcactggggcccacccgagcgcttgttctggtctcagccgctcccttggcagctgcagcccccatgcagaagaggctcccaggcccaagctctgtgtgacccagagaaataaagatgcctcagtgtggcccaaa

SEQ ID NO: 8313 - DNA, 4514 bp, Homo sapiens
aggcccgccctccgctcgcccggcgcggcaggcgggtgccggcgaccggagagcctggacaggctttccagatggctgcggcggtcggtcggtgaggctttcccggctgtggtttggctgcgggcggcttgggcagcccgcgggcgcctcaggtagaagaagaaaggtgccactccggcatgaagacagactcgcttagtcgccagtcacttaagctgagtgcattgtgatttccaataattgaggcagtggttctaaaagctgtctacattaatgaaaagagcaatgtggccagcttgactaagccgccagcgcacagcgcggcaggacgcgcccgggtctcagcggacttgtgcatgttagctgtgtagatttatgtgagggcttgtaaaactctggtcttgtaaactagtcttaagcgcttttaatatggagacagatgagagcccctctccgctcccgtgtgggcccgcaggagaagcggtgatggagagccgagctcgccccttccaagcgctgccccgtgagcagtctccaccacctcccctgcaaacgtccagtggtgcagaggtaatggacgttggctctggtggtgatggacagtccgaactccctgctgaggaccccttcaacttctacggagcttctcttctctccaaaggatccttctctaagggccgcctcctcatagacccgaactgtagtggccacagcccgcgcaccgcccggcacgcacctgcggtccggaagttctcccctgaccttaagttgcttaaggatgtaaagattagcgtgagctttaccgagagctgcaggagtaaggacaggaaggtgctgtacacaggagcagagcgcgacgtgcgggcggagtgcggtctgctccttagccctgtcagtggggacgtgcatgcttgtccctttggcgggagtgttggtgacggggtaggcatagggggtgagagtgctgataagaaggatgaggagaatgagctggatcaggaaaagagagtggagtatgcagtgctcgatgagttagaagattttactgacaatttggagctagatgaagaaggagcaggcgggttcacggctaaagcaatcgttcagagagacagagtggatgaagaggccttgaatttcccctacgaggatgactttgacaacgatgtggatgctctgctggaagaaggcctttgtgcccccaaaaagaggcgaacagaggaaaaatatggcggagacagcgaccatccgtccgatggagagacaagtgtgcagccgatgatgaccaagattaaaacagtgctcaaaagtcgtggccgcccacctacagagccgctgcccgacgggtggatcatgacattccataactctggagtcccggtgtacctacacagagagtctcgggtggtcacctggtccaggccatacttcttgggaacgggaagcatacggaaacacgaccctcctctgagtagcatcccttgtctgcattataagaaaatgaaggacaacgaggaacgggagcaaagcagtgacctcacccctagtggggatgtgtcccccgtcaagcccctgagccgatctgcagagctggagtttcccctggatgagcctgactctatgggtgctgacccggggcccccggacgagaaagacccactaggggctgaggcagcccctggggccctggggcaggtgaaggccaaagtcgaggtgtgcaaagatgaatccgttgatctcgaggaatttcgaagctacctggagaagcgttttgactttgagcaagttactgtgaaaaaattcaggacttgggctgagcggcggcaattcaatcgggaaatgaagcggaagcaggcggagtccgagaggcccatcttgccagccaatcagaagctcattactttatcagtgcaagatgcacccacaaagaaagagtttgttattaaccccaacgggaaatccgaggtctgcatcctgcacgagtacatgcagcgtgtcctcaaggtccgccctgtctataatttctttgaatgtgagaacccaagtgagccttttggtgcctcggtgaccattgatggtgtgacttacggatctggaactgcaagcagcaaaaaacttgcgaagaataaagctgcccgagctacactggaaatcctcatccctgactttgttaaacagacctctgaagagaagcccaaagacagtgaagaactcgagtattttaaccacatcagcatcgaggactcgcgggtctacgagctgaccagcaaggctgggctgttgtctccatatcagatcctccacgagtgccttaaaagaaaccatgggatgggtgacacgtctatcaagtttgaagtggttcctgggaaaaaccagaagagtgaatacgtcatggcgtgtggcaagcacacagtgcgcgggtggtgtaagaacaagagagttggaaagcagttagcctcacagaagatccttcagctgctgcacccacatgtcaagaactgggggtctttactgcgcatgtatggccgtgagagcagcaagatggtcaagcaggagacatcggacaagagtgtgattgagctgcagcagtatgccaagaagaacaagcccaacctgcacatcctcagcaagctccaagaggagatgaagaggctagctgaggaaagggaggagactcgaaagaagcccaagatgtccattgtggcgtccgcccagcctggcggtgagcccctgtgcaccgtggacgtgtgagggaggtggcacgggccagggcgcgggggccgccagccgcacttctgaggagaccagcagtcatgcatcgtgcaccacagtgtcaggcctccaacccacgctccttccctgtggccaacctgtgggcccggccttagggtggaggctttagtgtacagggacagccatggccacacagcacacatgtggagcagcggctctccctggaaagctccaggcctgaatggatggactcagcgactgcaccagtggcagctggtgactgtggacagtggtggaccctgcttctgtgcacctgctgcaggctctttttatgaaggctttcatgaattttagtatgtaatacgcactgacgacacatgatgcttggatgacagatgagaggggatggctgagtcctgtggctggcccgtgatgccaggtggcccatgtgcccagggcgcctgcagggctgctacagggacctggtcaggaggtgcacatggtgccctgccctcacccaccctctgtgtttccccttctttgaaaaggtagaagagaaaggaatattttaaacctttttggcttaaacagaattttagcatcagaactagctttctgggattggaggcaaaccatcaaggtggtccctctccagtctggacacgatgccagcaaggatgacgtcctgccacctcctggagttaccctggcctcctagggtccctttttctgatgaagtcttaattccctaaaagcgcctctttggacactgaggccctctctgcctttcctggcctccggcaacagttttttacaaagattttttgcagtcgagtccatatgtccacccattgatttttaaagcttttgtgatattttagcattttgaaagactttcacagtgagagtagaaggtagatttggaatcatgcattttagcaagtggacttgttgaaacaggaagcaagggccttcagtgtagcccattcttgatccagagctgttgcctgtgacagcggtttctctggatgtcaaaggcagctgcctggtgcccagcttgcttctcgactggtggcccctatgggtgggtgtgcgatggaaatgtgttcctgccggagtctgaggcaccagggtgtgctcaaaggctggccctggtggtggactggcacctgtgcagagtgccgtgtgcttgtggtgcgccatctgaagcaagagtccagcgttctgccgtgtctgtcccccaccatgccccctacaggcggtactgatggcgcttttttttttttttctgtcaggaaaacaatgttggcctgtgggccgcccacaacatatccttccctcactacctgtgtgaccaaggttggcttctgttgacctttaaaaaagaaaccctcaactcaaattgctataattagacacttgcttctgtcttgcctcctgtctgcagctgtgaatagtcatttgactgtgactgttgcccttagccagccagatgcgcctgtgaaccaaagcttcgtgcacatgtgttcccctaaaggttggggagcctcgctgtgtcttgctgttcccaggcaccaccacagcaggtgctgccatactcttgtggtctctgtgcgccccccccccccccccacccgtctgccaagcatgggtatgaatcgtgcacacagccatgcttcaaggccggggcaggggagcctgtgctgatgccatccagggcactgggctgtgcctggaaggcgagccttgattgtctgaacacataaagcaaactgtccaga

SEQ ID NO: 8314 - DNA, 4419 bp, Homo sapiens
aggcccgccctccgctcgcccggcgcggcaggcgggtgccggcgaccggagagcctggacaggctttccagatggctgcggcggtcggtcggtgaggctttcccggctgtggtttggctgcgggcggcttgggcagcccgcgggcgcctcaggtagaagaagaaaggtgccactccggcatgaagacagactcgcttagtcgccagtcacttaagctgagtgcattgtgatttccaataattgaggcagtggttctaaaagctgtctacattaatgaaaagagcaatgtggccagcttgactaagccgccagcgcacagcgcggcaggacgcgcccgggtctcagcggacttgtgcatgttagctgtgtagatttatgtgagggcttgtaaaactctggtcttgtaaactagtcttaagcgcttttaatatggagacagatgagagcccctctccgctcccgtgtgggcccgcaggagaagcggtgatggagagccgagctcgccccttccaagcgctgccccgtgagcagtctccaccacctcccctgcaaacgtccagtggtgcagaggtaatggacgttggctctggtggtgatggacagtccgaactccctgctgaggaccccttcaacttctacggagcttctcttctctccaaaggatccttctctaagggccgcctcctcatagacccgaactgtagtggccacagcccgcgcaccgcccggcacgcacctgcggtccggaagttctcccctgaccttaagttgcttaaggatgtaaagattagcgtgagctttaccgagagctgcaggagtaaggacaggaaggtgctgtacacaggagcagagcgcgacgtgcgggcggagtgcggtctgctccttagccctgtcagtggggacgtgcatgcttgtccctttggcgggagtgttggtgacggggtaggcatagggggtgagagtgctgataagaaggatgaggagaatgagctggatcaggaaaagagagtggagtatgcagtgctcgatgagttagaagattttactgacaatttggagctagatgaagaaggagcaggcgggttcacggctaaagcaatcgttcagagagacagagtggatgaagaggccttgaatttcccctacgaggatgactttgacaacgatgtggatgctctgctggaagaaggcctttgtgcccccaaaaagaggcgaacagaggaaaaatatggcggagacagcgaccatccgtccgatggagagacaagtgtgcagccgatgatgaccaagattaaaacagtgctcaaaagtcgtggccgcccacctacagagccgctgcccgacgggtggatcatgacattccataactctggagtcccggtgtacctacacagagagtctcgggtggtcacctggtccaggccatacttcttgggaacgggaagcatacggaaacacgaccctcctctgagtagcatcccttgtctgcattataagaaaatgaaggacaacgaggaacgggagcaaagcagtgacctcacccctagtggggatgtgtcccccgtcaagcccctgagccgatctgcagagctggagtttcccctggatgagcctgactctatgggtgctgacccggggcccccggacgagaaagacccactaggggctgaggcagcccctggggccctggggcaggtgaaggccaaagtcgaggtgtgcaaagatgaatccgttgatctcgaggaatttcgaagctacctggagaagcgttttgactttgagcaagttactgtgaaaaaattcaggacttgggctgagcggcggcaattcaatcgggaaatgaagcggaagcaggcggagtccgagaggcccatcttgccagccaatcagaagctcattactttatcagtgcaagatgcacccacaaagaaagagtttgttattaaccccaacgggaaatccgaggtctgcatcctgcacgagtacatgcagcgtgtcctcaaggtccgccctgtctataatttctttgaatgtgcccgagctacactggaaatcctcatccctgactttgttaaacagacctctgaagagaagcccaaagacagtgaagaactcgagtattttaaccacatcagcatcgaggactcgcgggtctacgagctgaccagcaaggctgggctgttgtctccatatcagatcctccacgagtgccttaaaagaaaccatgggatgggtgacacgtctatcaagtttgaagtggttcctgggaaaaaccagaagagtgaatacgtcatggcgtgtggcaagcacacagtgcgcgggtggtgtaagaacaagagagttggaaagcagttagcctcacagaagatccttcagctgctgcacccacatgtcaagaactgggggtctttactgcgcatgtatggccgtgagagcagcaagatggtcaagcaggagacatcggacaagagtgtgattgagctgcagcagtatgccaagaagaacaagcccaacctgcacatcctcagcaagctccaagaggagatgaagaggctagctgaggaaagggaggagactcgaaagaagcccaagatgtccattgtggcgtccgcccagcctggcggtgagcccctgtgcaccgtggacgtgtgagggaggtggcacgggccagggcgcgggggccgccagccgcacttctgaggagaccagcagtcatgcatcgtgcaccacagtgtcaggcctccaacccacgctccttccctgtggccaacctgtgggcccggccttagggtggaggctttagtgtacagggacagccatggccacacagcacacatgtggagcagcggctctccctggaaagctccaggcctgaatggatggactcagcgactgcaccagtggcagctggtgactgtggacagtggtggaccctgcttctgtgcacctgctgcaggctctttttatgaaggctttcatgaattttagtatgtaatacgcactgacgacacatgatgcttggatgacagatgagaggggatggctgagtcctgtggctggcccgtgatgccaggtggcccatgtgcccagggcgcctgcagggctgctacagggacctggtcaggaggtgcacatggtgccctgccctcacccaccctctgtgtttccccttctttgaaaaggtagaagagaaaggaatattttaaacctttttggcttaaacagaattttagcatcagaactagctttctgggattggaggcaaaccatcaaggtggtccctctccagtctggacacgatgccagcaaggatgacgtcctgccacctcctggagttaccctggcctcctagggtccctttttctgatgaagtcttaattccctaaaagcgcctctttggacactgaggccctctctgcctttcctggcctccggcaacagttttttacaaagattttttgcagtcgagtccatatgtccacccattgatttttaaagcttttgtgatattttagcattttgaaagactttcacagtgagagtagaaggtagatttggaatcatgcattttagcaagtggacttgttgaaacaggaagcaagggccttcagtgtagcccattcttgatccagagctgttgcctgtgacagcggtttctctggatgtcaaaggcagctgcctggtgcccagcttgcttctcgactggtggcccctatgggtgggtgtgcgatggaaatgtgttcctgccggagtctgaggcaccagggtgtgctcaaaggctggccctggtggtggactggcacctgtgcagagtgccgtgtgcttgtggtgcgccatctgaagcaagagtccagcgttctgccgtgtctgtcccccaccatgccccctacaggcggtactgatggcgcttttttttttttttctgtcaggaaaacaatgttggcctgtgggccgcccacaacatatccttccctcactacctgtgtgaccaaggttggcttctgttgacctttaaaaaagaaaccctcaactcaaattgctataattagacacttgcttctgtcttgcctcctgtctgcagctgtgaatagtcatttgactgtgactgttgcccttagccagccagatgcgcctgtgaaccaaagcttcgtgcacatgtgttcccctaaaggttggggagcctcgctgtgtcttgctgttcccaggcaccaccacagcaggtgctgccatactcttgtggtctctgtgcgccccccccccccccccacccgtctgccaagcatgggtatgaatcgtgcacacagccatgcttcaaggccggggcaggggagcctgtgctgatgccatccagggcactgggctgtgcctggaaggcgagccttgattgtctgaacacataaagcaaactgtccagaaggg

SEQ ID NO: 8315 - DNA, 4129 bp, Homo sapiens
gtggccagcttgactaagccgccagcgcacagcgcggcaggacgcgcccgggtctcagcggacttgtgcatgttagctgtgtagatttatgtgagggcttgtaaaactctggtcttgtaaactagtcttaagcgcttttaatatggagacagatgagagcccctctccgctcccgtgtgggcccgcaggagaagcggtgatggagagccgagctcgccccttccaagcgctgccccgtgagcagtctccaccacctcccctgcaaacgtccagtggtgcagaggtaatggacgttggctctggtggtgatggacagtccgaactccctgctgaggaccccttcaacttctacggagcttctcttctctccaaaggatccttctctaagggccgcctcctcatagacccgaactgtagtggccacagcccgcgcaccgcccggcacgcacctgcggtccggaagttctcccctgaccttaagttgcttaaggatgtaaagattagcgtgagctttaccgagagctgcaggagtaaggacaggaaggtgctgtacacaggagcagagcgcgacgtgcgggcggagtgcggtctgctccttagccctgtcagtggggacgtgcatgcttgtccctttggcgggagtgttggtgacggggtaggcatagggggtgagagtgctgataagaaggatgaggagaatgagctggatcaggaaaagagagtggagtatgcagtgctcgatgagttagaagattttactgacaatttggagctagatgaagaaggagcaggcgggttcacggctaaagcaatcgttcagagagacagagtggatgaagaggccttgaatttcccctacgaggatgactttgacaacgatgtggatgctctgctggaagaaggcctttgtgcccccaaaaagaggcgaacagaggaaaaatatggcggagacagcgaccatccgtccgatggagagacaagtgtgcagccgatgatgaccaagattaaaacagtgctcaaaagtcgtggccgcccacctacagagccgctgcccgacgggtggatcatgacattccataactctggagtcccggtgtacctacacagagagtctcgggtggtcacctggtccaggccatacttcttgggaacgggaagcatacggaaacacgaccctcctctgagtagcatcccttgtctgcattataagaaaatgaaggacaacgaggaacgggagcaaagcagtgacctcacccctagtggggatgtgtcccccgtcaagcccctgagccgatctgcagagctggagtttcccctggatgagcctgactctatgggtgctgacccggggcccccggacgagaaagacccactaggggctgaggcagcccctggggccctggggcaggtgaaggccaaagtcgaggtgtgcaaagatgaatccgttgatctcgaggaatttcgaagctacctggagaagcgttttgactttgagcaagttactgtgaaaaaattcaggacttgggctgagcggcggcaattcaatcgggaaatgaagcggaagcaggcggagtccgagaggcccatcttgccagccaatcagaagctcattactttatcagtgcaagatgcacccacaaagaaagagtttgttattaaccccaacgggaaatccgaggtctgcatcctgcacgagtacatgcagcgtgtcctcaaggtccgccctgtctataatttctttgaatgtgcccgagctacactggaaatcctcatccctgactttgttaaacagacctctgaagagaagcccaaagacagtgaagaactcgagtattttaaccacatcagcatcgaggactcgcgggtctacgagctgaccagcaaggctgggctgttgtctccatatcagatcctccacgagtgccttaaaagaaaccatgggatgggtgacacgtctatcaagtttgaagtggttcctgggaaaaaccagaagagtgaatacgtcatggcgtgtggcaagcacacagtgcgcgggtggtgtaagaacaagagagttggaaagcagttagcctcacagaagatccttcagctgctgcacccacatgtcaagaactgggggtctttactgcgcatgtatggccgtgagagcagcaagatggtcaagcaggagacatcggacaagagtgtgattgagctgcagcagtatgccaagaagaacaagcccaacctgcacatcctcagcaagctccaagaggagatgaagaggctagctgaggaaagggaggagactcgaaagaagcccaagatgtccattgtggcgtccgcccagcctggcggtgagcccctgtgcaccgtggacgtgtgagggaggtggcacgggccagggcgcgggggccgccagccgcacttctgaggagaccagcagtcatgcatcgtgcaccacagtgtcaggcctccaacccacgctccttccctgtggccaacctgtgggcccggccttagggtggaggctttagtgtacagggacagccatggccacacagcacacatgtggagcagcggctctccctggaaagctccaggcctgaatggatggactcagcgactgcaccagtggcagctggtgactgtggacagtggtggaccctgcttctgtgcacctgctgcaggctctttttatgaaggctttcatgaattttagtatgtaatacgcactgacgacacatgatgcttggatgacagatgagaggggatggctgagtcctgtggctggcccgtgatgccaggtggcccatgtgcccagggcgcctgcagggctgctacagggacctggtcaggaggtgcacatggtgccctgccctcacccaccctctgtgtttccccttctttgaaaaggtagaagagaaaggaatattttaaacctttttggcttaaacagaattttagcatcagaactagctttctgggattggaggcaaaccatcaaggtggtccctctccagtctggacacgatgccagcaaggatgacgtcctgccacctcctggagttaccctggcctcctagggtccctttttctgatgaagtcttaattccctaaaagcgcctctttggacactgaggccctctctgcctttcctggcctccggcaacagttttttacaaagattttttgcagtcgagtccatatgtccacccattgatttttaaagcttttgtgatattttagcattttgaaagactttcacagtgagagtagaaggtagatttggaatcatgcattttagcaagtggacttgttgaaacaggaagcaagggccttcagtgtagcccattcttgatccagagctgttgcctgtgacagcggtttctctggatgtcaaaggcagctgcctggtgcccagcttgcttctcgactggtggcccctatgggtgggtgtgcgatggaaatgtgttcctgccggagtctgaggcaccagggtgtgctcaaaggctggccctggtggtggactggcacctgtgcagagtgccgtgtgcttgtggtgcgccatctgaagcaagagtccagcgttctgccgtgtctgtcccccaccatgccccctacaggcggtactgatggcgcttttttttttttttctgtcaggaaaacaatgttggcctgtgggccgcccacaacatatccttccctcactacctgtgtgaccaaggttggcttctgttgacctttaaaaaagaaaccctcaactcaaattgctataattagacacttgcttctgtcttgcctcctgtctgcagctgtgaatagtcatttgactgtgactgttgcccttagccagccagatgcgcctgtgaaccaaagcttcgtgcacatgtgttcccctaaaggttggggagcctcgctgtgtcttgctgttcccaggcaccaccacagcaggtgctgccatactcttgtggtctctgtgcgccccccccccccccccacccgtctgccaagcatgggtatgaatcgtgcacacagccatgcttcaaggccggggcaggggagcctgtgctgatgccatccagggcactgggctgtgcctggaaggcgagccttgattgtctgaacacataaagcaaactgtccagaa

SEQ ID NO: 8316 - DNA, 770 bp, Homo sapiens
ggggctggggggcgggccccgggcccaggcgttgccgactctcgtcgctgtccgcccgggtaaagaggctcctctcccggagggcccgaagcctagcatcgccttcaggcgggaaaggtagaagaagaaaggtgccactccggcatgaagacagactcgcttagtcgccagtcacttaagctgagtgcattgtgatttccaataattgaggcagtggttctaaaagctgtctacattaatgaaaagagcaatgtggccagcttgactaagccgccagcgcacagcgcggcaggacgcgcccgggtctcagcggacttgtgcatgttagctgtgtagatttatgtgagggcttgtaaaactctggtcttgtaaactagtcttaagcgcttttaatatggagacagatgagagcccctctccgctcccgtgtgggcccgcaggagaagcggtgatggagagccgagctcgccccttccaagcgctgccccgtgagcagtctccaccacctcccctgcaaacgtccagtggtgcagaggtaatggacgttggctctggtggtgatggacagtccgaactccctgctgaggaccccttcaacttctacggagcttctcttctctccaaaggatccttctctaagggccgcctcctcatagacccgaactgtagtggccacagcccgcgcaccgcccggcacgcacctgcggtccggaagttctcccctgaccttaagttgcttaaggatgtaaagattagcgtgagctttaccg

SEQ ID NO: 8317 - DNA, 3917 bp, Homo sapiens
agtcccagacagaacctactatgtgcggcggcagctggggcgggaaggcgggagctgggggcgctgggggcgctgcggccgctgcggccgctgcagccgctgcagcgccagggtccacctggtcggctgcacctgtggaggaggaggtggatttcaggcttcccgtagactggaagaatcggctcaaaaccgcttgcctcgcaggggctgagctggaggcagcgaggccgcccgacgcaggcttccggcgagacatggcagggcaaggatggcagcccggcggcagggcctggcgaggagcgcgagcccgcggccgcagttcccaggcgtctgcgggcgcgagcacgccgcgaccctgcgtgcgccggggcgggggggcggggcctcgcctgcacaaatggggacgaggggggcggggcggccacaatttcgcgccaaacttgaccgcgcgttctgctgtaacgagcgggctcggaggtcctcccgctgctgtcatggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattaatatgaaggtgttttctagtttaagttgttccccctccctctgaaaaaagtatgtatttttacattagaaaaggttttttgttgactttagatctataattatttctaagcaactagtttttattccccactactcttgtctctatcagataccatttatgagacattcttgctataactaagtgcttctccaagaccccaactgagtccccagcacctgctacagtgagctgccattccacacccatcacatgtggcactcttgccagtccttgacattgtcgggcttttcacatgttggtaatatttattaaagatgaagatccacatacccttcaactgagcagtttcactagtggaaataccaaaagcttcctacgtgtatatccagaggtttgtagataaatgttgccaccttgtttgtaacagtgaaaaattgaaaacaacctggaagtccagtgatgggaaaatgagtatgtttctgtcttagattggggaacccaaagcagattgcaagactgaaatttcagtgaaagcagtgtatttgctaggtcataccagaaatcatcaattgaggtacggagaaactgaactgagaaggtaagaaaagcaatttaaagtcagcgagcaggttctcattgataacaagctccatactgctgagatacagggaaatggaggggggaaagctggagtattgatcccgcccccctccttggttgtcagctccctgtcctgtgtgtgggcggaacatagtccagctgctctatagcaagtctcaggtgtttgcagtaagaagctgctggcatgcacgggaacagtgaatgccaaacacttaaagcaattcgatgtttaagtatgtaagttcttttttttttagacagcgtttcgctcttgttgcccaggctagcatgcaatggtgtgacctcggcttactgcaacctccgccttcccagattcaagcgattctcctgcctcaggctcccaagtagctaggaccaggtgcgcgccaccacgcccggctaatttttgtattttgtatttttagtagagatggggtttcaccatgttggtcaggctagtctcgaactcgtgaccgcaagcgattcacccacctcagcctcccaaagtgctgggattaccggcttgagccaccacacccggcacatcttcattctttttatgtagtaaaaagtataaggccacacatggtttatttgaagtattttataatttaaaaaaatacagaagcaggaaaaccaattataagttcaagtgagggatgatggttgcttgaaccaaagggttgcatgtagtaagaaattgtgatttaagatatattttaaagttataagtagcaggatattctgatggagtttgactttggttttgggcccagggagtttcagatgcctttgagaaatgaatgaagtagagagaaaataaaagaaaaaccagccaggcacagtggctcacacctgtaatcccagcgctttgggaggctaaggcaggcagatcacttgagaccagcttgggcaacatggcaaagccccatctctacaaaaaacacaaaaattagctgggcattgtggcgcacacctgtattcccatctagtcaggaagctgagatggaagaattaattgagcccacgagttcaaggctgcagtgagtcgtgattgtgccactgcactccagccggggtgacagaagagaccttgtctcgaaaaggaatctgaaaacaatggaaccatgccttcataattctagaaagttattttcaactgataaatctatattcacccaaataatcaagggtgaaggtaaaataatacatttttagacaagcaaagactcaggggttacctccatgtgccctttttagggaagctgttggagaaaatactccagcaaaatgaaggagtacacaaaccagagaatgacatgaatccagcaaataggatccaacacaggcaatattccagctatggagctagctttaaaaaggaacagtaaaaatattaatcggttagctgggtggaatggcccatgcctgtagtcccagctactcaggaggctcagcagcaggacgacttgagcccaagagttccagaccagcctggccaccttagtgagatcccttctcttaaaaataataacttattgccagatttggggcatttggaaagaagttcattgaagataaagcaaaagtaaaaaaaaaaaaaaaaaaaacaaggggaaagggttggttaggcaatcattctagggcagaaagaagtacaggataggaagagcataatacactgtttttctcaacaaggagcagtatgtacacagtcataatgatgtgactgcttagcccctaaatatggtaactactctgggacaatatgggaggaaaagtgaagattgtgatggtgtaagagctaaatcctcatctgtcatatccagaaatcactatataatatataataatgaaatgactaagttatgtgaggaaaaaaacagaagacattgctaaaagagttaaaagtcattgctctggagaattaggagggatggggcaggggactgttaggatgcattataaactgaaaagcctttttaaaattttatgtattaatatatgcattcacttgaaaaactaaaaaaaaacaataatttggaaaaacccatgaaggtaactaacggaaggaaaaactaagagaatgaaaagtatttgcctctggaaagaacaactggcaggactgttgttttcattgtaagacttttggagccatttaattgtacttaaccattttcatctatttctttaataagaacaattccatcttaataaagagttacacttgttaataa

SEQ ID NO: 8318 - DNA, 1719 bp, Homo sapiens
gcggccgcagttcccaggcgtctgcgggcgcgagcacgccgcgaccctgcgtgcgccggggcgggggggcggggcctcgcctgcacaaatggggacgaggggggcggggcggccacaatttcgcgccaaacttgaccgcgcgttctgctgtaacgagcgggctcggaggtcctcccgctgctgtcatggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattaatatgaaggtgttttctagtttaagttgttccccctccctctgaaaaaaataccatttatgagacattcttgctataactaagtgcttctccaagaccccaactgagtccccagcacctgctacagtgagctgccattccacacccatcacatgtggcactcttgccagtccttgacattgtcgggcttttcacatgttggtaatatttattaaagatgaagatccacatacccttcaactgagcagtttcactagtggaaataccaaaagcttcctacgtgtatatccagaggtttgtagataaatgttgccaccttgtttgtaacagtgaaaaattgaaaacaacctggaagtccagtgatgggaaaatgagtatgtttctgtcttagattggggaacccaaagcagattgcaagactgaaatttcagtgaaagcagtgtatttgctaggtcataccagaaatcatcaattgaggtacggagaaactgaactgagaaggtaagaaaagcaatttaaagtcagcgagcaggttctcattgataacaagctccatactgctgagatacagggaaatggaggggggaaagctggagtattgatcccgcccccctccttggttgtcagctccctgtcctgtgtgtgggcggaacatagtccagctgctctatagcaagtctcaggtgtttgcagtaagaagctgctggcatgcacgggaacagtgaatgccaaacacttaaagcaattcgatgtttaagtatgtaagttcttttttttttagacagcgtttcgctcttgttgcccaggctagcatgcaatggtgtgacctcggcttactgcaacctccgccttcccagattcaagcgattctcctgcctcaggctcccaagtagctaggaccaggtgcgcgccaccacgcccggctaatttttgtattttgtatttttagtagagatggggtttcaccatgtt

SEQ ID NO: 8319 - DNA, 1521 bp, Homo sapiens
atggctgcagtccgtatgctgagaacctggagcaggaatgcggggaagctgatttgtgttcgctattttcaaacatgtggtaatgttcatgttttgaagccaaattatgtgtgtttctttggttatccttcattcaagtatagtcatccacatcacttcctgaaaacaactgctgctctccgtggacaggttgttcagttcaagctctcagacattggagaagggattagagaagtaactgttaaagaatggtatgtaaaagaaggagatacagtgtctcagtttgatagcatctgtgaagttcaaagtgataaagcttctgttaccatcactagtcgttatgatggagtcattaaaaaactctattataatctagacgatattgcctatgtggggaagccattagtagacatagaaacggaagctttaaaagattcagaagaagatgttgttgaaactcctgcagtgtctcatgatgaacatacacaccaagagataaagggccgaaaaacactggcaactcctgcagttcgccgtctggcaatggaaaacaatattaagctgagtgaagttgttggctcaggaaaagatggcagaatacttaaagaagatatcctcaactatttggaaaagcagacaggagctatattgcctccttcacccaaagttgaaattatgccacctccaccaaagccaaaagacatgactgttcctatactagtatcaaaacctccggtattcacaggcaaagacaaaacagaacccataaaaggctttcaaaaagcaatggtcaagactatgtctgcagccctgaagatacctcattttggttattgtgatgagattgaccttactgaactggttaagctccgagaagaattaaaacccattgcatttgctcgtggaattaaactctcctttatgcctttcttcttaaagtattacttctcatggaaatcttaagatcaacatgtcagtgaggaaatcacctagaatttagacattttctttggaactttggctggtctgtatcattattttgaaaatctccttgatgtttacaagctacctgactactttatcttttattctttaatgattagggtgacctagttccacatggcctgaaggtaacattggcagtaatgtgactaggtacatgtagacttgaaattaaactcagcataaataagagttctctctctccctccttttatacctcttattgtttcaaattctctatcctttctaagttaaaagtactaaaattgcattctttttctgttaaacaggctgcttccttgggattactacagtttcctatccttaacgcttctgtggatgaaaactgccagaatataacatataaggttggctatgcagagtaaaaatgttcttattattaatagaagatggggcaaatgtgcttgtagattagagacttctattgtacctcaaatagtgatcttttttagactagaattaaaggtatggggtaaaacattaaacttaagtctaatt

SEQ ID NO: 8320 - DNA, 3538 bp, Homo sapiens
atttccggggtaagatggctgcagtccgtatgctgagaacctggagcaggaatgcggggaagctgatttgtgttcgctattttcaaacatgtggtaatgttcatgttttgaagccaaattatgtgtgtttctttggttatccttcattcaagtatagtcatccacatcacttcctgaaaacaactgctgctctccgtggacaggttgttcagttcaagctctcagacattggagaagggattagagaagtaactgttaaagaatggtatgtaaaagaaggagatacagtgtctcagtttgatagcatctgtgaagttcaaagtgataaagcttctgttaccatcactagtcgttatgatggagtcattaaaaaactctattataatctagacgatattgcctatgtggggaagccattagtagacatagaaacggaagctttaaaagattcagaagaagatgttgttgaaactcctgcagtgtctcatgatgaacatacacaccaagagataaagggccgaaaaacactggcaactcctgcagttcgccgtctggcaatggaaaacaatattaagctgagtgaagttgttggctcaggaaaagatggcagaatacttaaagaagatatcctcaactatttggaaaagcagacaggagctatattgcctccttcacccaaagttgaaattatgccacctccaccaaagccaaaagacatgactgttcctatactagtatcaaaacctccggtattcacaggcaaagacaaaacagaacccataaaaggctttcaaaaagcaatggtcaagactatgtctgcagccctgaagatacctcattttggttattgtgatgagattgaccttactgaactggttaagctccgagaagaattaaaacccattgcatttgctcgtggaattaaactctcctttatgcctttcttcttaaaggctgcttccttgggattactacagtttcctatccttaacgcttctgtggatgaaaactgccagaatataacatataaggcttctcataacattgggatagcaatggatactgagcagggtttgattgtccctaatgtgaaaaatgttcagatctgctctatatttgacatcgccactgaactgaaccgcctccagaaattgggctctgtgagtcagctcagcaccactgatcttacaggaggaacatttactctttccaacattggatcaattggtggtacctttgccaaaccagtgataatgccacctgaagtagccattggggcccttggatcaattaaggccattccccgatttaaccagaaaggagaagtatataaggcacagataatgaatgtgagctggtcagctgatcacagagttattgatggtgctacaatgtcacgcttctccaatttgtggaaatcctatttagaaaacccagcttttatgctactagatctgaaatgaagactgataagacattcttgaactttttgagcttccaaagagtatgtaaaccctagctgtgccagcacatgttcatctttacaatttatattgtaaatgatttgtatcgtatgattaaggatctaaggcacaatatttgtcactgttctattagactttttactgaaaatgaataatggtgtaatggttctcctggggctgtcacattttataggtcagagtgtgacttcttaatatggtgctgatgtttttgtgtcaatggcttgaaactggcaagattaacaaaattaggccgggcatggtggctcacgcctgtaatcccagcactttgggaggcccaggtgggcggatcacctgaggttagaagtttgagaccagcctggccaacatggtgaaacctggcctctactaaaaatacaaaaattagccgggtgtggtggtgggtacctataatcccagctacttgggaggctgaggcaggagaatcgcttgaacctgggaggtggaggttgcagtgagctgagatcgtgctattgcactccagcctgggcgacagagcaagacgccatctcaaaaacaaaaaaacaaaattcatgttactaaaagacaggtagccatatacagacagtatatgccctattttttttaactgactcttaatgaaactttaattttacttaattaagaaatggaatttatatacaaaaatattttccatttccgttattatgctaattgttgtatgaaataagtgcaattatacttctcttttgagatatccaagagtatattcttgctctgtatagagaatatcatctgatagtgtcttatttatattaattaatgtctttgaaaagggaaaagtataaactggccttaaaattgtccaattatagttttataaccagtctattaaaggtgtttgtttaaaatggatatagttttagatttgtggtaatgctttggtattttcttggggaagaccttcacctttgcaaacttccctcatgtaaggaaggtactttaaatgtagcagccactgacatttctttttttaaaaaaaatttgagaagtctacttccttttaacttttttggtcttcagctaaaaaataggataagaaattaaggtctattccattctccatatcctgggtaagaatgtaaataagaggagaaggaagagtctaatagtaattatggatataaaaaataagaaattttgtatagaaatgaaggtttcataatgatcattttgttaaaggtctactttaatcagaaatagcaacgagatgaatgtatccaacatttcaatttgcattcggaaatccatgttgtttctaatattgtccagttgaaaactgtatgccaaaattagttgtttaagtgaagttttgtgacagaaaaaaggttgttttaatatctacttggtttttctcaaaatggaaataattttaaaatcaggaaagaataaatcagccaggtgtgatgacttgtaactgtaatcccagttataggggaggctgaagcaggaggatcacttgaggccaggagtttgagaccagcctgggcaacatagtgagatcccatctcaaaaaacattatttttaaaattagcctggtggctcacgcctgtaatcccagcactttgggaggccgaggtggccagatcacctgaggtcaggagttcgagaccaccctggccaacatggtgaaaccccatctctacagttttgtaaaaatacaaaaaattacctgggcctggtggcacacgcctgtagtcccagctacttgggaggctgaggcaggagaattgcttgagcccaagaggtggaggttacagtgagcagagatcacaccactgcactccagcctgggtggcagagcaacactttgtctcagaaaaaaaaaaaaaaaccaaaaagccaagtgtggtggtgtgcacctatagtcccagctactcaggaagctgagacaagaggatcaattgagcccaggagttcaaagctgtagtgagctgtcattgtgccactatcctccagtatgggtgacagagtgagacctggtctctaaaaa

SEQ ID NO: 8321 - DNA, 2216 bp, Homo sapiens
ccggggtaagatggctgcagtccgtatgctgagaacctggagcaggaatgcggggaagctgatgctcctgccttggtgaccccgatcttacaaaaactttcaagagcctgctatgtaccagtgctgtgttaggcactggagatacaaatatgaaatagacatcatatcttccttctcaagagattacaaccttgtggtggaggacaaaggagagggagacagatagaaattacaacccagcatgagagatttgtgttcgctattttcaaacatgtggtaatgttcatgttttgaagccaaattatgtgtgtttctttggttatccttcattcaagtatagtcatccacatcacttcctgaaaacaactgctgctctccgtggacaggttgttcagttcaagctctcagacattggagaagggattagagaagtaactgttaaagaatggtatgtaaaagaaggagatacagtgtctcagtttgatagcatctgtgaagttcaaagtgataaagcttctgttaccatcactagtcgttatgatggagtcattaaaaaactctattataatctagacgatattgcctatgtggggaagccattagtagacatagaaacggaagctttaaaagattcagaagaagatgttgttgaaactcctgcagtgtctcatgatgaacatacacaccaagagataaagggccgaaaaacactggcaactcctgcagttcgccgtctggcaatggaaaacaatattaagctgagtgaagttgttggctcaggaaaagatggcagaatacttaaagaagatatcctcaactatttggaaaagcagacaggagctatattgcctccttcacccaaagttgaaattatgccacctccaccaaagccaaaagacatgactgttcctatactagtatcaaaacctccggtattcacaggcaaagacaaaacagaacccataaaaggctttcaaaaagcaatggtcaagactatgtctgcagccctgaagatacctcattttggttattgtgatgagattgaccttactgaactggttaagctccgagaagaattaaaacccattgcatttgctcgtggaattaaactctcctttatgcctttcttcttaaaggctgcttccttgggattactacagtttcctatccttaacgcttctgtggatgaaaactgccagaatataacatataaggcttctcataacattgggatagcaatggatactgagcagggtttgattgtccctaatgtgaaaaatgttcagatctgctctatatttgacatcgccactgaactgaaccgcctccagaaattgggctctgtgagtcagctcagcaccactgatcttacaggaggaacatttactctttccaacattggatcaattggtggtacctttgccaaaccagtgataatgccacctgaagtagccattggggcccttggatcaattaaggccattccccgatttaaccagaaaggagaagtatataaggcacagataatgaatgtgagctggtcagctgatcacagagttattgatggtgctacaatgtcacgcttctccaatttgtggaaatcctatttagaaaacccagcttttatgctactagatctgaaatgaagactgataagacattcttgaactttttgagcttccaaagagtatgtaaaccctagctgtgccagcacatgttcatctttacaatttatattgtaaatgatttgtatcgtatgattaaggatctaaggcacaatatttgtcactgttctattagactttttactgaaaatgaataatggtgtaatggttctcctggggctgtcacattttataggtcagagtgtgacttcttaatatggtgctgatgtttttgtgtcaatggcttgaaactggcagagcaacactttgtctcagaaaaaaaaaaaaaaaccaaaaagccaagtgtggtggtgtgcacctatagtcccagctactcaggaagctgagacaagaggatcaattgagcccaggagttcaaagctgtagtgagctgtcattgtgccactatcctccagtatgggtgacagagtgagacctggtctctaaaaaataaaataaaataaaaaaaacaggtcaaataaatgctgttgttgtaaaatttcagataatacaaagagttaaccaataaaagaaaaagtcattcataatctt

SEQ ID NO: 8322 - DNA, 2467 bp, Homo sapiens
agtataagaatacattgtagctcgacattttggcaccagcccctaaagcattcccaccaccacccccgctgcgacaaagccctgcgctccttacgacagcgtacgacgccgagcctgacaggaacgcctcgtgcggtagaaccgcgcgggccaatcgcgctgctcccgggtgatgacgtaggctgcgcctgtgcatgcgcagggaggggagaccttggcggagcggcggaggcgcccagcggaggtgaaagtattggcggaaaggaaaatacagcggaaaaatgcagagctggagtcgtgtgtactgctccttggccaagagaggccatttcaatcgaatatctcatggcctacagggactttctgcagtgcctctgagaacttacgcagatcagccgattgatgctgatgtaacagttataggttctggtcctggaggatatgttgctgctattaaagctgcccagttaggcttcaagacagtctgcattgagaaaaatgaaacacttggtggaacatgcttgaatgttggttgtattccttctaaggctttattgaacaactctcattattaccatatggcccatggaaaagattttgcatctagaggaattgaaatgtccgaagttcgcttgaatttagacaagatgatggagcagaagagtactgcagtaaaagctttaacaggtggaattgcccacttattcaaacagaataaggttgttcatgtcaatggatatggaaagataactggcaaaaatcaagtcactgctacgaaagctgatggcggcactcaggttattgatacaaagaacattcttatagccacgggttcagaagttactccttttcctggaatcacgatagatgaagatacaatagtgtcatctacaggtgctttatctttaaaaaaagttccagaaaagatggttgttattggtgcaggagtaataggtgtagaattgggttcagtttggcaaagacttggtgcagatgtgacagcagttgaatttttaggtcatgtaggtggagttggaattgatatggagatatctaaaaactttcaacgcatccttcaaaaacaggggtttaaatttaaattgaatacaaaggttactggtgctaccaagaagtcagatggaaaaattgatgtttctattgaagctgcttctggtggtaaagctgaagttatcacttgtgatgtactcttggtttgcattggccgacgaccctttactaagaatttgggactagaagagctgggaattgaactagatcccagaggtagaattccagtcaataccagatttcaaactaaaattccaaatatctatgccattggtgatgtagttgctggtccaatgctggctcacaaagcagaggatgaaggcattatctgtgttgaaggaatggctggtggtgctgtgcacattgactacaattgtgtgccatcagtgatttacacacaccctgaagttgcttgggttggcaaatcagaagagcagttgaaagaagagggtattgagtacaaagttgggaaattcccatttgctgctaacagcagagctaagacaaatgctgacacagatggcatggtgaagatccttgggcagaaatcgacagacagagtactgggagcacatattcttggaccaggtgctggagaaatggtaaatgaagctgctcttgctttggaatatggagcatcctgtgaagatatagctagagtctgtcatgcacatccgaccttatcagaagcttttagagaagcaaatcttgctgcgtcatttggcaaatcaatcaacttttgaattagaagattatatatatttttttctgaaatttcctgggagcttttgtagaagtcacattcctgaacaggatattctcacagctccaagaatttctaggactgaattatgaaacttttggaaggtatttaataggtttggacaaaatggaatactcttatatctatattttacataaatttagtattttgtttcagtgcactaatgtgtaagacaaaaagctacttattgtagcatcctggaatatctccgtcaactcatattttcatgctgttcatgaaagattcaatgcccctgaatttaaatagcttttttctctgatacagaaaagttgaattttacatggctggagctagaatttgatatgtgaacagttgtgtttgaagcacagtgatcaagttatttttaatttggttttcacattggaaacaagtcagtcattcagatatgattcaaatgtctataaaccgaactgatgtaagtaaacggtctctcacttgttttatttaacctctaaattctttcattttaggggtagcatttgtgttgaagaggttttaaagcttccattgttgtctgcaactctgaagggtaattatatagttacccaaattaagagagtctatttacggaactcaaatacgtgggcattcaaa

SEQ ID NO: 8323 - DNA, 2041 bp, Homo sapiens
atgcgcagggaggggagaccttggcggagcggcggaggcgcccagcggaggtgaaagtattggcggaaaggaaaatacagcggaaaaatgcagagctggagtcgtgtgtactgctccttggccaagagaggccatttcaatcgaatatctcatggcctacagggactttctgcagtgcctctgagaacttacgcagatcagccgattgatgctgatgtaacagttataggttctggtcctggaggatatgttgctgctattaaagctgcccagttaggcttcaagacagtctgcattgagaaaaatgaaacacttggtggaacatgcttgaatgttggttgtattccttctaaggctttattgaacaactctcattattaccatatggcccatggaaaagattttgcatctagaggaattgaaatgtccgaagttcgcttgaatttagacaagatgatggagcagaagagtactgcagtaaaagctttaacaggtggaattgcccacttattcaaacagaataaggttgttcatgtcaatggatatggaaagataactggcaaaaatcaagtcactgctacgaaagctgatggcggcactcaggttattgatacaaagaacattcttatagccacgggttcagaagttactccttttcctggaatcacgatagatgaagatacaatagtgtcatctacaggtgctttatctttaaaaaaagttccagaaaagatggttgttattggtgcaggagtaataggtgtagaattgggttcagtttggcaaagacttggtgcagatgtgacagcagttgaatttttaggtcatgtaggtggagttggaattgatatggagatatctaaaaactttcaacgcatccttcaaaaacaggggtttaaatttaaattgaatacaaaggttactggtgctaccaagaagtcagatggaaaaattgatgtttctattgaagctgcttctggtggtaaagctgaagttatcacttgtgatgtactcttggtttgcattggccgacgaccctttactaagaatttgggactagaagagctgggaattgaactagatcccagaggtagaattccagtcaataccagatttcaaactaaaattccaaatatctatgccattggtgatgtagttgctggtccaatgctggctcacaaagcagaggatgaaggcattatctgtgttgaaggaatggctggtggtgctgtgcacattgactacaattgtgtgccatcagtgatttacacacaccctgaagttgcttgggttggcaaatcagaagagcagttgaaagaagagggtattgagtacaaagttgggaaattcccatttgctgctaacagcagagctaagacaaatgctgacacagatggcatggtgaagatccttgggcagaaatcgacagacagagtactgggagcacatattcttggaccaggtgctggagaaatggtaaatgaagctgctcttgctttggaatatggagcatcctgtgaagatatagctagagtctgtcatgcacatccgaccttatcagaagcttttagagaagcaaatcttgctgcgtcatttggcaaatcaatcaacttttgaattagaagattatatatatttttttctgaaatttcctgggagcttttgtagaagtcacattcctgaacaggatattctcacagctccaagaatttctaggactgaattatgaaacttttggaagcatttgtcttcaacagaatgtcttcagcactttgttttgcctcatctgccctcagttttgcttcagagacctaaatatgaagaataaattacccagggaagactttcattctttctaaaggagaccagaatattggaaatggctcaaaaatgatgttgaaaaactatgtacttggaatcatatgtctgggaaacaactttctcccattcaacaaagtattgtatcttacagactgcaagtattcagtatagagattcctaaacagtattctgatataaatagaactagcatttaaaattt

SEQ ID NO: 8324 - DNA, 1859 bp, Homo sapiens
aggggagaccttggcggagcggcggaggcgcccagcggaggtgaaagtattggcggaaaggaaaatacagcggaaaaatgcagagctggagtcgtgtgtactgctccttggccaagagaggccatttcaatcgaatatctcatggcctacagggactttctgcagtgcctctgagaacttacgcagatcagccgattgatgctgatgtaacagttataggttctggtcctggaggatatgttgctgctattaaagctgcccagttaggcttcaagacagtctgcattgagaaaaatgaaacacttggtggaacatgcttgaatgttggttgtattccttctaaggctttattgaacaactctcattattaccatatggcccatggaaaagattttgcatctagaggaattgaaatgtccgaagttcgcttgaatttagacaagatgatggagcagaagagtactgcagtaaaagctttaacaggtggaattgcccacttattcaaacagaataagatagatgaagatacaatagtgtcatctacaggtgctttatctttaaaaaaagttccagaaaagatggttgttattggtgcaggagtaataggtgtagaattgggttcagtttggcaaagacttggtgcagatgtgacagcagttgaatttttaggtcatgtaggtggagttggaattgatatggagatatctaaaaactttcaacgcatccttcaaaaacaggggtttaaatttaaattgaatacaaaggttactggtgctaccaagaagtcagatggaaaaattgatgtttctattgaagctgcttctggtggtaaagctgaagttatcacttgtgatgtactcttggtttgcattggccgacgaccctttactaagaatttgggactagaagagctgggaattgaactagatcccagaggtagaattccagtcaataccagatttcaaactaaaattccaaatatctatgccattggtgatgtagttgctggtccaatgctggctcacaaagcagaggatgaaggcattatctgtgttgaaggaatggctggtggtgctgtgcacattgactacaattgtgtgccatcagtgatttacacacaccctgaagttgcttgggttggcaaatcagaagagcagttgaaagaagagggtattgagtacaaagttgggaaattcccatttgctgctaacagcagagctaagacaaatgctgacacagatggcatggtgaagatccttgggcagaaatcgacagacagagtactgggagcacatattcttggaccaggtgctggagaaatggtaaatgaagctgctcttgctttggaatatggagcatcctgtgaagatatagctagagtctgtcatgcacatccgaccttatcagaagcttttagagaagcaaatcttgctgcgtcatttggcaaatcaatcaacttttgaattagaagattatatatatttttttctgaaatttcctgggagcttttgtagaagtcacattcctgaacaggatattctcacagctccaagaatttctaggactgaattatgaaacttttggaaggtatttaataggtttggacaaaatggaatactcttatatctatattttacataaatttagtattttgtttcagtgcactaatgtgtaagacaaaaagctacttattgtagcatcctggaatatctccgtcaactcatattttcatgctgttcatgaaagattcaatgcccctgaatttaaatagcttttttctctgatacagaaaagttgaattttacatggctggagctagaatttgatatgtgaacagttgtgtttgaagcacagtgatc

SEQ ID NO: 8325 - DNA, 1993 bp, Homo sapiens
gaggggagaccttggcggagcggcggaggcgcccagcggaggtgaaagtattggcggaaaggaaaatacagcggaaaaatgcagagctggagtcgtgtgtactgctccttggccaagagaggccatttcaatcgaatatctcatggcctacagggactttctgcagtgcctctgagaacttacgcagatcagccgattgatgctgatgtaacagttataggttctggtcctggaggatatgttgctgctattaaagctgcccagttaggcttcaaggctttattgaacaactctcattattaccatatggcccatggaaaagattttgcatctagaggaattgaaatgtccgaagttcgcttgaatttagacaagatgatggagcagaagagtactgcagtaaaagctttaacaggtggaattgcccacttattcaaacagaataaggttgttcatgtcaatggatatggaaagataactggcaaaaatcaagtcactgctacgaaagctgatggcggcactcaggttattgatacaaagaacattcttatagccacgggttcagaagttactccttttcctggaatcacgatagatgaagatacaatagtgtcatctacaggtgctttatctttaaaaaaagttccagaaaagatggttgttattggtgcaggagtaataggtgtagaattgggttcagtttggcaaagacttggtgcagatgtgacagcagttgaatttttaggtcatgtaggtggagttggaattgatatggagatatctaaaaactttcaacgcatccttcaaaaacaggggtttaaatttaaattgaatacaaaggttactggtgctaccaagaagtcagatggaaaaattgatgtttctattgaagctgcttctggtggtaaagctgaagttatcacttgtgatgtactcttggtttgcattggccgacgaccctttactaagaatttgggactagaagagctgggaattgaactagatcccagaggtagaattccagtcaataccagatttcaaactaaaattccaaatatctatgccattggtgatgtagttgctggtccaatgctggctcacaaagcagaggatgaaggcattatctgtgttgaaggaatggctggtggtgctgtgcacattgactacaattgtgtgccatcagtgatttacacacaccctgaagttgcttgggttggcaaatcagaagagcagttgaaagaagagggtattgagtacaaagttgggaaattcccatttgctgctaacagcagagctaagacaaatgctgacacagatggcatggtgaagatccttgggcagaaatcgacagacagagtactgggagcacatattcttggaccaggtgctggagaaatggtaaatgaagctgctcttgctttggaatatggagcatcctgtgaagatatagctagagtctgtcatgcacatccgaccttatcagaagcttttagagaagcaaatcttgctgcgtcatttggcaaatcaatcaacttttgaattagaagattatatatatttttttctgaaatttcctgggagcttttgtagaagtcacattcctgaacaggatattctcacagctccaagaatttctaggactgaattatgaaacttttggaaggtatttaataggtttggacaaaatggaatactcttatatctatattttacataaatttagtattttgtttcagtgcactaatgtgtaagacaaaaagctacttattgtagcatcctggaatatctccgtcaactcatattttcatgctgttcatgaaagattcaatgcccctgaatttaaatagcttttttctctgatacagaaaagttgaattttacatggctggagctagaatttgatatgtgaacagttgtgtttgaagcacagtgatcaagttatttttaatttggttttcacattggaaacaagtcagtcattcagatatgattc

SEQ ID NO: 8326 - DNA, 1802 bp, Homo sapiens
atgcgcagggaggggagaccttggcggagcggcggaggcgcccagcggaggtgaaagtattggcggaaaggaaaatacagcggaaaaatgcagagctggagtcgtgtgtactgctccttggccaagagaggccatttcaatcgaatatctcatggcctacagggactttctgcagtgcctctgagaacttacgcagatcagccgagctttattgaacaactctcattattaccatatggcccatggaaaagattttgcatctagaggaattgaaatgtccgaagttcgcttgaatttagacaagatgatggagcagaagagtactgcagtaaaagctttaacaggtggaattgcccacttattcaaacagaataaggttgttcatgtcaatggatatggaaagataactggcaaaaatcaagtcactgctacgaaagctgatggcggcactcaggttattgatacaaagaacattcttatagccacgggttcagaagttactccttttcctggaatcacgatagatgaagatacaatagtgtcatctacaggtgctttatctttaaaaaaagttccagaaaagatggttgttattggtgcaggagtaataggtgtagaattgggttcagtttggcaaagacttggtgcagatgtgacagcagttgaatttttaggtcatgtaggtggagttggaattgatatggagatatctaaaaactttcaacgcatccttcaaaaacaggggtttaaatttaaattgaatacaaaggttactggtgctaccaagaagtcagatggaaaaattgatgtttctattgaagctgcttctggtggtaaagctgaagttatcacttgtgatgtactcttggtttgcattggccgacgaccctttactaagaatttgggactagaagagctgggaattgaactagatcccagaggtagaattccagtcaataccagatttcaaactaaaattccaaatatctatgccattggtgatgtagttgctggtccaatgctggctcacaaagcagaggatgaaggcattatctgtgttgaaggaatggctggtggtgctgtgcacattgactacaattgtgtgccatcagtgatttacacacaccctgaagttgcttgggttggcaaatcagaagagcagttgaaagaagagggtattgagtacaaagttgggaaattcccatttgctgctaacagcagagctaagacaaatgctgacacagatggcatggtgaagatccttgggcagaaatcgacagacagagtactgggagcacatattcttggaccaggtgctggagaaatggtaaatgaagctgctcttgctttggaatatggagcatcctgtgaagatatagctagagtctgtcatgcacatccgaccttatcagaagcttttagagaagcaaatcttgctgcgtcatttggcaaatcaatcaacttttgaattagaagattatatatatttttttctgaaatttcctgggagcttttgtagaagtcacattcctgaacaggatattctcacagctccaagaatttctaggactgaattatgaaacttttggaaggtatttaataggtttggacaaaatggaatactcttatatctatattttacataaatttagtattttgtttcagtgcactaatgtgtaagacaaaaagctacttattgtagcatcctggaatatctccgtcaactcatattttcatgctgttcatgaaagattcaatgcccctgaatttaaatagcttttttctctgatacagaaaagttg

SEQ ID NO: 8327 - DNA, 1863 bp, Homo sapiens
atgctgatatatgttgctgctattaaagctgcccagttaggcttcaagacagtctgcattgagaaaaatgaaacacttggtggaacatgcttgaatgttggttgtattccttctaaggctttattgaacaactctcattattaccatatggcccatggaaaagattttgcatctagaggaattgaaatgtccgaagttcgcttgaatttagacaagatgatggagcagaagagtactgcagtaaaagctttaacaggtggaattgcccacttattcaaacagaataaggttgttcatgtcaatggatatggaaagataactggcaaaaatcaagtcactgctacgaaagctgatggcggcactcaggttattgatacaaagaacattcttatagccacgggttcagaagttactccttttcctggaatcacgatagatgaagatacaatagtgtcatctacaggtgctttatctttaaaaaaagttccagaaaagatggttgttattggtgcaggagtaataggtgtagaattgggttcagtttggcaaagacttggtgcagatgtgacagcagttgaatttttaggtcatgtaggtggagttggaattgatatggagatatctaaaaactttcaacgcatccttcaaaaacaggggtttaaatttaaattgaatacaaaggttactggtgctaccaagaagtcagatggaaaaattgatgtttctattgaagctgcttctggtggtaaagctgaagttatcacttgtgatgtactcttggtttgcattggccgacgaccctttactaagaatttgggactagaagagctgggaattgaactagatcccagaggtagaattccagtcaataccagatttcaaactaaaattccaaatatctatgccattggtgatgtagttgctggtccaatgctggctcacaaagcagaggatgaaggcattatctgtgttgaaggaatggctggtggtgctgtgcacattgactacaattgtgtgccatcagtgatttacacacaccctgaagttgcttgggttggcaaatcagaagagcagttgaaagaagagggtattgagtacaaagttgggaaattcccatttgctgctaacagcagagctaagacaaatgctgacacagatggcatggtgaagatccttgggcagaaatcgacagacagagtactgggagcacatattcttggaccaggtgctggagaaatggtaaatgaagctgctcttgctttggaatatggagcatcctgtgaagatatagctagagtctgtcatgcacatccgaccttatcagaagcttttagagaagcaaatcttgctgcgtcatttggcaaatcaatcaacttttgaattagaagattatatatatttttttctgaaatttcctgggagcttttgtagaagtcacattcctgaacaggatattctcacagctccaagaatttctaggactgaattatgaaacttttggaaggtatttaataggtttggacaaaatggaatactcttatatctatattttacataaatttagtattttgtttcagtgcactaatgtgtaagacaaaaagctacttattgtagcatcctggaatatctccgtcaactcatattttcatgctgttcatgaaagattcaatgcccctgaatttaaatagcttttttctctgatacagaaaagttgaattttacatggctggagctagaatttgatatgtgaacagttgtgtttgaagcacagtgatcaagttatttttaatttggttttcacattggaaacaagtcagtcattcagatatgattcaaatgtctataaaccgaactgatgtaagt

SEQ ID NO: 8328 - DNA, 4458 bp, Homo sapiens
acaaacctgaaacgaaatctttgcaaccagtacagcctgcgcggggcgcggcccagtccatcccccttcggatgcgcagaagcagaggtcaccacgccggacccctcgattccctcgcgggcgattcctggctccttcaccaccccagcactccaagacccccgccctttggcctgaggctcccactgccctagccagttcccgggctcacttccagcttttccagaaagcttggccacgcccctcggcccagactctcaggccactcggccgcaattaacccgcgtctctgcgcctttttaggcccctccccctcggtcgtgcccttgtcatctcttaggccccgtctcaccctttcggatgcctcccctagaaccctaccactttccacccctttccgtctgttatttctcccaaacttgcgcccgcacaggcccctctggaacactcctgccccgtagtgcccctcgtccccgctccgtagagaaagagcgtgcgtgccgcgcatttctggcctggggagcgggtggagtaaacctgcgggaaccattttacgacaacgtgcggctgtgcggtgtggctgacggcaacgccgctgctcttggagaggtcactccggagacggcgttggttttggggtgtggggggttggtggcactatgtggcgcgtctgtgcgcgacgggctcagaatgtagccccatgggcgggactcgaggctcggtggacggccttgcaggaggtacccggaactccacgagtgacctcgcgatctggcccggctcccgctcgtcgcaacagcgtgactacagggtatggcggggtccgggcactgtgcggctggacccccagttctggggccacgccgcggaaccgcttactgctgcagcttttggggtcgcccggccgccgctattacagtcttcccccgcatcagaaggttccattgccttctctttcccccacaatgcaggcaggcaccatagcccgttgggaaaaaaaagagggggacaaaatcaatgaaggtgacctaattgcagaggttgaaactgataaagccactgttggatttgagagcctggaggagtgttatatggcaaagatacttgttgctgaaggtaccagggatgttcccatcggagcgatcatctgtatcacagttggcaagcctgaggatattgaggcctttaaaaattatacactggattcctcagcagcacctaccccacaagcggccccagcaccaacccctgctgccactgcttcgccacctacaccttctgctcaggctcctggtagctcatatccccctcacatgcaggtacttcttcctgccctctctcccaccatgaccatgggcacagttcagagatgggaaaaaaaagtgggtgagaagctaagtgaaggagacttactggcagagatagaaactgacaaagccactataggttttgaagtacaggaagaaggttatctggcaaaaatcctggtccctgaaggcacaagagatgtccctctaggaaccccactctgtatcattgtagaaaaagaggcagatatatcagcatttgctgactataggccaaccgaagtaacagatttaaaaccacaagtgccaccacctaccccacccccggtggccgctgttcctccaactccccagcctttagctcctacaccttcagcaccctgcccagctactcctgctggaccaaagggaagggtgtttgttagccctcttgcaaagaagttggcagtagagaaagggattgatcttacacaagtaaaagggacaggaccagatggtagaatcaccaagaaggatatcgactcttttgtgcctagtaaagttgctcctgctccggcagctgttgtgcctcccacaggtcctggaatggcaccagttcctacaggtgtcttcacagatatcccaatcagcaacattcgtcgggttattgcacagcgattaatgcaatcaaagcaaaccatacctcattattacctttctatcgatgtaaatatgggagaagttttgttggtacggaaagaacttaataagatattagaagggagaagcaaaatttctgtcaatgacttcatcataaaagcttcagctttggcatgtttaaaagttcccgaagcaaattcttcttggatggacacagttataagacaaaatcatgttgttgatgtcagtgttgcggtcagtactcctgcaggactcatcacacctattgtgtttaatgcacatataaaaggagtggaaaccattgctaatgatgttgtttctttagcaaccaaagcaagagagggtaaactacagccacatgaattccagggtggcacttttacgatctccaatttaggaatgtttggaattaagaatttctctgctattattaacccacctcaagcatgtattttggcaattggtgcttcagaggataaactggtccctgcagataatgaaaaagggtttgatgtggctagcatgatgtctgttacactcagttgtgatcaccgggtggtggatggagcagttggagcccagtggcttgctgagtttagaaagtaccttgaaaaacctatcactatgttgttgtaactaactcaagaatttctaaactctcccaggtcacactgattcattcttaacaagatatttatatgttattaaacaggtggttctttttattttaaccagttatttttattattgagtctgtccagataagttatttataatgggcattactgaatttttaaaatgccgattacacccaaatattgtgcacatttaataatcagacaccagatttttagctctgtactcctaattaagggacatgtatgtggccttgcctagccctttggtgataagtacttcctctaggaaatgtacgataggtagaattgtggttccctaaagacaagtacataaaggtgaccctgatgaaaccttgaagttctgaaatttaactgcctaaaatgttctccttagatgtgagagaaagagaaatcagaaaaattaattctcttgggggaagggcttgaattgaagctttactttagaatttagccctggtttgaaattttccattacatgatcttggtttatcatcgatgggaagggtagaaaacttcaaggaaaataagtgaaattttaaaagtcagcattttcttagacctcttcagctgattgtttatttttctatgaattcctacacatggttattcccccctacttgagataatctaaatataaaccagctacttgatgtaactgagaatttgtgtggatatttatttaaacaaatgtgtaattttgagtacagaattcaacagttacctccaaaaaagaaacattgttaatataatttaacagaagttgtgaaactaaaattttctaagattaactggtagttcattgtaaatgaacataatgaacagaatttatgactccactgtggaaaatgctatcaaataactaaggaatatatatggaataagtgtacatatgtaaaatattgttactagagttagatatgtgccaaagtccatttatcccaaatcctgtctgaaaaggaggggtacattggtaaacattttggagtgcttaaaaatgccaaaaacaaaatggtaatttctactttgataaagtaaaaaagttaaatgtgtgtaaaaaagtgttctgtgtccttctactccagcatcgtctcatgtaaaataagaaagccctaaaatactattggagagaaaaaattaactaggttgctactttatttgcctaaatacttttttctattttgttagattttgcctttcttttggaaggaaggaggcgatattctggattataaaaatgaattgggaacattatcacaattccagactttctattaatatttatgtgttttaataaacgtttgaaattatttatgactacttaaaatgaatctgaccagtgcttcctggtatatgtaatatgtggagttagcccctgaaatttgctttaagtgtttcagtgttgaatctgtttctaaatattcattattacatggtacacaagtgacactccatatattccacacagacttttaccttgctgtattattatgaaaacaatacattaatttgatttttcagtaattagtaattttaggttgaagattatccaaaagaaacaagcttatcacaagggaccatcatcaatatgatccaaatctggttcaaacattcaaaacttcaaagataattcatctttcgctaatgcttgtggttctgttgttcccttgaaaaaaaataaaaacagttgccttctaataaacattgttgagttaaaaattaatctgagctataatctaaatcgattcagtctcttaccagaactgaaagaaaaaagttagaaatagtgtttttggttcatatgattatttaaaaattaaagtataaatcttcaa

SEQ ID NO: 8329 - DNA, 1352 bp, Homo sapiens
gctgctcttggagaggtcactccggagacggcgttggttttggggtgtggggggttggtggcactatgtggcgcgtctgtgcgcgacgggctcagaatgtagccccatgggcgggactcgaggctcggtggacggccttgcaggaggtacccggaactccacgagtgacctcgcgatctggcccggctcccgctcgtcgcaacagcgtgactacagggtatggcggggtccgggcactgtgcggctggacccccagttctggggccacgccgcggaaccgcttactgctgcagcttttggggtcgcccggccgccgctattacagtcttcccccgcatcagaaggttccattgccttctctttcccccacaatgcaggcaggcaccatagcccgttgggaaaaaaaagagggggacaaaatcaatgaaggtgacctaattgcagaggttgaaactgataaagccacagttggcaagcctgaggatattgaggcctttaaaaattatacactggattcctcagcagcacctaccccacaagcggccccagcaccaacccctgctgccactgcttcgccacctacaccttctgctcaggctcctggtagctcatatccccctcacatgcaggtacttcttcctgccctctctcccaccatgaccatgggcacagttcagagatgggaaaaaaaagtgggtgagaagctaagtgaaggagacttactggcagagatgtccctctaggaaccccactctgtatcattgtagaaaaagaggcagatatatcagcatttgctgactataggccaaccgaagtaacagatttaaaaccacaagtgccaccacctaccccacccccggtggccgctgttcctccaactccccagcctttagctcctacaccttcagcaccctgcccagctactcctgctggaccaaagggaagggtgtttgttagccctcttgcaaagaagttggcagtagagaaagggattgatcttacacaagtaaaagggacaggaccagatggtagaatcaccaagaaggatatcgactcttttgtgcctagtaaagttgctcctgctccggcagctgttgtgcctcccacaggtcctggaatggcaccagttcctacaggtgtcttcacagatatcccaatcagcaacattcgtcgggttattgcacagcgattaatgcaatcaaagcaaaccatacctcattattacctttctatcgatgtaaatatgggagaagttttgttggtacggaaagaacttaataagatattagaagggagaagcaaaatttctgtcaatgacttcatcataaaagcttcagctttggcatgtttaa

SEQ ID NO: 8330 - DNA, 1766 bp, Homo sapiens
cccgctcgtcgcaacagcgtgactacagggtatggcggggtccgggcactgtgcggctggacccccagttctggggccacgccgcggaaccgcttactgctgcagcttttggggtcgcccggccgccgctattacagtcttcccccgcatcagaaggttccattgccttctctttcccccacaatgcaggcaggcaccatagcccgttgggaaaaaaaagagggggacaaaatcaatgaaggagacttactggcagagatagaaactgacaaagccactataggttttgaagtacaggaagaaggttatctggcaaaaatcctggtccctgaaggcacaagagatgtccctctaggaaccccactctgtatcattgtagaaaaagaggcagatatatcagcatttgctgactataggccaaccgaagtaacagatttaaaaccacaagtgccaccacctaccccacccccggtggccgctgttcctccaactccccagcctttagctcctacaccttcagcaccctgcccagctactcctgctggaccaaagggaagggtgtttgttagccctcttgcaaagaagttggcagtagagaaagggattgatcttacacaagtaaaagggacaggaccagatggtagaatcaccaagaaggatatcgactcttttgtgcctagtaaagttgctcctgctccggcagctgttgtgcctcccacaggtcctggaatggcaccagttcctacaggtgtcttcacagatatcccaatcagcaacattcgtcgggttattgcacagcgattaatgcaatcaaagcaaaccatacctcattattacctttctatcgatgtaaatatgggagaagttttgttggtacggaaagaacttaataagatattagaagggagaagcaaaatttctgtcaatgacttcatcataaaagcttcagctttggcatgtttaaaagttcccgaagcaaattcttcttggatggacacagttataagacaaaatcatgttgttgatgtcagtgttgcggtcagtactcctgcaggactcatcacacctattgtgtttaatgcacatataaaaggagtggaaaccattgctaatgatgttgtttctttagcaaccaaagcaagagagggtaaactacagccacatgaattccagggtggcacttttacgatctccaatttaggaatgtttggaattaagaatttctctgctattattaacccacctcaagcatgtattttggcaattggtgcttcagaggataaactggtccctgcagataatgaaaaagggtttgatgtggctagcatgatgtctgttacactcagttgtgatcaccgggtggtggatggagcagttggagcccagtggcttgctgagtttagaaagtaccttgaaaaacctatcactatgttgttgtaactaactcaagaatttctaaactctcccaggtcacactgattcattcttaacaagatatttatatgttattaaacaggtggttctttttattttaaccagttatttttattattgagtctgtccagataagttatttataatgggcattactgaatttttaaaatgccgattacacccaaatattgtgcacatttaataatcagacaccagatttttagctctgtactcctaattaagggacatgtatgtggccttgcctagccctttggtgataagtacttcctctaggaaatgtacgataggtagaattgtggttccctaaagac

SEQ ID NO: 8331 - DNA, 1479 bp, Homo sapiens
tatatccggtgtccgcccgccctcggctcctccgccgtgatgctgtcccgatcccgctgtgtgtctcgggcgttcagccgctcgctctccgccttccagaaggggtctccttatgccagggaccaggttaccctaacagcaggaaggttgtaggatgacttggttacagtcaaaaccccagcgtttgcagaatctgtcacagagggagatgtcaggtgggagaaagacatctgtgcaggttccatcaccagcaaatggcgtgattgaagctcttttggtacctgatgggggaaaagtcgaaggaggcactccacttttcacactcaggaaaactggtgctgctcctgctaaggccaagccggctgaagctcctgctgctgcagccccaaaagcagaacctacagcagcggcagttcctccccctgcagcacccatacccactcagatgccaccggtgccctcgccctcacagcctccttctggcaaacctgtgtctgcagtaaaacccactgttgccccaccactagctgagccaggagctggcaaaggtctgcgttcagaacatcgggagaaaatgaacaggatgcggcagcgcattgctcagcgtctgaaggaggcccagaatacatgtgcaatgctgacaacttttaatgagattgacatgagtaacatccaggagatgagggctcggcacaaagaggcttttttgaagaaacataacctcaaactaggcttcatgtcggcatttgtgaaggcctcagcctttgccttgcaggaacagcctgttgtaaatgcagtgattgacgacacaaccaaagaggtggtgtatagggattatattgacatcagtgttgcagtggccaccccacggggtctggtggttccagtcatcaggaatgtggaagctatgaattttgcagatattgaacggaccatcactgaactgggagagaaggcccgaaagaatgaacttgccattgaagatatggatggcggtaccttcaccattagcaatggaggcgtttttggctcgctctttggaacacccattatcaacccccctcagtctgccatcctggggatgcatggcatctttgacaggccagtggctataggaggcaaggtagaggtgcggcccatgatgtacgtggcactgacctatgatcaccggctgattgatggcagagaggctgtgactttcctccgcaaaatcaaggcagcggtagaggatcccagagtcctcctcctggatctttaggaggaacccacacaccctacaagttgatcatgcaggaactgaaaaccagtcttctccctgtcccctcatgggtcccgggttagcctggtgacaggcagacacatgctgttggcctcaagcaaggaagcagagcactgtgtaaccagcagtcacaggtcttttcttggcgttcctgccaggctctccctctctgcacctgtctcatagcctcgaatatctta

SEQ ID NO: 8332 - DNA, 2838 bp, Homo sapiens
acttccggttgttgtccggccctatatccggtgtccgcccgccctcggctcctccgccgtgatgctgtcccgatcccgctgtgtgtctcgggcgttcagccgctcgctctccgccttccagaaggggaactgccctctagggagacgttccctgcctggggtctccttatgccagggaccaggttaccctaacagcaggaaggttgtcattaacaacagtgtcttcagtgttcgctttttcagaactacagctgtatgcaaggatgacttggttacagtcaaaaccccagcgtttgcagaatctgtcacagagggagatgtcaggtgggagaaagctgttggagacacagttgcagaagatgaagtggtttgtgagattgaaactgacaagacatctgtgcaggttccatcaccagcaaatggcgtgattgaagctcttttggtacctgatgggggaaaagtcgaaggaggcactccacttttcacactcaggaaaactggtgctgctcctgctaaggccaagccggctgaagctcctgctgctgcagccccaaaagcagaacctacagcagcggcagttcctccccctgcagcacccatacccactcagatgccaccggtgccctcgccctcacagcctccttctggcaaacctgtgtctgcagtaaaacccactgttgccccaccactagctgagccaggagctggcaaaggtctgcgttcagaacatcgggagaaaatgaacaggatgcggcagcgcattgctcagcgtctgaaggaggcccagaatacatgtgcaatgctgacaacttttaatgagattgacatgagtaacatccaggagatgagggctcggcacaaagaggcttttttgaagaaacataacctcaaactaggcttcatgtcggcatttgtgaaggcctcagcctttgccttgcaggaacagcctgttgtaaatgcagtgattgacgacacaaccaaagaggtggtgtatagggattatattgacatcagtgttgcagtggccaccccacggggtctggtggttccagtcatcaggaatgtggaagctatgaattttgcagatattgaacggaccatcactgaactgggagagaaggcccgaaagaatgaacttgccattgaagatatggatggcggtaccttcaccattagcaatggaggcgtttttggctcgctctttggaacacccattatcaacccccctcagtctgccatcctggggatgcatggcatctttgacaggccagtggctataggaggcaaggtagaggtgcggcccatgatgtacgtggcactgacctatgatcaccggctgattgatggcagagaggctgtgactttcctccgcaaaatcaaggcagcggtagaggatcccagagtcctcctcctggatctttaggaggaacccacacaccctacaagttgatcatgcaggaactgaaaaccagtcttctccctgtcccctcatgggtcccgggttagcctggtgacaggcagacacatgctgttggcctcaagcaaggaagcagagcactgtgtaaccagcagtcacaggtcttttcttggcgttcctgccaggctctccctctctgcacctgtctcatagcctcgaatatcttaattccttaggcttaagagagagagccttaatggatgctcattcatattcctgcctttcttccatcagctctctgcaaagatgattttgcttttccctagtgctggtatactatagagaaacccctggggaccatgtgattaagttcctatcttttgaaagtttgttctgcagagacttctaggaggatgctgtgcctcccaagctcagagcagcctctgtcctggctgtgcacattctcccttgattccacttgtgtggagggattgaacacaggcaaagaggtgctgctttgcttcttcaatggcaccttcattctccgttgtcattgacttcaagatgcctcttctacctcttccaggaagcacaggccaggggatctgggtgtgtgagtgggaggagagggcagaggtcccctgaggtcatgcattgtaatcatcatagaaggagagcccaggcctgccctcacgctctccatcataggctgacaccaagaagactcgtcttggcacaatctcacacagctggggctgtagcaaccctttccaacccctttgctggttgctgggcctcattctagcaccttgttcttagagcagattctagcacatcatggcagtgggaccaagcgtggtcccgaggaagggccagagcctggtagagactagggaagggaggtctcctctagactgactcacattgccttgagcttttcagttaagttgctgtaagcacctgggctgaggaggcagtttttgttccttcctgcgttatagcggggccttgtctcttcctctgcaggacacagatctggaggacgtggactggggtaggaaaccaccctgagggtgttagtacctagtggtgaaacggatgaggtcatttctaaggtgtgttgcccgtggatctgggcacaatcattggaattccttggagccactgggattcatggctttgtatccaactgcatccaggcctgaggctgctgacgtttgacaccagggccagtagagagtgcccttttgtatcttaagccaagaagtgaggcctgggggtgggggaggggggaaggggtgggagccaatactgagtgcctgcagcatctactactctgtcttcactattcagaacttgtaactaaagtatttaaagaaactgattttaaatgcaaattaaagggcagatattctcaaaca

SEQ ID NO: 8333 - DNA, 2065 bp, Homo sapiens
gggcttaatgacggaaggagcatggcgtggagacacctgaaaaagcgggcccaggatgctgtgatcatcctggggggaggaggacttctcttcgcctcctacctgatggccacgggagatgagcgtttctatgctgaacacctgatgccgactctgcaggggctgctggacccggagtcagcccacagactggctgttcgcttcacctccctggggctccttccacgggccagatttcaagactctgacatgctggaagtgagagttctgggccataaattccgaaatccagtaggaattgctgcaggatttgacaagcatggggaagccgtggacggactttataagatgggctttggttttgttgagataggaagtgtgactccaaaacctcaggaaggaaaccctagacccagagtcttccgcctccctgaggaccaagctgtcattaacaggtatggatttaacagtcacgggctttcagtggtggaacacaggttacgggccagacagcagaagcaggccaagctcacagaagatggactgcctctgggggtcaacttggggaagaacaagacctcagtggacgccgcggaggactacgcagaaggggtgcgcgtactgggccccctggccgactacctggtggtgaatgtgtccagccccaacactgccgggctgcggagccttcagggaaaggccgagctgcgccgcctgctgaccaaggtgctgcaggagagggatggcttgcggagagtgcacaggccggcagtcctggtgaagatcgctcctgacctcaccagccaggataaggaggacattgccagtgtggtcaaagagttgggcatcgatgggctgattgttacgaacaccaccgtgagtcgccctgcgggcctccagggtgccctgcgctctgaaacaggagggctgagtgggaagcccctccgggatttatcaactcaaaccattcgggagatgtatgcactcacccaaggccgagttcccataattggggttggtggtgtgagcagcgggcaggacgcgctggagaagatccgggcaggggcctccctggtgcagctgtacacggccctcaccttctgggggccacccgttgtgggcaaagtcaagcgggaactggaggcccttctgaaagagcagggctttggcggagtcacagatgccattggagcagatcatcggaggtgaggacagcgtctgacgggaagcctgatctggaaccttcccaaggactcaggcaagcctttgtggctggatcatgagaggagggactccatcttgagccatgtcccccagccatggcatggctgcactgtaaacgccaatcggggggtcaccaggatcaaccgcaggctttcttcagtcccttggtcagaccataaactgcatttttgattctttgtggattcaaaccctaggatccatcagtcttgcaaggacattgaatattaggaggaaaaagtcatggaaaaaataaagccatttagaacctgggtttcaacgctagccctttctggtttgccataggccctgccaagatactgcaggtccatccaggcctctgctatctgcatctgcagtgggcttcccaggaacttgactgtctttcatttgatctttatttttgtttatttaatattttaaactttattttaaaaatatttcaaacataagggcggggtgtggtggctcatgcctgtaatcccagcactttgggaggccgaggcgggcggatcacctgaggccaggagttggagaccagccaggccaccatggtgaaaccctgtctctaccaaaaatacaaaaaattagccagatattgtggcaggcacttttaatcccagctactcgggaggctgaggcaggagaattgcttgaacctgggaggcggaggttgcagtgagccaagattgcaccagtgcactccagcttgggcgacagatcaagactctgtcacacacaaaacaaacaaacaaattttcccgtttctctctgtccctttctctataacatggataaaatattcacgtcttatgtatttatt

SEQ ID NO: 8334 - DNA, 2127 bp, Homo sapiens
atttgcagcctgaggcagagctcgggggctgtcggtggggaccttgcaggagggcaccccaagcccgcccggcccgcccaacccagcccctgcgcgcagcccgggccgagtaggaccccgcgcgcccctcgctatggcggcgccctcgcggctcctgatccgcgggggtcgcgtggtcaacgatgacttctcggaggtggccgacgtgctggtggaggacggcgtggtgcgggcactcgggcacgacctgctgcctcccgggggcgctcctgcggggctgcgggtcctcgacgccgccggcaagctcgtcctgcccggaggcatcgacacacacacgcacatgcagttccccttcatgggctcgcggtccatcgacgacttccaccagggcaccaaggctgctctctcaggaggcaccaccatgattattgatttcgccattcctcagaaaggtggctccctcattgaggccttcgagacctggcgaagctgggctgatcccaaagtttgctgcgactacagccttcatgtggcagtgacgtggtggagtgaccaggttaaagaagaaatgaaaatccttgtgcaagataaaggtgttaactctttcaagatgtttatggcctataaagatctgtacatggtgacagacctggagctgtacgaagccttctctcggtgcaaggaaattggagcaattgcccaggtccatgcggaaaatggagacttaattgcagagggagcaaagaagatgttggctctggggataacaggccctgagggccacgagctgtgccgcccagaggcagtggaggcagaggccacgctgagagccatcaccatagccagcgctgtgaactgtcctctctacattgtgcatgtgatgagcaagtctgcagctaaggtgatagcggatgcaaggagagatgggaaggtggtctatggtgaacccatagcagccagtcttggcacagatggcactcactactggaataaagaatggcaccatgcagcccaccatgtcatgggtccacctttgcgaccagacccctcaacacccgacttcctcatgaatctgttggctaatgatgatctaaccacaacagggactgataactgcactttcaacacctgccagaaagctcttgggaaggatgattttaccaagatccccaatggggtgaatggtgttgaagatcggatgtccgtaatatgggaaaaaggcgtgcatagtggtaaaatggatgaaaacagatttgtggcagttaccagcacaaatgcagccaaaatttttaatctctatccaagaaaaggaagaatagctgtaggatcagatgctgacattgttatttgggacccaaaaggcacaaggactatctcagcaaaaactcatcatcaggctgttaacttcaacattttcgagggcatggtttgccacggggtgccccttgtgactatttcaagaggcaaagtggtatatgaagccggagtgttcagtgtcacggcaggagatgggaagtttattcctcgaaaaccatttgctgaatatatttacaaacgaataaagcagcgagaccggacttgcacacctacccctgtggagcgtgcaccctataagggagaagtcgccacactgaaatccagagtgacaaaagaagatgccacagcagggaccaggaaacaggcccacccctgaagtgtgtgccatcggtaaaaaaatcagaggaaaggaggctgccattcccttcacagccaaacattgtcaacccatggagaagcaggccttattcaactccctaggatcctttagaaaaaattcaccactataggcttctttgattttctttcagaagcaattgctgtctttctcactgtgtttttgttgctgcataagattgaaggtataaatttatattattgtgatggaaaggctgtgtggaaattcattgatgatactttaaaatgtcatctttgcttgtactagatttcttacttagaatttttaaaaatcattttcttgtttaaatagtttctttttttaaaaaaatggttacattagttttaaaatagctctgtgattttactttttattgtaattaataaacattgagatcttcattttatacctta

SEQ ID NO: 8335 - DNA, 4603 bp, Homo sapiens
aatcgctgctcgtctctctcgaagcggatggcttttgcctgagaggaaagggagtggctggcggcgcatgcgccacggtggccgacttgaaccgaggcttttattgctgtagtttatttccacccccttccctcctgtttctctctctccttctctctctctctctctctctctcttttttttccgccctagctggggctgtgttggaggagaggaagaaagagagacagaggattgcattcatccgttacgttcttgaaatttcctaatagcaagaccagcgaagcggttgcacccttttcaatcttgcaaaggaaaaaaacaaaacaaaacaaaaaaaacccaagtccccttcccggcagtttttgccttaaagctgccctcttgaaattaattttttcccaggagagagatgtcttatcaggggaagaaaaatattccacgcatcacgagcgatcgtcttctgatcaaaggaggtaaaattgttaatgatgaccagtcgttctatgcagacatatacatggaagatgggttgatcaagcaaataggagaaaatctgattgtgccaggaggagtgaagaccatcgaggcccactcccggatggtgatccccggaggaattgacgtccacactcgtttccagatgcctgatcagggaatgacgtctgctgatgatttcttccaaggaaccaaggcggccctggctgggggaaccactatgatcattgaccacgttgttcctgagcctgggacaagcctgctcgctgcctttgaccagtggagggaatgggccgacagcaagtcctgctgtgactactctctgcatgtggacatcagtgagtggcataagggcatccaggaggagatggaagcgcttgtgaaggatcacggggtaaattccttcctcgtgtacatggctttcaaagatcgcttccagctaacggattgccagatttatgaagtactgagtgtgatccgggatattggcgccatagcccaagtccacgcagaaaatggcgacatcattgcagaggagcagcagaggatcctggatctgggcatcacgggccccgagggacatgtgctgagccgacctgaggaggtcgaggccgaagccgtgaatcgtgccatcaccatcgccaaccagaccaactgcccgctgtatatcaccaaggtgatgagcaaaagctctgctgaggtcatcgcccaggcacggaagaagggaactgtggtgtatggcgagcccatcactgccagcttgggaacggacggctcccattactggagcaagaactgggccaaggctgctgcctttgtcacctccccacccttgagccctgatccaaccactccagactttctcaactccttgctgtcctgtggagacctccaggtcacgggcagtgcccattgcacgtttaacactgcccagaaggctgtaggaaaggacaacttcaccctgattccggagggcaccaatggcactgaggagcggatgtccgtcatctgggacaaggctgtggtcactgggaagatggatgagaaccagtttgtggctgtgaccagcaccaatgcagccaaagtcttcaacctttacccccggaaaggccgcattgctgtgggatccgatgccgacctggtcatctgggaccccgacagcgttaaaaccatctctgccaagacacacaacagctctctcgagtacaacatctttgaaggcatggagtgccgcggctccccactggtggtcatcagccaggggaagattgtcctggaggacggcaccctgcatgtcaccgaaggctctggacgctacattccccggaagcccttccctgattttgtttacaagcgtatcaaggcaaggagcaggctggctgagctgagaggggttcctcgtggcctgtatgacggacctgtgtgtgaagtgtctgtgacgcccaagacagtcactccagcctcctcggccaagacgtctcctgccaagcagcaggccccacctgtccggaacctgcaccagtctggattcagtttgtctggtgctcagattgatgacaacattccccgccgcaccacccagcgtatcgtggcgccccccggtggccgtgccaacatcaccagcctgggctagagctcctgggctgtgccgtccactggggactggggatgggacacctgaggacattctgagacttctttcttccttcctttttttttttttgtttttttttttaagagcctgtgatagttactgtggagcagccagttcatggggtcccccttggggccccacaccccgtctctcaccaagagttactgattttgctcatccacttccctacacatctatgggtatcacacccaagactacccaccaagctcatacagggaaccacacccaacacttagacatgcgaacaagcagcccccagcgagggtctccttcgccttcaacctcctagtgtctgttagcatcttccttttcatggggggagggaagataaagtgaattgcccagagctgcctttttcttttctttttaaaaattttaagaagttttctttgtggggctggggaggggccggggtcagggagagtcttttttttttttttttttaaatactaaattggaacatttaattccatattaatacaaggggtttgaactggacatcctaatgatgcaattacgtcatcacccagctgattccgggtggttggcaaactcatcgtgtctgtcctgagaggctccacaatgcccacccgcatcgccattctgtagtcttcagggtcagctgttgataaaggggcaggcttgcgttattggcctagattttgctgcagattaaatcctttgaggattctcttctcttttaccatttttctgcgtgctctcactctctctttctctctctagctttttaattcatgaatattttcgtgtctgtctctctctctctctgtgtttcctccagcccttgtctcggagacggtgttttcctcccttgccccattatcttttcacctcccaggtctaccatttcatggtggtcgttgggtccgcctaaaggatttgagcgtttgccattgcaagcatagtgctgtgtcatcctggtccatgtaggactggtgctaaccacctgccatcatgaggatgtgtgctagagtgtgggaccctggccaagtgcaggaatgggccatgccgtctcacccacagtatcacacgtggaaccgcagacagggcccagaagctttagaggtatgaggctgcagaaccggagagattttcctctgtgcagtgctctctggctaaagtcacggtcaaacctaaacaccgagcctcattaacccaagtgaaccaaccaaagtcaccagttcagaagtgctaagctaataggagtctgacccgagggcctgctgcttcctggttaagtatcttttgagattctagaacacatgggagctttttattttcggggaaaaaccgtatttttttcttgtccaattatttctaaagacacactacatagaaagaggccctataaactcaaaaagtcattgggaaacttaaagtctattctactttgcaagaggagaaatgtgttttatgaacgatagatcacatcagaactcctgtggggaggaaaccttataaattaaacacatggcccccttagagaccacaggtgatgtctgtctccatccttccctctccttttctgtcacctttccccctagctggctcctttggacctacccctgtccttgctgacttgtgttgcattgtattccaaacgtgtttacaggttctcttaagcaatgttgtatttgcaggcttttctgaataccaaatctgctttttgtaaagcgtaaaaacatcacaaagtaggtcattccatcaccacccttgtctctctacacattttgcctttggggatctggttggggttttgggttttttgttgttgttgtttatttgttattttaaaggtaaattgcacttttaaaaaaataattggttgacttaatatatttgctttttttctcacctgcacttagaggaaatttgaacaagttggaaaaaaacaatttttgtttcaattctaagaaacacttgcagctctagtattcacttgagtcttcctgtttttcctgtaccgggtcatggtaatttttggttgttttggttgttttcttaaaaaacaagttaaaacctgacgatttctgcaggctgtgtaagcatgtttacctgttggcttgctttgtgtgtctgttaaatgaatgtcatatgtaaatgctaaaataaatcgacagtgtctcagaactgaataactgcagtgacttgatgctctaaaacagtgtaggatttaagaatagatggtttttaatcctggaaattgtgattgtgacccatgagtggaggaactttcagttctaaagctgataaagtgtgtagccagaagagtacttttttttttgtaaccactgtcttgatggcaaaataattatggtaaaaaacaagtctcgtgtttattattccttaagaactctgtgttatattaccatggaacgcctaataaagcaaaatgtggttgtttcaggg

SEQ ID NO: 8336 - DNA, 4552 bp, Homo sapiens
actggcagacggacggacggacggcgaggaccctacccgagcccccgagccatggccgagagaaagcaatccgggaaggcggcagaggacgaagaggtccctgctttttttaaaaacctgggctccggcagccccaagccccggcagaaattctgtggcatgttctgcccggtggaagggtcctcggagaacaagaccatcgacttcgactcgctgtcggtgggccggggctcggggcaggtggtggctcagcagcgggacgtcgcccacttgggcccggacccgcagccgccgtactcgcggcagggccggcgcgccggcggagagccatctgttgaatcgggccggaaggtggagatccggagggcctcgggcaaagaagccctgcagaacatcaacgaccagagcgatcgtcttctgatcaaaggaggtaaaattgttaatgatgaccagtcgttctatgcagacatatacatggaagatgggttgatcaagcaaataggagaaaatctgattgtgccaggaggagtgaagaccatcgaggcccactcccggatggtgatccccggaggaattgacgtccacactcgtttccagatgcctgatcagggaatgacgtctgctgatgatttcttccaaggaaccaaggcggccctggctgggggaaccactatgatcattgaccacgttgttcctgagcctgggacaagcctgctcgctgcctttgaccagtggagggaatgggccgacagcaagtcctgctgtgactactctctgcatgtggacatcagtgagtggcataagggcatccaggaggagatggaagcgcttgtgaaggatcacggggtaaattccttcctcgtgtacatggctttcaaagatcgcttccagctaacggattgccagatttatgaagtactgagtgtgatccgggatattggcgccatagcccaagtccacgcagaaaatggcgacatcattgcagaggagcagcagaggatcctggatctgggcatcacgggccccgagggacatgtgctgagccgacctgaggaggtcgaggccgaagccgtgaatcgtgccatcaccatcgccaaccagaccaactgcccgctgtatatcaccaaggtgatgagcaaaagctctgctgaggtcatcgcccaggcacggaagaagggaactgtggtgtatggcgagcccatcactgccagcttgggaacggacggctcccattactggagcaagaactgggccaaggctgctgcctttgtcacctccccacccttgagccctgatccaaccactccagactttctcaactccttgctgtcctgtggagacctccaggtcacgggcagtgcccattgcacgtttaacactgcccagaaggctgtaggaaaggacaacttcaccctgattccggagggcaccaatggcactgaggagcggatgtccgtcatctgggacaaggctgtggtcactgggaagatggatgagaaccagtttgtggctgtgaccagcaccaatgcagccaaagtcttcaacctttacccccggaaaggccgcattgctgtgggatccgatgccgacctggtcatctgggaccccgacagcgttaaaaccatctctgccaagacacacaacagctctctcgagtacaacatctttgaaggcatggagtgccgcggctccccactggtggtcatcagccaggggaagattgtcctggaggacggcaccctgcatgtcaccgaaggctctggacgctacattccccggaagcccttccctgattttgtttacaagcgtatcaaggcaaggagcaggctggctgagctgagaggggttcctcgtggcctgtatgacggacctgtgtgtgaagtgtctgtgacgcccaagacagtcactccagcctcctcggccaagacgtctcctgccaagcagcaggccccacctgtccggaacctgcaccagtctggattcagtttgtctggtgctcagattgatgacaacattccccgccgcaccacccagcgtatcgtggcgccccccggtggccgtgccaacatcaccagcctgggctagagctcctgggctgtgccgtccactggggactggggatgggacacctgaggacattctgagacttctttcttccttcctttttttttttttgtttttttttttaagagcctgtgatagttactgtggagcagccagttcatggggtcccccttggggccccacaccccgtctctcaccaagagttactgattttgctcatccacttccctacacatctatgggtatcacacccaagactacccaccaagctcatacagggaaccacacccaacacttagacatgcgaacaagcagcccccagcgagggtctccttcgccttcaacctcctagtgtctgttagcatcttccttttcatggggggagggaagataaagtgaattgcccagagctgcctttttcttttctttttaaaaattttaagaagttttctttgtggggctggggaggggccggggtcagggagagtcttttttttttttttttttaaatactaaattggaacatttaattccatattaatacaaggggtttgaactggacatcctaatgatgcaattacgtcatcacccagctgattccgggtggttggcaaactcatcgtgtctgtcctgagaggctccacaatgcccacccgcatcgccattctgtagtcttcagggtcagctgttgataaaggggcaggcttgcgttattggcctagattttgctgcagattaaatcctttgaggattctcttctcttttaccatttttctgcgtgctctcactctctctttctctctctagctttttaattcatgaatattttcgtgtctgtctctctctctctctgtgtttcctccagcccttgtctcggagacggtgttttcctcccttgccccattatcttttcacctcccaggtctaccatttcatggtggtcgttgggtccgcctaaaggatttgagcgtttgccattgcaagcatagtgctgtgtcatcctggtccatgtaggactggtgctaaccacctgccatcatgaggatgtgtgctagagtgtgggaccctggccaagtgcaggaatgggccatgccgtctcacccacagtatcacacgtggaaccgcagacagggcccagaagctttagaggtatgaggctgcagaaccggagagattttcctctgtgcagtgctctctggctaaagtcacggtcaaacctaaacaccgagcctcattaacccaagtgaaccaaccaaagtcaccagttcagaagtgctaagctaataggagtctgacccgagggcctgctgcttcctggttaagtatcttttgagattctagaacacatgggagctttttattttcggggaaaaaccgtatttttttcttgtccaattatttctaaagacacactacatagaaagaggccctataaactcaaaaagtcattgggaaacttaaagtctattctactttgcaagaggagaaatgtgttttatgaacgatagatcacatcagaactcctgtggggaggaaaccttataaattaaacacatggcccccttagagaccacaggtgatgtctgtctccatccttccctctccttttctgtcacctttccccctagctggctcctttggacctacccctgtccttgctgacttgtgttgcattgtattccaaacgtgtttacaggttctcttaagcaatgttgtatttgcaggcttttctgaataccaaatctgctttttgtaaagcgtaaaaacatcacaaagtaggtcattccatcaccacccttgtctctctacacattttgcctttggggatctggttggggttttgggttttttgttgttgttgtttatttgttattttaaaggtaaattgcacttttaaaaaaataattggttgacttaatatatttgctttttttctcacctgcacttagaggaaatttgaacaagttggaaaaaaacaatttttgtttcaattctaagaaacacttgcagctctagtattcacttgagtcttcctgtttttcctgtaccgggtcatggtaatttttggttgttttggttgttttcttaaaaaacaagttaaaacctgacgatttctgcaggctgtgtaagcatgtttacctgttggcttgctttgtgtgtctgttaaatgaatgtcatatgtaaatgctaaaataaatcgacagtgtctcagaactgaataactgcagtgacttgatgctctaaaacagtgtaggatttaagaatagatggtttttaatcctggaaattgtgattgtgacccatgagtggaggaactttcagttctaaagctgataaagtgtgtagccagaagagtacttttttttttgtaaccactgtcttgatggcaaaataattatggtaaaaaacaagtctcgtgtttattattccttaagaactctgtgttatattaccatggaacgcctaataaagcaaaatgtggttgttt

SEQ ID NO: 8337 - DNA, 4395 bp, Homo sapiens
cttttattgctgtagtttatttccacccccttccctcctgtttctctctctccttctctctctctctctctctctctcttttttttccgccctagctggggctgtgttggaggagaggaagaaagagagacagaggattgcattcatccgttacgttcttgaaatttcctaatagcaagaccagcgaagcggttgcacccttttcaatcttgcaaaggaaaaaaacaaaacaaaacaaaaaaaacccaagtccccttcccggcagtttttgccttaaagctgccctcttgaaattaattttttcccaggagagagatgtcttatcaggggaagaaaaatattccacgcatcacgagcgatcgtcttctgatcaaaggaggtaaaattgttaatgatgaccagtcgttctatgcagacatatacatggaagatgggttgatcaagcaaataggagaaaatctgattgtgccaggaggagtgaagaccatcgaggcccactcccggatggtgatccccggaggaattgacgtccacactcgtttccagatgcctgatcagggaatgacgtctgctgatgatttcttccaaggaaccaaggcggccctggctgggggaaccactatgatcattgaccacgttgttcctgagcctgggacaagcctgctcgctgcctttgaccagtggagggaatgggccgacagcaagtcctgctgtgactactctctgcatgtggacatcagtgagtggcataagggcatccaggaggagatggaagcgcttgtgaaggatcacggggtaaattccttcctcgtgtacatggctttcaaagatcgcttccagctaacggattgccagatttatgaagtactgagtgtgatccgggatattggcgccatagcccaagtccacgcagaaaatggcgacatcattgcagaggagcagcagaggatcctggatctgggcatcacgggccccgagggacatgtgctgagccgacctgaggaggtcgaggccgaagccgtgaatcgtgccatcaccatcgccaaccagaccaactgcccgctgtatatcaccaaggtgatgagcaaaagctctgctgaggtcatcgcccaggcacggaagaagggaactgtggtgtatggcgagcccatcactgccagcttgggaacggacggctcccattactggagcaagaactgggccaaggctgctgcctttgtcacctccccacccttgagccctgatccaaccactccagactttctcaactccttgctgtcctgtggagacctccaggtcacgggcagtgcccattgcacgtttaacactgcccagaaggctgtaggaaaggacaacttcaccctgattccggagggcaccaatggcactgaggagcggatgtccgtcatctgggacaaggctgtggtcactgggaagatggatgagaaccagtttgtggctgtgaccagcaccaatgcagccaaagtcttcaacctttacccccggaaaggccgcattgctgtgggatccgatgccgacctggtcatctgggaccccgacagcgttaaaaccatctctgccaagacacacaacagctctctcgagtacaacatctttgaaggcatggagtgccgcggctccccactggtggtcatcagccaggggaagattgtcctggaggacggcaccctgcatgtcaccgaaggctctggacgctacattccccggaagcccttccctgattttgtttacaagcgtatcaaggcaaggagcaggctggctgagctgagaggggttcctcgtggcctgtatgacggacctgtgtgtgaagtgtctgtgacgcccaagacagtcactccagcctcctcggccaagacgtctcctgccaagcagcaggccccacctgtccggaacctgcaccagtctggattcagtttgtctggtgctcagattgatgacaacattccccgccgcaccacccagcgtatcgtggcgccccccggtggccgtgccaacatcaccagcctgggctagagctcctgggctgtgccgtccactggggactggggatgggacacctgaggacattctgagacttctttcttccttcctttttttttttttgtttttttttttaagagcctgtgatagttactgtggagcagccagttcatggggtcccccttggggccccacaccccgtctctcaccaagagttactgattttgctcatccacttccctacacatctatgggtatcacacccaagactacccaccaagctcatacagggaaccacacccaacacttagacatgcgaacaagcagcccccagcgagggtctccttcgccttcaacctcctagtgtctgttagcatcttccttttcatggggggagggaagataaagtgaattgcccagagctgcctttttcttttctttttaaaaattttaagaagttttctttgtggggctggggaggggccggggtcagggagagtcttttttttttttttttttaaatactaaattggaacatttaattccatattaatacaaggggtttgaactggacatcctaatgatgcaattacgtcatcacccagctgattccgggtggttggcaaactcatcgtgtctgtcctgagaggctccacaatgcccacccgcatcgccattctgtagtcttcagggtcagctgttgataaaggggcaggcttgcgttattggcctagattttgctgcagattaaatcctttgaggattctcttctcttttaccatttttctgcgtgctctcactctctctttctctctctagctttttaattcatgaatattttcgtgtctgtctctctctctctctgtgtttcctccagcccttgtctcggagacggtgttttcctcccttgccccattatcttttcacctcccaggtctaccatttcatggtggtcgttgggtccgcctaaaggatttgagcgtttgccattgcaagcatagtgctgtgtcatcctggtccatgtaggactggtgctaaccacctgccatcatgaggatgtgtgctagagtgtgggaccctggccaagtgcaggaatgggccatgccgtctcacccacagtatcacacgtggaaccgcagacagggcccagaagctttagaggtatgaggctgcagaaccggagagattttcctctgtgcagtgctctctggctaaagtcacggtcaaacctaaacaccgagcctcattaacccaagtgaaccaaccaaagtcaccagttcagaagtgctaagctaataggagtctgacccgagggcctgctgcttcctggttaagtatcttttgagattctagaacacatgggagctttttattttcggggaaaaaccgtatttttttcttgtccaattatttctaaagacacactacatagaaagaggccctataaactcaaaaagtcattgggaaacttaaagtctattctactttgcaagaggagaaatgtgttttatgaacgatagatcacatcagaactcctgtggggaggaaaccttataaattaaacacatggcccccttagagaccacaggtgatgtctgtctccatccttccctctccttttctgtcacctttccccctagctggctcctttggacctacccctgtccttgctgacttgtgttgcattgtattccaaacgtgtttacaggttctcttaagcaatgttgtatttgcaggcttttctgaataccaaatctgctttttgtaaagcgtaaaaacatcacaaagtaggtcattccatcaccacccttgtctctctacacattttgcctttggggatctggttggggttttgggttttttgttgttgttgtttatttgttattttaaaggtaaattgcacttttaaaaaaataattggttgacttaatatatttgctttttttctcacctgcacttagaggaaatttgaacaagttggaaaaaaacaatttttgtttcaattctaagaaacacttgcagctctagtattcacttgagtcttcctgtttttcctgtaccgggtcatggtaatttttggttgttttggttgttttcttaaaaaacaagttaaaacctgacgatttctgcagtgacttgatgctctaaaacagtgtaggatttaagaatagatggtttttaatcctggaaattgtgattgtgacccatgagtggaggaactttcagttctaaagctgataaagtgtgtagccagaagagtacttttttttttgtaaccactgtcttgatggcaaaataattatggtaaaaaacaagtctcgtgtttattattccttaagaactctgtgttatattaccatggaacgcctaataaagcaaaatgtggttgtttca

SEQ ID NO: 8338 - DNA, 2130 bp, Homo sapiens
cctttctgttgctaacggaggcgatggtgatggtggtggtggttgtgggagatgcagtgatccaggattagaagtcgcatcgtttgcaaggcattaaacaggagcgcgagtgcacgaaggtagccttagagcgatcgtcttctgatcaaaggaggtaaaattgttaatgatgaccagtcgttctatgcagacatatacatggaagatgggttgatcaagcaaataggagaaaatctgattgtgccaggaggagtgaagaccatcgaggcccactcccggatggtgatccccggaggaattgacgtccacactcgtttccagatgcctgatcagggaatgacgtctgctgatgatttcttccaaggaaccaaggcggccctggctgggggaaccactatgatcattgaccacgttgttcctgagcctgggacaagcctgctcgctgcctttgaccagtggagggaatgggccgacagcaagtcctgctgtgactactctctgcatgtggacatcagtgagtggcataagggcatccaggaggagatggaagcgcttgtgaaggatcacggggtaaattccttcctcgtgtacatggctttcaaagatcgcttccagctaacggattgccagatttatgaagtactgagtgtgatccgggatattggcgccatagcccaagtccacgcagaaaatggcgacatcattgcagaggagcagcagaggatcctggatctgggcatcacgggccccgagggacatgtgctgagccgacctgaggaggtcgaggccgaagccgtgaatcgtgccatcaccatcgccaaccagaccaactgcccgctgtatatcaccaaggtgatgagcaaaagctctgctgaggtcatcgcccaggcacggaagaagggaactgtggtgtatggcgagcccatcactgccagcttgggaacggacggctcccattactggagcaagaactgggccaaggctgctgcctttgtcacctccccacccttgagccctgatccaaccactccagactttctcaactccttgctgtcctgtggagacctccaggtcacgggcagtgcccattgcacgtttaacactgcccagaaggctgtaggaaaggacaacttcaccctgattccggagggcaccaatggcactgaggagcggatgtccgtcatctgggacaaggctgtggtcactgggaagatggatgagaaccagtttgtggctgtgaccagcaccaatgcagccaaagtcttcaacctttacccccggaaaggccgcattgctgtgggatccgatgccgacctggtcatctgggaccccgacagcgttaaaaccatctctgccaagacacacaacagctctctcgagtacaacatctttgaaggcatggagtgccgcggctccccactggtggtcatcagccaggggaagattgtcctggaggacggcaccctgcatgtcaccgaaggctctggacgctacattccccggaagcccttccctgattttgtttacaagcgtatcaaggcaaggagcaggctggctgagctgagaggggttcctcgtggcctgtatgacggacctgtgtgtgaagtgtctgtgacgcccaagacagtcactccagcctcctcggccaagacgtctcctgccaagcagcaggccccacctgtccggaacctgcaccagtctggattcagtttgtctggtgctcagattgatgacaacattccccgccgcaccacccagcgtatcgtggcgccccccggtggccgtgccaacatcaccagcctgggctagagctcctgggctgtgccgtccactggggactggggatgggacacctgaggacattctgagacttctttcttccttcctttttttttttttgtttttttttttaagagcctgtgatagttactgtggagcagccagttcatggggtcccccttggggccccacaccccgtctctcaccaagagttactgattttgctcatccacttccctacacatctatgggtatcacacccaagactacccaccaagctcatacagggaaccacacccaacacttagacatgcgaacaagcagcccccagcgagggtctccttcgccttc

SEQ ID NO: 8339 - DNA, 3091 bp, Homo sapiens
ctttcggctcccgcagccgcagcggacgccctcccagatccaactttgccgcttccccgagctcgcgctgtagccgcggggggcgtgggcagggaggggagaagcggggtcagggggagggaccgggagggtgggtcgccggctcgccagccctccttcctttctgtgcaccttgcggtgggcggcgaacggcagccgcggcagcagctagggggcttgtgcacgtttaacactgcccagaaggctgtaggaaaggacaacttcaccctgattccggagggcaccaatggcactgaggagcggatgtccgtcatctgggacaaggctgtggtcactgggaagatggatgagaaccagtttgtggctgtgaccagcaccaatgcagccaaagtcttcaacctttacccccggaaaggccgcattgctgtgggatccgatgccgacctggtcatctgggaccccgacagcgttaaaaccatctttgaaggcatggagtgccgcggctccccactggtggtcatcagccaggggaagattgtcctggaggacggcaccctgcatgtcaccgaaggctctggacgctacattccccggaagcccttccctgattttgtttacaagcgtatcaaggcaaggagcaggctggctgagctgagaggggttcctcgtggcctgtatgacggacctgtgtgtgaagtgtctgtgacgcccaagacagtcactccagcctcctcggccaagacgtctcctgccaagcagcaggccccacctgtccggaacctgcaccagtctggattcagtttgtctggtgctcagattgatgacaacattccccgccgcaccacccagcgtatcgtggcgccccccggtggccgtgccaacatcaccagcctgggctagagctcctgggctgtgccgtccactggggactggggatgggacacctgaggacattctgagacttctttcttccttcctttttttttttttgtttttttttttaagagcctgtgatagttactgtggagcagccagttcatggggtcccccttggggccccacaccccgtctctcaccaagagttactgattttgctcatccacttccctacacatctatgggtatcacacccaagactacccaccaagctcatacagggaaccacacccaacacttagacatgcgaacaagcagcccccagcgagggtctccttcgccttcaacctcctagtgtctgttagcatcttccttttcatggggggagggaagataaagtgaattgcccagagctgcctttttcttttctttttaaaaattttaagaagttttctttgtggggctggggaggggccggggtcagggagagtcttttttttttttttttttaaatactaaattggaacatttaattccatattaatacaaggggtttgaactggacatcctaatgatgcaattacgtcatcacccagctgattccgggtggttggcaaactcatcgtgtctgtcctgagaggctccacaatgcccacccgcatcgccattctgtagtcttcagggtcagctgttgataaaggggcaggcttgcgttattggcctagattttgctgcagattaaatcctttgaggattctcttctcttttaccatttttctgcgtgctctcactctctctttctctctctagctttttaattcatgaatattttcgtgtctgtctctctctctctctgtgtttcctccagcccttgtctcggagacggtgttttcctcccttgccccattatcttttcacctcccaggtctaccatttcatggtggtcgttgggtccgcctaaaggatttgagcgtttgccattgcaagcatagtgctgtgtcatcctggtccatgtaggactggtgctaaccacctgccatcatgaggatgtgtgctagagtgtgggaccctggccaagtgcaggaatgggccatgccgtctcacccacagtatcacacgtggaaccgcagacagggcccagaagctttagaggtatgaggctgcagaaccggagagattttcctctgtgcagtgctctctggctaaagtcacggtcaaacctaaacaccgagcctcattaacccaagtgaaccaaccaaagtcaccagttcagaagtgctaagctaataggagtctgacccgagggcctgctgcttcctggttaagtatcttttgagattctagaacacatgggagctttttattttcggggaaaaaccgtatttttttcttgtccaattatttctaaagacacactacatagaaagaggccctataaactcaaaaagtcattgggaaacttaaagtctattctactttgcaagaggagaaatgtgttttatgaacgatagatcacatcagaactcctgtggggaggaaaccttataaattaaacacatggcccccttagagaccacaggtgatgtctgtctccatccttccctctccttttctgtcacctttccccctagctggctcctttggacctacccctgtccttgctgacttgtgttgcattgtattccaaacgtgtttacaggttctcttaagcaatgttgtatttgcaggcttttctgaataccaaatctgctttttgtaaagcgtaaaaacatcacaaagtaggtcattccatcaccacccttgtctctctacacattttgcctttggggatctggttggggttttgggttttttgttgttgttgtttatttgttattttaaaggtaaattgcacttttaaaaaaataattggttgacttaatatatttgctttttttctcacctgcacttagaggaaatttgaacaagttggaaaaaaacaatttttgtttcaattctaagaaacacttgcagctctagtattcacttgagtcttcctgtttttcctgtaccgggtcatggtaatttttggttgttttggttgttttcttaaaaaacaagttaaaacctgacgatttctgcaggctgtgtaagcatgtttacctgttggcttgctttgtgtgtctgttaaatgaatgtcatatgtaaatgctaaaataaatcgacagtgtctcag

SEQ ID NO: 8340 - DNA, 5476 bp, Homo sapiens
tgctccgcgcgctagctggctgtgtggctcgctggctcgctagggacaagcaggaatcggagcagcactgccgcctctggcgcgaaggctcaggcgcctcctcccgccacagtcactgtggctcggcgcacgctgccggcggctgccctttccgcctctggggaagaaaaacccgcgggccgctttcgtgcttgaaccatggcctcgggccggaggggctgggacagctcccacgaagacgatctgcccgtgtacctggccaggccgggcaccacggaccaggtcccgcggcagaaatacggcggcatgttctgcaacgtggagggcgccttcgagagcaagacgctggatttcgatgccctcagcgtggggcagcggggcgcgaagactcctcggagcggccagggcagcgaccgaggatcggggagtcggcccgggatcgagggggacaccccgcgcaggggccaaggccgggaagagagcagggagcccgcgcccgcctcccccgcccccgccggggtagagatccggagcgccaccggcaaagaggtgttgcagaacctcggccccaaggacaagagtgaccgtctccttatcaagggaggcagaatcgtcaatgatgatcagtccttttatgctgatatttacatggaagatggcttaataaaacaaattggagacaatctgattgttcctggaggagtgaagaccattgaagccaatgggaagatggtgatccctggaggcatcgatgtccatactcacttccagatgccatataagggaatgaccacagtagatgacttcttccaagggacaaaggcggccttagcaggtggcaccaccatgatcattgaccatgtggtgcctgagcctgagtccagcctgactgaggcctatgagaaatggagagagtgggctgatgggaagagttgctgtgactatgccctgcatgtggacatcacccactggaatgacagcgtcaagcaggaagtgcagaacctcatcaaggacaaaggggttaactccttcatggtttatatggcttataaggatttgtatcaagtatctaacacagagctctatgagatcttcacctgcctgggagagctgggggccattgctcaagttcatgctgagaatggggatatcattgcccaggagcaaacccgcatgttggaaatggggataactggcccagaaggccatgtactgagcaggccagaagagctggaagctgaggctgtgttccgtgccatcaccattgccagccaaaccaattgccctctctacgtcacaaaggtcatgagcaagagtgcagctgacctcatctcacaagccaggaaaaaaggaaatgtagtctttggtgagcccatcactgccagcctcggcatagatggaacccattattggagcaagaactgggccaaggcggctgcatttgtgacatccccacccctgagccctgacccaactactccggactacatcaactccttgctggccagcggggatctgcagctatctgggagtgcccactgcaccttcagcactgcccagaaagcaattgggaaggacaacttcacagccattcctgagggcaccaatggtgtggaggagcggatgtctgtcatctgggacaaggctgtggccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctgcggcagagtacaacatctttgaagggatggagctgcgcggggctcctctggttgtcatctgccagggcaagatcatgctggaagatggcaacctgcacgtgacccagggggctggccgcttcataccctgcagcccgttctccgactatgtctacaagcgcattaaagcacggaggaagatggcagacctgcatgccgtcccaaggggcatgtacgatgggcctgtgtttgacctgaccaccacccccaaaggtggcacccccgcaggctctgctcggggctctcctactcggccgaacccacctgtgaggaatcttcatcagtcgggatttagcctgtcaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttgtttgactcccctccccccatttacatgcatgcaatcagacaggccactaaggtaaaagagtctgctctatcatagtgttgagagcgtgtgtagtgctgcatcttatgacaaggggacagacaagctgggacgtcagggaaatgaacaaaagggacgcaggttatttggggtgagtgggtggtgggagcctggagcaaggtggagggtgcagaggggctggggtagggcatgtaggagggaggtgggtgggtcaggtgagtggaaggggtgttgtatattgtgttgatgacgtacgttatttccatggaagatagccgctgtggcagctgtcacatcaccacagctccctagggtctgccgagaaggcaggcagtctttgggttctgttctttgtcacgtcccctacaagtaaattttgtttctttgaacgtttattaaaatgccaagacccaaccatttcttccacctgcttgattgtgccagtgtttgctcaggcctctttcttagtgttgctttcaaatccttctctttcctgggttgggaaggccaggcagggacagagcaaatgacacttctcttcctcttgccctccctgcctctttggtgctcttaaaagccagcagctgagaacatagcacaggcccacgtggtgagggcacccacagcttaaagacgcttccttctaaacacggcgaggtcacctctcactcttctgtctttgcaaaccgagaagagtggcatgcttctggcatcccaagtcaggattttagctcagatgaggcagaatgaagggcctctcttacaggcagtttgtgtttgattctctcgatcctggcacatccatgataaataggagtttttgaaagttggttttattaggtgttccctaatttttaccgtaataggtcatctcagcttatatgaaagtcaagtggggaactgggaaagccaaagtcagtcttgagcagagggagcacattttgtggacctggttccacctttccattccaaaccacctgtttccccttccattagcagaaactctgggggaactttgtgtctcagtcctagaatctccccaagtgagtggaagtgacatgatgcagtcttcctcatggggcacctgaaagaaattagtgtgggtgcttcgatctaccttgtctgtcagagttgaatatctctttccctatcatgctgcttctgaaaattcagttttggagcaagtcctgtgagcaagataagaatctatagaaccaagatgctcattttcagaagaaatatgttcaacctgggatcagacttccatgctctggggaatccaagtggtagcacctgtaaccctgtgtactaagtgctttgaagagaagagcaggcctcagacaccttttaattgcttaggagaaaccattgtctctgactgcaggtttgaataagttgaagaccagagaaaagtacacactgggctacaaaggaatttggagatagccaaggaacaggatttcccctagcaagctaccttctgttcaaatcatgaaaaaagactatttccccttagaatagggaagcttgctattttaaagctcttgtagtgcttttcttttaagggagatgtagtaaaagggaaaatgtagctcttagtttacacttcaaagatgtgggggtctttcagagaactaagaataacagttttatgtgcagagagagtttgccagatctgaagcatatacctcattgactaggctgttactttgggataggttgcagtaccagccacagccagcagatagaggaaaagacacacataaactcgcttctgagcgtccacttctgcactctctgctctgctgttactcagcccctgagtctgactcatctctgcacaacctctctgtgccatgaagataagtcttccatggccaaatcggtcatccgcactgcccttgggacttccgaagtgaaccattccaccagaacctttgattctgcacaagatttccttgctctgggaacaacccccaaatgcccttgggaggaacaacatgagctcaggaagcctctctttcttcacttaccattactaactctccaagcatagaaatccctgggaattgcgagaataactcccactattttaaaatttatattcagatttgtttcgtttcataagacacatcaaacaggcctatacaaaaggtttaggaaaagaaaacaatggtgagtcccggccctcttcgaattcactggcacctcatgcaagtgtaggaaggcacgctggatcgtctatctgattccaaagctgtcctttgccatctcatcccttggcctgccccccaaccctgaggatgcccctgccatccccccaacctcctcatattgcctctgaacccagatggcaatccatcccggttctctctgagggccacgggcttgggtagtggaaagggtgtttgggaaattgttaaatcagttacccgtagtagagctatttcttgtacttctaagttttctagaagtggaaggattgtagtcatcctgaaaatgggtttacttcaaaatccctcagccttgttcttcacgactgtctatactgagagtgtcatgtttccacaaagggctgacacctgagcctggattttcactcatccctgagaagccctttccagtagggtgggcaattcccaacttccttgccacaagcttcccaggctttctcccctggaaaactccagcttgagtcccagatacactcatgggctgccctgggcagccagcattcattgtaagttccctctttgaaaactggtgtgtgggtgttcagttctgtgtctggtgggtatggacagacagtaatctcctgtgatctgtgctagctgtgaggcagctctggaacgtgaagagctgtttggtttgaaccgtgaacaaaactgtgttttgagtttagctgacattaaagaaaaaagttcatcacgtgactgttaatgtaaacctggttattaaaataactatgaaatta

SEQ ID NO: 8341 - DNA, 5309 bp, Homo sapiens
ggcagatgcaaagaggaaaatcaatagggataagagagaagagggaggagtcgcagatcagccattcttgtcttatggggtcccagctggcgcagcaaaagaaaaaaaaaaacaaaacccgggcgtgaacgcgggtggaggagggtgtgcgtgggggggcgggggtgaaagggggaccggggagatttactattgtctctggcagccgccgcgggagcccgggaggggggcggaggcgggcggaggcggcggcgcggccagcgcaccattcactccacctgatctcggggcgctgtgcgctgaggaaggcgcgggcgagccggagcagaagaaggagggagggagccagccgctgcagccaccaccgccaccatgtcctaccaaggcaagaagaacatcccgcggatcacgagtgaccgtctccttatcaagggaggcagaatcgtcaatgatgatcagtccttttatgctgatatttacatggaagatggcttaataaaacaaattggagacaatctgattgttcctggaggagtgaagaccattgaagccaatgggaagatggtgatccctggaggcatcgatgtccatactcacttccagatgccatataagggaatgaccacagtagatgacttcttccaagggacaaaggcggccttagcaggtggcaccaccatgatcattgaccatgtggtgcctgagcctgagtccagcctgactgaggcctatgagaaatggagagagtgggctgatgggaagagttgctgtgactatgccctgcatgtggacatcacccactggaatgacagcgtcaagcaggaagtgcagaacctcatcaaggacaaaggggttaactccttcatggtttatatggcttataaggatttgtatcaagtatctaacacagagctctatgagatcttcacctgcctgggagagctgggggccattgctcaagttcatgctgagaatggggatatcattgcccaggagcaaacccgcatgttggaaatggggataactggcccagaaggccatgtactgagcaggccagaagagctggaagctgaggctgtgttccgtgccatcaccattgccagccaaaccaattgccctctctacgtcacaaaggtcatgagcaagagtgcagctgacctcatctcacaagccaggaaaaaaggaaatgtagtctttggtgagcccatcactgccagcctcggcatagatggaacccattattggagcaagaactgggccaaggcggctgcatttgtgacatccccacccctgagccctgacccaactactccggactacatcaactccttgctggccagcggggatctgcagctatctgggagtgcccactgcaccttcagcactgcccagaaagcaattgggaaggacaacttcacagccattcctgagggcaccaatggtgtggaggagcggatgtctgtcatctgggacaaggctgtggccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctgcggcagagtacaacatctttgaagggatggagctgcgcggggctcctctggttgtcatctgccagggcaagatcatgctggaagatggcaacctgcacgtgacccagggggctggccgcttcataccctgcagcccgttctccgactatgtctacaagcgcattaaagcacggaggaagatggcagacctgcatgccgtcccaaggggcatgtacgatgggcctgtgtttgacctgaccaccacccccaaaggtggcacccccgcaggctctgctcggggctctcctactcggccgaacccacctgtgaggaatcttcatcagtcgggatttagcctgtcaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttgtttgactcccctccccccatttacatgcatgcaatcagacaggccactaaggtaaaagagtctgctctatcatagtgttgagagcgtgtgtagtgctgcatcttatgacaaggggacagacaagctgggacgtcagggaaatgaacaaaagggacgcaggttatttggggtgagtgggtggtgggagcctggagcaaggtggagggtgcagaggggctggggtagggcatgtaggagggaggtgggtgggtcaggtgagtggaaggggtgttgtatattgtgttgatgacgtacgttatttccatggaagatagccgctgtggcagctgtcacatcaccacagctccctagggtctgccgagaaggcaggcagtctttgggttctgttctttgtcacgtcccctacaagtaaattttgtttctttgaacgtttattaaaatgccaagacccaaccatttcttccacctgcttgattgtgccagtgtttgctcaggcctctttcttagtgttgctttcaaatccttctctttcctgggttgggaaggccaggcagggacagagcaaatgacacttctcttcctcttgccctccctgcctctttggtgctcttaaaagccagcagctgagaacatagcacaggcccacgtggtgagggcacccacagcttaaagacgcttccttctaaacacggcgaggtcacctctcactcttctgtctttgcaaaccgagaagagtggcatgcttctggcatcccaagtcaggattttagctcagatgaggcagaatgaagggcctctcttacaggcagtttgtgtttgattctctcgatcctggcacatccatgataaataggagtttttgaaagttggttttattaggtgttccctaatttttaccgtaataggtcatctcagcttatatgaaagtcaagtggggaactgggaaagccaaagtcagtcttgagcagagggagcacattttgtggacctggttccacctttccattccaaaccacctgtttccccttccattagcagaaactctgggggaactttgtgtctcagtcctagaatctccccaagtgagtggaagtgacatgatgcagtcttcctcatggggcacctgaaagaaattagtgtgggtgcttcgatctaccttgtctgtcagagttgaatatctctttccctatcatgctgcttctgaaaattcagttttggagcaagtcctgtgagcaagataagaatctatagaaccaagatgctcattttcagaagaaatatgttcaacctgggatcagacttccatgctctggggaatccaagtggtagcacctgtaaccctgtgtactaagtgctttgaagagaagagcaggcctcagacaccttttaattgcttaggagaaaccattgtctctgactgcaggtttgaataagttgaagaccagagaaaagtacacactgggctacaaaggaatttggagatagccaaggaacaggatttcccctagcaagctaccttctgttcaaatcatgaaaaaagactatttccccttagaatagggaagcttgctattttaaagctcttgtagtgcttttcttttaagggagatgtagtaaaagggaaaatgtagctcttagtttacacttcaaagatgtgggggtctttcagagaactaagaataacagttttatgtgcagagagagtttgccagatctgaagcatatacctcattgactaggctgttactttgggataggttgcagtaccagccacagccagcagatagaggaaaagacacacataaactcgcttctgagcgtccacttctgcactctctgctctgctgttactcagcccctgagtctgactcatctctgcacaacctctctgtgccatgaagataagtcttccatggccaaatcggtcatccgcactgcccttgggacttccgaagtgaaccattccaccagaacctttgattctgcacaagatttccttgctctgggaacaacccccaaatgcccttgggaggaacaacatgagctcaggaagcctctctttcttcacttaccattactaactctccaagcatagaaatccctgggaattgcgagaataactcccactattttaaaatttatattcagatttgtttcgtttcataagacacatcaaacaggcctatacaaaaggtttaggaaaagaaaacaatggtgagtcccggccctcttcgaattcactggcacctcatgcaagtgtaggaaggcacgctggatcgtctatctgattccaaagctgtcctttgccatctcatcccttggcctgccccccaaccctgaggatgcccctgccatccccccaacctcctcatattgcctctgaacccagatggcaatccatcccggttctctctgagggccacgggcttgggtagtggaaagggtgtttgggaaattgttaaatcagttacccgtagtagagctatttcttgtacttctaagttttctagaagtggaaggattgtagtcatcctgaaaatgggtttacttcaaaatccctcagccttgttcttcacgactgtctatactgagagtgtcatgtttccacaaagggctgacacctgagcctggattttcactcatccctgagaagccctttccagtagggtgggcaattcccaacttccttgccacaagcttcccaggctttctcccctggaaaactccagcttgagtcccagatacactcatgggctgccctgggcagccagcattcattgtaagttccctctttgaaaactggtgtgtgggtgttcagttctgtgtctggtgggtatggacagacagtaatctcctgtgatctgtgctagctgtgaggcagctctggaacgtgaagagctgtttggtttgaaccgtgaacaaaactgtgttttgagtttagctgacattaaagaaaaaagttcatcacgtgactgttaatgtaaacctggttattaaaataactatgaaattac

SEQ ID NO: 8342 - DNA, 539 bp, Homo sapiens
gcggccgccgcattcgacccgcgccatggcagaggagagcgggtgccgggagggaagccgggaaccgtctccattctgaaactagggcggggaagccgccgcgggagcccgggaggggggcggaggcgggcggaggcggcggcgcggccagcgcaccattcactccacctgatctcggggcgctgtgcgctgaggaaggcgcgggcgagccggagcagaagaaggagggagggagccagccgctgcagccaccaccgccaccatgtcctaccaaggcaagaagaacatcccgcggatcacgagtgaccgtctccttatcaagggaggcagaatcgtcaatgatgatcagtccttttatgctgatatttacatggaagatggcttaataaaacaaattggagacaatctgattgttcctggaggagtgaagaccattgaagccaatgggaagatggtgatccctggaggcatcgatgtccatactcacttccagatgccatataagggaatgaccacagtagatgacttcttccaaggga

SEQ ID NO: 8343 - DNA, 1043 bp, Homo sapiens
actccacctgatctcggggcgctgtgcgctgaggaaggcgcgggcgagccggagcagaagaaggagggagggagccagccgctgcagccaccaccgccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctgcggcagagtacaacatctttgaagggatggagctgcgcggggctcctctggttgtcatctgccagggcaagatcatgctggaagatggcaacctgcacgtgacccagggggctggccgcttcataccctgcagcccgttctccgactatgtctacaagcgcattaaagcacggaggaagatggcagacctgcatgccgtcccaaggggcatgtacgatgggcctgtgtttgacctgaccaccacccccaaaggtggcacccccgcaggctctgctcggggctctcctactcggccgaacccacctgtgaggaatcttcatcagtcgggatttagcctgtcaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttgtttgactcccctccccccatttacatgcatgcaatcagacaggccactaaggtaaaagagtctgctctatcatagtgttgagagcgtgtgtagtgctgcatcttatgacaaggggacagacaagctgggacgtca

SEQ ID NO: 8344 - DNA, 2715 bp, Homo sapiens
gcccagcgggggcgggaccggaacggagccgtgcggccccgcgcgctcgcagtctgtctcccgccgtccccacgcacgcgtcccggctcacgcgtccccccgcccgcccgcccgcccgcccgcccccgcttgtgccgcccctaccagagacccccaggagcaggatgtccttccagggcaagaaaagcatcccccggatcacgagtgaccgccttctgatcagaggtgggaggatcgtgaatgacgaccagtccttttacgctgatgtgcacgtggaagatggcttgataaaacaaatcggagaaaacctcatcgtccctgggggcatcaagaccattgacgcccacggcctgatggtccttcctggtggcgttgacgtccacacaaggctgcagatgcctgtcctgggcatgacaccggctgacgacttctgtcagggcaccaaggcagcgctagcaggaggaaccaccatgatcttggaccacgtcttccccgacacgggtgtgagcctgctggcggcctacgagcagtggcgggagcgggcggacagcgcggcctgctgcgactactccctgcacgtggacatcacccgatggcatgagagcatcaaggaggagctggaggccctggtcaaggagaagggtgtgaactccttcctggtcttcatggcatacaaggaccggtgccagtgcagcgacagccagatgtacgagatcttcagcatcatccgggacctgggggccttggcccaggtgcacgctgagaacggggacatcgtggaggaggagcagaagcggttgctggagctcggcatcactggccccgagggccacgtgctcagccaccccgaggaggtggaggctgaggcggtgtaccgagctgtcaccatcgccaagcaggcaaactgcccgctgtacgtcaccaaggtgatgagcaagggggcggccgacgccatcgctcaggccaagcgcagaggggtggtcgtgtttggggagcccatcaccgccagcctgggcaccgacggttcacactactggagcaagaactgggccaaggccgcagccttcgtcacatcaccccctgtcaacccagaccccaccacggcggaccacctcacctgcttgctgtccagcggggacctccaggtgacaggcagcgcccactgcaccttcaccactgcccagaaggctgtgggcaaggacaacttcgcgctgatccccgagggcaccaacggcattgaggagcgcatgtcgatggtctgggagaaatgtgtggcctctgggaagatggacgagaatgagttcgtcgcggtgaccagtacaaatgctgccaaaatcttcaatttttacccaaggaaggggcgagtggctgtgggctctgacgctgacctggtcatatggaaccccaaggccaccaagatcatctctgccaagacccacaatctgaacgtggagtacaacatcttcgagggagtggagtgccggggagcgcctgccgtggtcataagtcagggccgagtggcgctggaggacgggaagatgtttgtcaccccgggggcgggccgcttcgtccctcggaaaacattcccggactttgtctacaagaggatcaaagctcgcaacaggctggcggagatccacggtgtgccccgtggactgtatgacgggcccgtccacgaggtgatggtgcctgccaagccagggagtggcgctccggcccgcgcgtcctgcccaggcaagatctccgtccctcctgtgcgcaacctacatcagtcggggttcagcctatctgggtctcaggctgatgaccacatcgcccgacgcacagcacagaagatcatggcaccacctggcggccgctccaacatcacctctctctcctagacgcccaggaccggccctgtgagccgtgctggccccacccgaggccgcgggggccccagggcactcgcccccctccttagcattttcttttgtagaagtttctcgaaggtgcttggcggtcttgccttccccctccccacaggctctccttgtggggtcccaggtcctgctgccaagagcccctcaagagaagggctgaacctggggagatgtcactgccagggtgaggtggagccacatggcagggacaatgccggcagcctgagcccaggcaccccagtgcccgctgggcccagcctggggacagggaacctgccgggctcacagtgtgggagcagctggacaccaggcttcttggtgaaccggcgaggggccgagtcccgcctggtgggcatttgccgccgcctccccaccaccagtcactgcctcgcagagccctacactcccgcagccgctcctcagaggcctgtgcccatcgcaggcctgggaggaaagtgggcgcagagccctcctgctcacacagctgctgagacttcagggacccatcagaacttggtgcagcacagccccgcccgtggagggtcccttttacgcaccccaaggcccacacctaagcttccatgtagccctcatccagggaagttttgcgatcctttaggaagacactgtcctcttattacagattgtgtatttccgtaggcttcttagtagcagctttgtacactgaggacactgtagccaggaacctgtgcatgccacccaccgcctggacaggcagtcatcctgcctctgatgtgaatcaggcccattaaagacgtctgggtttgaagcc

SEQ ID NO: 8345 - DNA, 1545 bp, Homo sapiens
gatgcctgtcctgggcatgacaccggctgacgacttctgtcagggcaccaaggcagcgctagcaggaggaaccaccatgatcttggaccacgtcttccccgacacgggtgtgagcctgctggcggcctacgagcagtggcgggagcgggcggacagcgcggcctgctgcgactactccctgcacgtggacatcacccgatggcatgagagcatcaaggaggagctggaggccctggtcaaggagaagggtgtgaactccttcctggtcttcatggcatacaaggaccggtgccagtgcagcgacagccagatgtacgagatcttcagcatcatccgggacctgggggccttggcccaggtgcacgctgagaacggggacatcgtggaggaggtggaggctgaggcggtgtaccgagctgtcaccatcgccaagcaggcaaactgcccgctgtacgtcaccaaggtgatgagcaagggggcggccgacgccatcgctcaggccaagcgcagaggggtggtcgtgtttggggagcccatcaccgccagcctgggcaccgacggttcacactactggagcaagaactgggccaaggccgcagccttcgtcacatcaccccctgtcaacccagaccccaccacggcggaccacctcacctgcttgctgtccagcggggacctccaggtgacaggcagcgcccactgcaccttcaccactgcccagaaggctgtgggcaaggacaacttcgcgctgatccccgagggcaccaacggcattgaggagcgcatgtcgatggtctgggagaaatgtgtggcctctgggaagatggacgagaatgagttcgtcgcggtgaccagtacaaatgctgccaaaatcttcaatttttacccaaggaaggggcgagtggctgtgggctctgacgctgacctggtcatatggaaccccaaggccaccaagatcatctctgccaagacccacaatctgctggcggagatccacggtgtgccccgtggactgtatgacgggcccgtccacgaggtgatggtgcctgccaagccagggagtggcgctccggcccgcgcgtcctgcccaggcaagatctccgtccctcctgtgcgcaacctacatcagtcggggttcagcctatctgggtctcaggctgatgaccacatcgcccgacgcacagcacagaagatcatggcaccacctggcggccgctccaacatcacctctctctcctagacgcccaggaccggccctgtgagccgtgctggccccacccgaggccgcgggggccccagggcactcgcccccctccttagcattttcttttgtagaagtttctcgaaggtgcttggcggtcttgccttccccctccccacaggctctccttgtggggtcccaggtcctgctgccaagagcccctcaagagaagggctgaacctggggagatgtcactgccagggtgaggtggagccacatggcagggacaatgccggcagcctgagcccaggcaccccagtgcccgctgggcccagcctggggac

SEQ ID NO: 8346 - DNA, 2466 bp, Homo sapiens
gcccagcgggggcgggaccggaacggagccgtgcggccccgcgcgctcgcagtctgtctcccgccgtccccacgcacgcgtcccggctcacgcgtccccccgcccgcccgcccgcccgcccgcccccgcttgtgccgcccctaccagagacccccaggagcaggatgtccttccagggcaagaaaagcatcccccggatcacgagtgaccgccttctgatcagaggtgggaggatcgtgaatgacgaccagtccttttacgctgatgtgcacgtggaagatggcttgataaaacaaatcggagaaaacctcatcgtccctgggggcatcaagaccattgacgcccacggcctgatggtccttcctggtggcgttgacgtccacacaaggctgcagatgcctgtcctgggcatgacaccggctgacgacttctgtcagggcaccaaggcagcgctagcaggaggaaccaccatgatcttggaccacgtcttccccgacacgggtgtgagcctgctggcggcctacgagcagtggcgggagcgggcggacagcgcggcctgctgcgactactccctgcacgtggacatcacccgatggcatgagagcatcaaggaggagctggaggccctggtcaaggagaagggtgtgaactccttcctggtcttcatggcatacaaggaccggtgccagtgcagcgacagccagatgtacgagatcttcagcatcatccgggacctgggggccttggcccaggtgcacgctgagaacggggacatcgtggaggaggtggaggctgaggcggtgtaccgagctgtcaccatcgccaagcaggcaaactgcccgctgtacgtcaccaaggtgatgagcaagggggcggccgacgccatcgctcaggccaagcgcagaggggtggtcgtgtttggggagcccatcaccgccagcctgggcaccgacggttcacactactggagcaagaactgggccaaggccgcagccttcgtcacatcaccccctgtcaacccagaccccaccacggcggaccacctcacctgcttgctgtccagcggggacctccaggtgacaggcagcgcccactgcaccttcaccactgcccagaaggctgtgggcaaggacaacttcgcgctgatccccgagggcaccaacggcattgaggagcgcatgtcgatggtctgggagaaatgtgtggcctctgggaagatggacgagaatgagttcgtcgcggtgaccagtacaaatgctgccaaaatcttcaatttttacccaaggaaggggcgagtggctgtgggctctgacgctgacctggtcatatggaaccccaaggccaccaagatcatctctgccaagacccacaatctgctggcggagatccacggtgtgccccgtggactgtatgacgggcccgtccacgaggtgatggtgcctgccaagccagggagtggcgctccggcccgcgcgtcctgcccaggcaagatctccgtccctcctgtgcgcaacctacatcagtcggggttcagcctatctgggtctcaggctgatgaccacatcgcccgacgcacagcacagaagatcatggcaccacctggcggccgctccaacatcacctctctctcctagacgcccaggaccggccctgtgagccgtgctggccccacccgaggccgcgggggccccagggcactcgcccccctccttagcattttcttttgtagaagtttctcgaaggtgcttggcggtcttgccttccccctccccacaggctctccttgtggggtcccaggtcctgctgccaagagcccctcaagagaagggctgaacctggggagatgtcactgccagggtgaggtggagccacatggcagggacaatgccggcagcctgagcccaggcaccccagtgcccgctgggcccagcctggggacagggaacctgccgggctcacagtgtgggagcagctggacaccaggcttcttggtgaaccggcgaggggccgagtcccgcctggtgggcatttgccgccgcctccccaccaccagtcactgcctcgcagagccctacactcccgcagccgctcctcagaggcctgtgcccatcgcaggcctgggaggaaagtgggcgcagagccctcctgctcacacagctgctgagacttcagggacccatcagaacttggtgcagcacagccccgcccgtggagggtcccttttacgcaccccaaggcccacacctaagcttccatgtagccctcatccagggaagttttgcgatcctttaggaagacactgtcctcttattacagattgtgtatttccgtaggcttcttagtagcagctttgtacactgaggacactgtagccaggaacctgtgcatgccacccaccgcctggacaggcagtcatcctgcctctgatgtgaatcaggcccattaaagacgtctgggtttgaagcc

SEQ ID NO: 8347 - DNA, 5209 bp, Homo sapiens
ccccactctggactcccgcgctgggcgcgctgaggcggcccccgagcgagcgcgcgtgcagccgccgccgccccgagcacccgcagctccggcgccgcggcgagacggagacggaccgagccacgggcccccgcggccgcagcatctcggaggagaacatgcttgccaactcagccagcgtgaggatcctcatcaagggaggcaaggtggtgaacgatgactgcacccacgaggctgacgtctacatcgagaatggcatcatccagcaggtgggccgcgagctcatgatccctggcggggccaaggtgattgatgccacaggaaaactggtgatccctggtggcatcgacaccagcacccacttccaccagaccttcatgaatgccacgtgcgtggacgacttctaccatgggaccaaggcagcactcgtcggaggcaccaccatgatcatcggccacgtcctgcccgacaaggagacctcccttgtggacgcttatgagaagtgccgaggtctggccgaccccaaggtctgctgtgattacgccctccacgtggggatcacctggtgggcacccaaggtgaaagcagaaatggagacactggtgagggagaagggtgtcaactcgttccagatgttcatgacctacaaggacctgtacatgcttcgagacagtgagctgtaccaagtgttgcacgcttgcaaggacattggggcaatcgcccgcgtccatgctgaaaatggggagcttgtggccgagggtgctaaggaggcactggatttggggatcacaggcccagaaggaatcgagatcagccgtccagaggagctggaagctgaagccactcatcgtgttatcaccattgcaaacaggactcactgtccaatctacctggtcaacgtgtccagtatctcggctggtgacgttatcgcagctgctaagatgcaagggaaggttgtgctggcggagaccaccactgcacatgccacgctgacaggcttacactactaccaccaggactggtcccacgcggctgcctatgtcacggtgcctcccctgagactggacaccaacacctcaacctacctcatgagcctgctggccaatgacactctgaacatcgtggcatcagatcaccggcctttcaccacaaagcagaaagctatgggcaaggaagacttcaccaagatcccacatggagtgagtggcgtgcaggaccgcatgagcgtcatctgggagagaggagtggttggaggaaagatggatgagaaccgttttgtggccgttaccagttccaacgcagctaagcttctgaacctgtatccccgcaagggccgcattattcccggagccgatgctgatgtggtggtgtgggacccagaagccacaaagaccatctcagccagcacgcaggtccagggaggagacttcaacctgtatgagaacatgcgctgccacggcgtgccactggtcaccatcagccgggggcgcgtcgtgtatgagaacggcgtcttcatgtgcgccgagggcaccggcaagttctgtcccctgaggtccttcccagacactgtctacaagaagctggtccagagagagaagactttaaaggttagaggagtggaccgcactccctacctgggggatgtcgctgttgtcgtgcaccctgggaaaaaagagatgggaaccccactcgcagacactcctacccggcccgtcacccggcatgggggcatgagggaccttcacgaatccagcttcagcctctctggctctcagatcgatgaccatgttccaaagcgagcttcagctcggatcctcgctcctcccggaggcaggtcgagtggcatttggtaaaggcattgccaagccccccgagtgaggacgcaccgccgccaccagcccgcaactctccagccgaagctgcaggggcaggagaggctgggctgggtggcacaccacccgaggggggccccgggacccacggagccctccctatgtctgcaaagtgattcactgtgcttcgagccaactctaacaggcactttgagatgtgttcctcctgctgtagtcctttctgccttggcctcggcgggcttttctggggcccaggaagcccacactatgcacagagcccaatgcatagagccctggccagcccttcctctcactcctgcctccgctggctttgggaaagcccagactttagtgccctgccccctggctgactggccagttgcccagagcactttagcagatgtggtttcaaagtaaaggcctcctcccccaccccttaggccccgtggtgacatttcccaagtcagacagatgtcagcttcccagccatgcccaggacgtcctatctcccccaacccacctctggccctgtgtaggggcagggatgggggtggctgggactcctggtgcccctcgccagcttctcctgcgccccgcccacaccctcggggggtcacaggcccagaagggtagctgggcggggctcgaggctggtgccaggcgcgtgtaaatggttttgttttgcacgtttggtttgcgcagtagtttggtttgacttgtttgtgcatcctgtgaaaaataacggtgcttgtgtcactagcatagaatagcgacaggaatagatgtggtccttaggagacgctgcacttgacaccaaccagacagcacagggcaggggtggtggagggggctgggctcacaggcctctcttttccccgcctgcagtcttctgggctgcgggaggccctggccctttccccttcccctcccctccttgtctagtttcccacattccaaaagggggcctgggatgctagccccagagatgccagcccttcaggaagcaggtgtcctttcccctctctgcccctgatcactcccagcactccccttgccttcccctgtcttcacctgccaccacacacacacacacacacacacacacacacacacacgcacggcttcctataacttcttcctgctggacagagactcagcgctcctcctgtgtgactggcaagaggcctcatgcctgctgagagaggaggagtgggagaggggcttgccagacaccagagagggagaccccaggcccacaggacctggctgtcgaacccgcattgctgctcaggtgccgtgatctcccgtggtcggcaccaggcccttgccagctcatggcctcatcttctcccctgtccatccaggtgggccctccctgcttctaaagccccacagaagttcccatggaaacactagaggccgggtgtctccttccacctccagtgatctgggaagtgacccagccgcctgcccttgttaagcctggtctgccccgtgggaagtgacttcatgttgcacatgtgatttcagcccccgaggcttgcgcgaggcttctggaccctcggttaaaggtcagcccctggccgggtgcggtggctcacgcctgtaatcccagcactttgggaggccaaggcgggtggatcatggagtcaggagatcgagaccatcctggctaacacggtgaaaccccgtctctactaaaaatacaaaaattacccaggcgtggtggcgggcgcctgtagtcccagctactgaggaggctgaggcaggagaatagcgtgaacccgggaggcggagcttgcagtgagccaagatcacgccactgcacttcagcctggacgacagagtgagactccatctcaaaaaacagacaaacaaaaaagtcagcccctgcacatctctgtagtgcttttcatgtattcaaaccacttccgtatatgacctctcacttagtcctcatgacaatggagcacttattattcttcccattttacagatgaggaaactaagacccagaaagttcaggtcctctgaccccagaagtgtctgtgatgaccctcccaaccttggctatctaccccacctgtggagaggaggtctggggtgacatctattgtagatcccacctgagagtttaaccaatgagaagacttactttcctggtaggcagcctgctttgttttgcacaggaagatagattttttttctcatctttcttataaacaacctcatgcacattctgtgtttgagccaagactagtcacccattgggggctaaccgtgcagtgtgagctgcgtccacaccctcacttctcccttcactccccctttcctcactcaggggctgagaggacagaggtggtcagccggggagcagaggtggcgaaggggctcatggcaagtggcagccattggaacaggggtgaggacccaggcctgggaaagccaccagggatgggggaaaccatgacgccgcctcctggtgcagtgcacaccatctctatccctgtcagccctcactgggtcatgggccttgggcagatgtcaaagagcccagcagcagcggtggtggccagctgggcagagcatccttgcttgggctaggaaagctttaccttctctgagtgcctccgcctgagagatgtgtgacccgtggcaccagggaaccacgtcttggagtggtccactgtaggccatgcgcttcatccacccccagtccctacataggccctacccttgcccgggagcttctagatagaaatcagaaagagattcaaggagccaaatgagcggtcagcccccaccatgcactccttgccccgtgcagagctccagccagcttcgtcaccagccccactggctcctggttggaacgaaagggtctctggttgcactgaatgcagctctcaaactggtcttgtacttgctgaataaatactgttgttcttgccttagctgctctctaggtttgtggggttaagttgccagaaaattgtgctactgtgtgtgcgtgtgcgtgcgtgtgtgtagtgctaggagtccacagtaggtctctgtcaagccgatgtcgtgatgagggcttttctgatactgacccagaagccacagaaccacaaggaaacccaaaccccctccagctgctgaggcgcaggcacagcctggggtcggatggagcctccagcaccccagcacccaggtgacttccccactcccctgtaaatgtcatggtgctaagactgtgtcaaccccaagacgacacatggtcctgtgctttggccaccgtttgaggcaaaaactaaacagcccgacacgttgtgttctggtgcaggtttgtattaaactgtagctacttctca

SEQ ID NO: 8348 - DNA, 1972 bp, Homo sapiens
ctcccgggctaggacatcctcctctcccccttctgtttctgcgtgaggcgcacaaaagggcggggagccgggaacatgcttgccaactcagccagcgtgaggatcctcatcaagggaggcaaggtggtgaacgatgactgcacccacgaggctgacgtctacatcgagaatggcatcatccagcaggtgggccgcgagctcatgatccctggcggggccaaggtgattgatgccacaggaaaactggtgatccctggtggcatcgacaccagcacccacttccaccagaccttcatgaatgccacgtgcgtggacgacttctaccatgggaccaaggcagcactcgtcggaggcaccaccatgatcatcggccacgtcctgcccgacaaggagacctcccttgtggacgcttatgagaagtgccgaggtctggccgaccccaaggtctgctgtgattacgccctccacgtggggatcacctggtgggcacccaaggtgaaagcagaaatggagacactggtgagggagaagggtgtcaactcgttccagatgttcatgacctacaaggacctgtacatgcttcgagacagtgagctgtaccaagtgttgcacgcttgcaaggacattggggcaatcgcccgcgtccatgctgaaaatggggagcttgtggccgagggtgctaaggaggcactggatttggggatcacaggcccagaaggaatcgagatcagccgtccagaggagctggaagctgaagccactcatcgtgttatcaccattgcaaacaggactcactgtccaatctacctggtcaacgtgtccagtatctcggctggtgacgttatcgcagctgctaagatgcaagggaaggttgtgctggcggagaccaccactgcacatgccacgctgacaggcttacactactaccaccaggactggtcccacgcggctgcctatgtcacggtgcctcccctgagactggacaccaacacctcaacctacctcatgagcctgctggccaatgacactctgaacatcgtggcatcagatcaccggcctttcaccacaaagcagaaagctatgggcaaggaagacttcaccaagatcccacatggagtgagtggcgtgcaggaccgcatgagcgtcatctgggagagaggagtggttggaggaaagatggatgagaaccgttttgtggccgttaccagttccaacgcagctaagcttctgaacctgtatccccgcaagggccgcattattcccggagccgatgctgatgtggtggtgtgggacccagaagccacaaagaccatctcagccagcacgcaggtccagggaggagacttcaacctgtatgagaacatgcgctgccacggcgtgccactggtcaccatcagccgggggcgcgtcgtgtatgagaacggcgtcttcatgtgcgccgagggcaccggcaagttctgtcccctgaggtccttcccagacactgtctacaagaagctggtccagagagagaagactttaaaggttagaggagtggaccgcactccctacctgggggatgtcgctgttgtcgtgcaccctgggaaaaaagagatgggaaccccactcgcagacactcctacccggcccgtcacccggcatgggggcatgagggaccttcacgaatccagcttcagcctctctggctctcagatcgatgaccatgttccaaagcgagcttcagctcggatcctcgctcctcccggaggcaggtcgagtggcatttggtaaaggcattgccaagccccccgagtgaggacgcaccgccgccaccagcccgcaactctccagccgaagctgcaggggcaggagaggctgggctgggtggcacaccacccgaggggggccccgggacccacggagccctccctatgtctgcaaagtgattcactgtgcttcgagccaactctaacaggcactttgagatgtgttc

SEQ ID NO: 8349 - DNA, 647 bp, Homo sapiens
atcggggctaagccggggcgctcttggggtcctctttgtacgcccgcgaagcgccgtgccgggccttgctcatagaacatgcttgccaactcagccagcgtgaggatcctcatcaagggaggcaaggtggtgaacgatgactgcacccacgaggctgacgtctacatcgagaatggcatcatccagcaggtgggccgcgagctcatgatccctggcggggccaaggtgattgatgccacaggaaaactggtgatccctggtggcatcgacaccagcacccacttccaccagaccttcatgaatgccacgtgcgtggacgacttctaccatgggaccaaggcagcactcgtcggaggcaccaccatgatcatcggccacgtcctgcccgacaaggagacctcccttgtggacgcttatgagaagtgccgaggtctggccgaccccaaggtctgctgtgattacgccctccacgtggggatcacctggtgggcacccaaggtgaaagcagaaatggagacactggtgagggagaagggtgtcaactcgttccagatgttcatgacctacaaggacctgtacatgcttcgagacagtgagctgtaccaagtgttgcacgcttgcaaggacattggggcaatcgcccgcgt

SEQ ID NO: 8350 - DNA, 560 bp, Homo sapiens
aatgcgtgctcgcggggttgcaaagccctggggaacatgcttgccaactcagccagcgtgaggatcctcatcaagggaggcaaggtggtgaacgatgactgcacccacgaggctgacgtctacatcgagaatggcatcatccagcaggtgggccgcgagctcatgatccctggcggggccaaggtgattgatgccacaggaaaactggtgatccctggtggcatcgacaccagcacccacttccaccagaccttcatgaatgccacgtgcgtggacgacttctaccatgggaccaaggcagcactcgtcggaggcaccaccatgatcatcggccacgtcctgcccgacaaggagacctcccttgtggacgcttatgagaagtgccgaggtctggccgaccccaaggtctgctgtgattacgccctccacgtggggatcacctggtgggcacccaaggtgaaagcagaaatggagacactggtgagggagaagggtgtcaactcgttccagatgttcatgacctacaaggacctgtacatgcttcgagacagtgagctgta

SEQ ID NO: 8351 - DNA, 621 bp, Homo sapiens
gtcctccggaaccgcccccggccctccctggggacccgtgcctcagcgcgtccaggctttgtggtgtcctgagtcgccatggaaacccgagggaacgcggagccgggtgctaggggggtcggaacatgcttgccaactcagccagcgtgaggatcctcatcaagggaggcaaggtggtgaacgatgactgcacccacgaggctgacgtctacatcgagaatggcatcatccagcaggtgggccgcgagctcatgatccctggcggggccaaggtgattgatgccacaggaaaactggtgatccctggtggcatcgacaccagcacccacttccaccagaccttcatgaatgccacgtgcgtggacgacttctaccatgggaccaaggcagcactcgtcggaggcaccaccatgatcatcggccacgtcctgcccgacaaggagacctcccttgtggacgcttatgagaagtgccgaggtctggccgaccccaaggtctgctgtgattacgccctccacgtggggatcacctggtgggcacccaaggtgaaagcagaaatggagacactggtgagggagaagggtgtcaactcgttccagatgttcatgacctacaaggacc

SEQ ID NO: 8352 - DNA, 1779 bp, Homo sapiens
cgcgccgccggccctagtctgcctgttttcgactcgcgctccggctgctgtcacttggctctctggctggagcttgaggacgcaaggagggtttgtcactggcagactcgagactgtaggcactgccatggcccctgtgctcagtaaggactcggcggacatcgagagtatcctggctttaaatcctcgaacacaaactcatgcaactctgcgttccacttcggccaagaaattagacaagaaacattggaaaagaaatcctgataagaactgctttaattgtgagaagctggagaataattttgatgacatcaagcacacgactcttggtgagcgaggagctctccgagaagcaatgagatgcctgaaatgtgcagatgccccgtgtcagaagagctgtccaactaatcttgatattaaatcattcatcacaagtattgcaaacaagaactattatggagctgctaagatgatattttctgacaacccacttggtctgacttgtggaatggtatgtccaacctctgatctttgtgtaggtggatgcaatttatatgccactgaagagggacccattaatattggtggattgcagcaatttgctactgagactttgatcctggctttctctttaatgaatcatttgtaaagactttgattcttcagacactcttgggctctctgacgtctcctatttggagtcaacaagcaggttaattcccatgtatcatttaaatgatcagcttatatgaagggtatagtaagattttataatctttggagactagttggctagaaggtcaaattaagtgcccgtcaacctagatttttagttaatgacttactgatctggttttgtcagcataaacacaatgtgttctttcattttgggacccttcccataatattcctcaagcttaagtctcactttgctcttagtaataaatcagggttattcccttcctgctttctgacaggttaattctaaagaagagctcctgggaataagaaaataaaaacaattcgaggttgtggattgttgcaataaattctgggatttaatttcttttcttaccaaattcaaaattgcattaggcttacctgaccactacgaagtatgatctttactacctgtgaaaatccttagttgatggagaagattcacttgaattcctcctcacttttctttggggacccattgcctcttcattaaaccagggcaagctttcacagatgcagtaagtgaaaggtcacatagtatgtatatcaactaacacagcattttaaaacaaaatgaattaaaatgatatcattagtaattgatctggtcatgagaggtgtgtgtgtttgtgtgtgtgtgtgtgtgtgtgtgagagagagagagagaaagagagagagagacagggaaatacattattcctctggaaactctcacatggttttaattcttttctctgggaacactgtccctctgggaactcttacttggttctaccactcattcccagagcagagtctatttaagacagagacatgtgccttcagaacagaatttattagaaacttactaaaatttgagagtggtcacacttaggtcttgccataagtatcacctaatgaagagttatgcatagattaggactgcagtagatgcattttaagtgaatcaaggaatttagaataggaatgtatctgcttatttcattccaattatagtttgtataattgtaatttcaatatcaaattataaattaaaaatgtcctcgtgggaactactga

SEQ ID NO: 8353 - DNA, 4412 bp, Homo sapiens
tttcgactcgcgctccggctgctgtcacttggctctctggctggagcttgaggacgcaaggagggtttgtcactggcagactcgagactgtaggcactgccatggcccctgtgctcagtaaggactcggcggacatcgagagtatcctggctttaaatcctcgaacacaaactcatgcaactctgcgttccacttcggccaagaaattagacaagaaacattggaaaagaaatcctgataagaactgctttaattgtgagaagctggagaataattttgatgacatcaagcacacgactcttggtgagcgaggagctctccgagaagcaatgagatgcctgaaatgtgcagatgccccgtgtcagaagagctgtccaactaatcttgatattaaatcattcatcacaagtattgcaaacaagaactattatggagctgctaagatgatattttctgacaacccacttggtctgacttgtggaatggtatgtccaacctctgatctttgtgtaggtggatgcaatttatatgccactgaagagggacccattaatattggtggattgcagcaatttgctactgaggtattcaaagcaatgagtatcccacagatcagaaatccttcgctgcctcccccagaaaaaatgtctgaagcctattctgcaaagattgctctttttggtgctgggcctgcaagtataagttgtgcttcctttttggctcgattggggtactctgacatcactatatttgaaaaacaagaatatgttggtggtttaagtacttctgaaattcctcagttccggctgccgtatgatgtagtgaattttgagattgagctaatgaaggaccttggtgtaaagataatttgcggtaaaagcctttcagtgaatgaaatgactcttagcactttgaaagaaaaaggctacaaagctgctttcattggaataggtttgccagaacccaataaagatgccatcttccaaggcctgacgcaggaccaggggttttatacatccaaagactttttgccacttgtagccaaaggcagtaaagcaggaatgtgcgcctgtcactctccattgccatcgatacggggagtcgtgattgtacttggagctggagacactgcctttgactgtgcaacatctgctctacgttgtggagctcgccgtgtgttcatcgtcttcagaaaaggctttgttaatataagagctgtccctgaggagatggaacttgctaaggaagaaaagtgtgaatttctgccattcctgtccccacggaaggttatagtaaaaggtgggagaattgttgctatgcagtttgttcggacagagcaagatgaaactggaaaatggaatgaagatgaagatcagatggtccatctgaaagccgatgtggtcatcagtgcctttggttcagttctgagtgatcctaaagtaaaagaagccttgagccctataaaatttaacagatggggtctcccagaagtagatccagaaactatgcaaactagtgaagcatgggtatttgcaggtggtgatgtcgttggtttggctaacactacagtggaatcggtgaatgatggaaagcaagcttcttggtacattcacaaatacgtacagtcacaatatggagcttccgtttctgccaagcctgaactacccctcttttacactcctattgatctggtggacattagtgtagaaatggccggattgaagtttataaatccttttggtcttgctagcgcaactccagccaccagcacatcaatgattcgaagagcttttgaagctggatggggttttgccctcaccaaaactttctctcttgataaggacattgtgacaaatgtttcccccagaatcatccggggaaccacctctggccccatgtatggccctggacaaagctcctttctgaatattgagctcatcagtgagaaaacggctgcatattggtgtcaaagtgtcactgaactaaaggctgactttccagacaacattgtgattgctagcattatgtgcagttacaataaaaatgactggacggaacttgccaagaagtctgaggattctggagcagatgccctggagttaaatttatcatgtccacatggcatgggagaaagaggaatgggcctggcctgtgggcaggatccagagctggtgcggaacatctgccgctgggttaggcaagctgttcagattcctttttttgccaagctgaccccaaatgtcactgatattgtgagcatcgcaagagctgcaaaggaaggtggtgccaatggcgttacagccaccaacactgtctcaggtctgatgggattaaaatctgatggcacaccttggccagcagtggggattgcaaagcgaactacatatggaggagtgtctgggacagcaatcagacctattgctttgagagctgtgacctccattgctcgtgctctgcctggatttcccattttggctactggtggaattgactctgctgaaagtggtcttcagtttctccatagtggtgcttccgtcctccaggtatgcagtgccattcagaatcaggatttcactgtgatcgaagactactgcactggcctcaaagccctgctttatctgaaaagcattgaagaactacaagactgggatggacagagtccagctactgtgagtcaccagaaagggaaaccagttccacgtatagctgaactcatggacaagaaactgccaagttttggaccttatctggaacagcgcaagaaaatcatagcagaaaacaagattagactgaaagaacaaaatgtagctttttcaccacttaagagaaactgttttatccccaaaaggcctattcctaccatcaaggatgtaataggaaaagcactgcagtaccttggaacatttggtgaattgagcaacgtagagcaagttgtggctatgattgatgaagaaatgtgtatcaactgtggtaaatgctacatgacctgtaatgattctggctaccaggctatacagtttgatccagaaacccacctgcccaccataaccgacacttgtacaggctgtactctgtgtctcagtgtttgccctattgtcgactgcatcaaaatggtttccaggacaacaccttatgaaccaaagagaggcgtacccttatctgtgaatccggtgtgttaaggtgatttgtgaaacagttgctgtgaactttcatgtcacctacatatgctgatcttttaaaatcatgatccttgtgttcagctctttccaaattaaaacaaatatacattttctaaataaaaatatgtaatttcaaaatacatttgtaagtgtaaaaaatgtctcatgtcaatgaccattcaattagtggtcataaaatagaataattcttttctgaggatagtagttaaataactgtgtggcagttaattggatgttcactgccagttgtcttatgtgaaaaattaacttttttgtggcaattagtgtgacagtttccaaattgccctatgctgtgctccatatttgatttctaattgtaagtgaaattaagcattttgaaacaaagtactctttaacatacaagaaaatgtatccaaggaaacattttatcattaaaaattacctttaattttaatgctgtttctaagaaaatgtagttagctccataaagtacaaatgaagaaagtcaaaaaattatttgctatggcaggataagaaagcctaaaattgagtttgtagaactttattaagtaaaatccccttcgctgaaattgcttatttttggtgttggatagaggatagggagaatatttactaactaaataccattcactactcatgcgtgagatgggtgtacaaactcatcctcttttaatggcatttctctttaaactatgttcctaacaaaatgagatgataggatagatcctggttaccactcttttgctgtgcacatacgggctctgactggttttaatagtcaccttcatgattatagcaactaatgtttgaacaaagctcaaagtatgcaatgcttcattattcaagaatgaaaaatataatgttgataatatatattaagtgtgccaaatcagtttgactactctctgttttagtgtttatgtttaaaagaaatatattttttgttattattagataatatttttgtatttctctattttcataatcagtaaatagtgtcatataaactcatttatctcctcttcatggcatcttcaatatgaatctataagtagtaaatcagaaagtaacaatctatggcttatttctatgacaaattcaagagctagaaaaataaaatgtttcattatgcacttttagaaatgcatatttgccacaaaacctgtattactgaataatatcaaataaaatatcataaagcattttaaa

SEQ ID NO: 8354 - DNA, 835 bp, Homo sapiens
acttggctctctggctggagcttgaggacgcaaggagggtttgtcactggcagactcgagactgtaggcactgccatggcccctgtgctcagtaaggactcggcggacatcgagaattgtgagaagctggagaataattttgatgacatcaagcacacgactcttggtgagcgaggagctctccgagaagcaatgagatgcctgaaatgtgcagatgccccgtgtcagaagagctgtccaactaatcttgatattaaatcattcatcacaagtattgcaaacaagaactattatggagctgctaagatgatattttctgacaacccacttggtctgacttgtggaatggtatgtccaacctctgatctttgtgtaggtggatgcaatttatatgccactgaagagggacccattaatattggtggattgcagcaatttgctactgaggttaatggcctcctacatttccaaaactctgtgtctctctggtttcaaaagactgccaacatctcttttctgagctgtggttctcttcaagatgcttagccttcctccctttggtattcaaagcaatgagtatcccacagatcagaaatccttcgctgcctcccccagaaaaaatgtctgaagcctattctgcaaagattgctctttttggtgctgggcctgcaagtataagttgtgcttcctttttggctcgattggggtactctgacatcactatatttgaaaaacaagaatatgttggtggtttaagtacttctgaaattcctcagttccggctgccgtatgatgtagtgaattttgagattgagctaatgaaggaccttggtgt

SEQ ID NO: 8355 - DNA, 2310 bp, Homo sapiens
tgaggcgcgccggctggttcaactccggccgccgcgccgaaaccagcagcggtccgggtcgaaccagcaccggcctcgggaggttccgccgcctgctctgccgctgttccaactgccgctgtagagccactgggatgcgcaccaccggcaggggttcgtcgggactgcggaccgtgaggccccgtcgcggcgccaggagcaaccgagtcacgagggaaaagagccgcaccggccgcgttagagccatgtttcccttagtgcgggagaagcgcacatcagtgacgtcacggacgcgccgcgacctcgcgtacggtggctggcgaggctcagtacggtgtgtggagctggagcaccgtgaggaagaagcgaggttctttttaagagttcagctgcgagatatcaaacaaagaattactctgtacaaagccagaacacatatatcaaagtaatcctgaagtatcagaacaaaataataggctgtaacagaggaggaaatgattttgaatagcctctctctgtgttaccataataagctaatcctggccccaatggttcgggtagggactcttccaatgaggctgctggccctggattatggagcggacattgtttactgtgaggagctgatcgacctcaagatgattcagtgcaagagagttgttaatgaggtgctcagcacagtggactttgtcgcccctgatgatcgagttgtcttccgcacctgtgaaagagagcagaacagggtggtcttccagatggggacttcagacgcagagcgagcccttgctgtggccaggcttgtagaaaatgatgtggctggtattgatgtcaacatgggctgtccaaaacaatattccaccaagggaggaatgggagctgccctgctgtcagaccctgacaagattgagaagatcctcagcactcttgttaaagggacacgcagacctgtgacctgcaagattcgcatcctgccatcgctagaagataccctgagccttgtgaagcggatagagaggactggcattgctgccatcgcagttcatgggaggaagcgggaggagcgacctcagcatcctgtcagctgtgaagtcatcaaagccattgctgataccctctccattcctgtcatagccaacggaggatctcatgaccacatccaacagtattcggacatagaggactttcgacaagccacggcagcctcttccgtgatggtggcccgagcagccatgtggaacccatctatcttcctcaaggagggtctgcggcccctggaggaggtcatgcagaaatacatcagatacgcggtgcagtatgacaaccactacaccaacaccaagtactgcttgtgccagatgctacgagaacagctggagtcgccccagggaaggttgctccatgctgcccagtcttcccgggaaatttgtgaggcctttggccttggtgccttctatgaggagaccacacaggagctggatgcccagcaggccaggctctcagccaagacttcagagcagacaggggagccagctgaagatacctctggtgtcattaagatggctgtcaagtttgaccggagagcatacccagcccagatcacccctaagatgtgcctactagagtggtgccggagggagaagttggcacagcctgtgtatgaaacggttcaacgccctctagatcgcctgttctcctctattgtcaccgttgctgaacaaaagtatcagtctaccttgtgggacaagtccaagaaactggcggagcaggctgcagccatcgtctgtctgcggagccagggcctccctgagggtcggctgggtgaggagagcccttccttgcacaagcgaaagagggaggctcctgaccaagaccctgggggccccagagctcaggagctagcacaacctggggatctgtgcaagaagccctttgtggccttgggaagtggtgaagaaagccccctggaaggctggtgactactcttcctgccttagtcacccctccatgggcctggtgctaaggtggctgtggatgccacagcatgaaccagatgccgttgaacagtttgctggtcttgcctggcagaagttagatgtcctggcaggggccatcagcctagagcatggaccaggggccgcccaggggtggatcctggcccctttggtggatctgagtgacagggtcaagttctctttgaaaacaggagcttttcaggtggtaactccccaacctgacattggtactgtgcaataaagacaccccctaccctcacccacggctggctgcttcagccttgggcatcttcataaa

SEQ ID NO: 8356 - DNA, 1986 bp, Homo sapiens
gctcagtacggtgtgtggagctggagcaccgtgaggaagaagcgaggttctttttaagagttcagctgcgagatatcaaacaaagaattactctgtacaaagccagaacacatatatcaaagtaatcctgaagtatcagaacaaaataataggctgtaacagaggaggaaatgattttgaatagcctctctctgtgttaccataataagctaatcctggccccaatggttcgggtagggactcttccaatgaggctgctggccctggattatggagcggacattgtttactgtgaggagctgatcgacctcaagatgattcagtgcaagagagttgttaatgaggtgctcagcacagtggactttgtcgcccctgatgatcgagttgtcttccgcacctgtgaaagagagcagaacagggtggtcttccagatggggacttcagacgcagagcgagcccttgctgtggccaggcttgtagaaaatgatgtggctggtattgatgtcaacatgggctgtccaaaacaatattccaccaagggaggaatgggagctgccctgctgtcagaccctgacaagattgagaagatcctcagcactcttgttaaagggacacgcagacctgtgacctgcaagattcgcatcctgccatcgctagaagataccctgagccttgtgaagcggatagagaggactggcattgctgccatcgcagttcatgggaggaagcgggaggagcgacctcagcatcctgtcagctgtgaagtcatcaaagccattgctgataccctctccattcctgtcatagccaacggaggatctcatgaccacatccaacagtattcggacatagaggactttcgacaagccacggcagcctcttccgtgatggtggcccgagcagccatgtggaacccatctatcttcctcaaggagggtctgcggcccctggaggaggtcatgcagaaatacatcagatacgcggtgcagtatgacaaccactacaccaacaccaagtactgcttgtgccagatgctacgagaacagctggagtcgccccagggaaggttgctccatgctgcccagtcttcccgggaaatttgtgaggcctttggccttggtgccttctatgaggagaccacacaggagctggatgcccagcaggccaggctctcagccaagacttcagagcagacaggggagccagctgaagatacctctggtgtcattaagatggctgtcaagtttgaccggagagcatacccagcccagatcacccctaagatgtgcctactagagtggtgccggagggagaagttggcacagcctgtgtatgaaacggttcaacgccctctagatcgcctgttctcctctattgtcaccgttgctgaacaaaagtatcagtctaccttgtgggacaagtccaagaaactggcggagcaggctgcagccatcgtctgtctgcggagccagggcctccctgagggtcggctgggtgaggagagcccttccttgcacaagcgaaagagggaggctcctgaccaagaccctgggggccccagagctcaggagctagcacaacctggggatctgtgcaagaagccctttgtggccttgggaagtggtgaagaaagccccctggaaggctggtgactactcttcctgccttagtcacccctccatgggcctggtgctaaggtggctgtggatgccacagcatgaaccagatgccgttgaacagtttgctggtcttgcctggcagaagttagatgtcctggcaggggccatcagcctagagcatggaccaggggccgcccaggggtggatcctggcccctttggtggatctgagtgacagggtcaagttctctttgaaaacaggagcttttcaggtggtaactccccaacctgacattggtactgtgcaataaagacaccccctaccctcacccacggctggctgcttcagccttgggcatcttcataaa

SEQ ID NO: 8357 - DNA, 1864 bp, Homo sapiens
gtgtggagctggagcaccgtgaggaagaagcgaggttctttttaagagttcagctgcgagatatcaaacaaagaattactctgtacaaagccagaacacatatatcaaagtaatcctgaagtatcagaacaaaataataggctgtaacagaggaggaaatgattttgaatagcctctctctgtgttaccataataagctaatcctggccccaatggttcgggtagggactcttccaatgaggctgctggccctggattatggagcggacattgtttactgtgaggagctgatcgacctcaagatgattcagtgcaagagagttgttaatgaggtgctcagcacagtggactttgtcgcccctgatgatcgagttgtcttccgcacctgtgaaagagagcagaacagggtggtcttccagatgggaggaatgggagctgccctgctgtcagaccctgacaagattgagaagatcctcagcactcttgttaaagggacacgcagacctgtgacctgcaagattcgcatcctgccatcgctagaagataccctgagccttgtgaagcggatagagaggactggcattgctgccatcgcagttcatgggaggaagcgggaggagcgacctcagcatcctgtcagctgtgaagtcatcaaagccattgctgataccctctccattcctgtcatagccaacggaggatctcatgaccacatccaacagtattcggacatagaggactttcgacaagccacggcagcctcttccgtgatggtggcccgagcagccatgtggaacccatctatcttcctcaaggagggtctgcggcccctggaggaggtcatgcagaaatacatcagatacgcggtgcagtatgacaaccactacaccaacaccaagtactgcttgtgccagatgctacgagaacagctggagtcgccccagggaaggttgctccatgctgcccagtcttcccgggaaatttgtgaggcctttggccttggtgccttctatgaggagaccacacaggagctggatgcccagcaggccaggctctcagccaagacttcagagcagacaggggagccagctgaagatacctctggtgtcattaagatggctgtcaagtttgaccggagagcatacccagcccagatcacccctaagatgtgcctactagagtggtgccggagggagaagttggcacagcctgtgtatgaaacggttcaacgccctctagatcgcctgttctcctctattgtcaccgttgctgaacaaaagtatcagtctaccttgtgggacaagtccaagaaactggcggagcaggctgcagccatcgtctgtctgcggagccagggcctccctgagggtcggctgggtgaggagagcccttccttgcacaagcgaaagagggaggctcctgaccaagaccctgggggccccagagctcaggagctagcacaacctggggatctgtgcaagaagccctttgtggccttgggaagtggtgaagaaagccccctggaaggctggtgactactcttcctgccttagtcacccctccatgggcctggtgctaaggtggctgtggatgccacagcatgaaccagatgccgttgaacagtttgctggtcttgcctggcagaagttagatgtcctggcaggggccatcagcctagagcatggaccaggggccgcccaggggtggatcctggcccctttggtggatctgagtgacagggtcaagttctctttgaaaacaggagcttttcaggtggtaactccccaacctgacattggtactgtgcaataaagacaccccctaccctcacccacggctggctgcttcagccttgggcatcttc

SEQ ID NO: 8358 - DNA, 3920 bp, Homo sapiens
aggagccgacgggcgctcgcaggctcagcgcgcgctgcccgcggcaggacccggccgcctccgccgccgccgccgcccctaagcctcccgaagccatggccgggctcggccaccccgccgccttcggccgggccacccacgccgtggtgcgggcgctacccgagtcgctcggccagcacgcgctgagaagcgccaagggcgaggaggtggacgtcgcccgcgcggaacggcagcaccagctctacgtgggcgtgctgggcagcaagctggggctgcaggtggtggagctgccggccgacgagagccttccggactgcgtcttcgtggaggacgtggccgtggtgtgcgaggagacggccctcatcacccgacccggggcgccgagccggaggaaggaggttgacatgatgaaagaagcattagaaaaacttcagctcaatatagtagagatgaaagatgaaaatgcaactttagatggcggagatgttttattcacaggcagagaattttttgtgggcctttccaaaaggacaaatcaacgaggtgctgaaatcttggctgatacttttaaggactatgcagtctccacagtgccagtggcagatgggttgcatttgaagagtttctgcagcatggctgggcctaacctgatcgcaattgggtctagtgaatctgcacagaaggcccttaagatcatgcaacagatgagtgaccaccgctacgacaaactcactgtgcctgatgacatagcagcaaactgtatatatctaaatatccccaacaaagggcacgtcttgctgcaccgaaccccggaagagtatccagaaagtgcaaaggtttatgagaaactgaaggaccatatgctgatccccgtgagcatgtctgaactggaaaaggtggatgggctgctcacctgctgctcagttttaattaacaagaaagtagactcctgagctgcagagtcccccccggttgccggcaagaccgcacaggcaaggccgatgactctgtgcccactcctgttgttttccttgacaatctactgtgccactgtgctactaactcttgtttacaaaatttgattctaagttgaattgcttcattcaacacccccaccctccctcccctcgaggtggtacctaagctgtggatttgctaaatgaattaagcaacctagaagatacagagctaatgaattatcaaaatgtgattaatcccagtaaggaaacactcatttagtgtctgtatttttggtgtgaaaattatttagttgccagtatattctgaagaatgtcttcttgatcagtcagataagcttgctttttttttttttttttttcatgaatcatgtttggttcctgtgaaagtccctggtccagggatcctcctcctttctcttttacttctgaattctgaaattcagttagttacttttgcctttcgctcttctatcacagccaccttgaccttgggtaaaacccaaggtctttccttctggctaccttcctgcaggtccaccctgtctgccattggtctcctctgcctctgactacatctgccaccaacaaccctcccctcacccctgccaggggcagacaggcttctcagcagaactgtgactgaaatcagagctgctgtctggggcagtgttaactacacagaggcacatcctgacagggtttgccccagagatctaaattccagaaggagggcaccacacctaggaaggtaaatccagtatcagaaggttgctaaaagattaaagatcaagaagcttggaaacatcccatgggtacaatgtcttagaaagtctttaagtcacataccatgaatttttgcttcattactgaccatatatgaccttggaggaactcttttttttttttccttctactcatttctgtttccacctaccctgactcaccgtatttccagtcttctacccctgcagttatcctagtccagcaaagtcatttctttcaaaagagacatcatgtctgaaaataattactggtagtctaatatgagccagagtaaacagctcctcatggtcaatgaacatgttcaggaagcgatcaccttgatgcttgaacccaaccccagacagtggacaattctactttgaaatatccgtgaatatttactgtgggatccaatttaaacttctttcttctctagcctttaaattacacaactttgaactgacacggatctcttacaaagaacaatgcggcactgaaggaagagatgattcctttactcaaacctgcaggaatcagcctattaacaggcaggggaaacggtactttccaatgaatggtaactgatccaggcacattatcacacttcctagtcatctccacctttcctgtattgcctgtggcttgttgtttaagattaagaatcaaagagattaagaagtatcacttcaaatcttgctctgctcacttctatgtttgcagtcaaattattccttatgttggtgacctaaagagaattactttcattcatttcatttcccccgtagcagatggaaggagaaacctctgagaaaatgaaaacatccttaaccactatctttcccttttatttgattattttatgtcagaaatttgcaaaagtttttttctcctccttctcttccttgttgcttaactttttaattcatgccatatgcagatatccaattatgtgcatcctgtgaataaaccacgtcttggtcactgtcatattttgaaccatctcatcagagatgaataatatctttttaccagagagagaacgaatgttagccacatgcccaagttaacaaagaaaaaatgttctcaaggttgtccttttgggttaaatctggcccttccttggcaaaagcaaaaattctccctgtgagagctcaacatctcaaatacaaccacaggaaaaatggcccaatctgccagtttaggcttaccagcatataatttttaatatctttacttctatcatcccaaatcaaagaactcttctctattatgtttaatcaattgcaagcaaatagatttttctttgtaacaatttgttctgcagaaggctgtttttcacttttcctttcttttgcttctttctgtctttccttctcttttgtctggagaaatcacttagactctgtgtgcctcttctacattgcattctgctctgctatgttacctgctaggctggcttctttggactccctatatgattgatgatgtgaaaacctaaattacttgcagcatagtattacttctttgatgttctcattagcataatgttatttttgaaaaggaaagatactatcacataagttttcctcatctgttgtgatatacaccaatggataaactaacggaaactgctttttgacattaaaagacaggagaaattatatttaactaagtaaaagttaagtcagaattacttgggtgatgtgattcaatttagttaaaggatgatatagagaaaatacattatttagcattatttcttcagctataatgaattgctatagaaatcaggcagatctttctaatgtgtattgattggtcttttcagctactctgaacagattactaaggccatctcctcatctctaagggagaaaaatagtctgtagatgaataatgtaaggtaaagagttgcatgtcagtctttgtaattatttacactttaactttctccagaactcagacatgatttcaacatggtgttagatttgtgcattttattttcctgaccacctcattccagccaatgtatggttatccactctgtgtgccaaaaccaatcatgcctttcacggccctttagttcagagaagttctgcactgatttttagtctcttgatgtctcaatcttacatgtataccaatcacaatggaataaagtgttgagttgtactgtga

SEQ ID NO: 8359 - DNA, 1043 bp, Homo sapiens
agtcagagagaagttcattgttcacacctcccggctgccggcagccttctggaggatccgattcaatgtggttgtacggtctcgggcaggttgacatgatgaaagaagcattagaaaaacttcagctcaatatagtagagatgaaagatgaaaatgcaactttagatggcggagatgttttattcacaggcagagaattttttgtgggcctttccaaaaggacaaatcaacgaggtgctgaaatcttggctgatacttttaaggactatgcagtctccacagtgccagtggcagatgggttgcatttgaagagtttctgcagcatggctgggcctaacctgatcgcaattgggtctagtgaatctgcacagaaggcccttaagatcatgcaacagatgagtgaccaccgctacgacaaactcactgtgcctgatgacatagcagcaaactgtatatatctaaatatccccaacaaagggcacgtcttgctgcaccgaaccccggaagagtatccagaaagtgcaaaggtttatgagaaactgaaggaccatatgctgatccccgtgagcatgtctgaactggaaaaggtggatgggctgctcacctgctgctcagttttaattaacaagaaagtagactcctgagctgcagagtcccccccggttgccggcaagaccgcacaggcaaggccgatgactctgtgcccactcctgttgttttccttgacaatctactgtgccactgtgctactaactcttgtttacaaaatttgattctaagttgaattgcttcattcaacacccccaccctccctcccctcgaggtggtacctaagctgtggatttgctaaatgaattaagcaacctagaagatacagagctaatgaattatcaaaatgtgattaatcccagtaaggaaacactcatttagtgtctgtatttttggtgtgaaaattatttagttgccagtatattctgaagaatgtcttcttgatcagtcagataagcttgctttttttttttttttttttcatgaatcatgtt

SEQ ID NO: 8360 - DNA, 4017 bp, Homo sapiens
gtttgtttctggacttcaactggggaatcttgaggatgagtttgccccagaagagaaatttagagaaccttaccgtcagctgcccatttaaagcagggggtgtgttgtgggatgggggtgggaagctggagcaacagggccaggaggtgtgggagcgggagacactagagtaacctatgtgcacagcctctccatataccatgtgctgttgcgcctgctagtaatcgacgacattaggcaagagaaacagcggctcctcaagtcctgcccaaagaccgtccagaaaccccagcctcccgtcgccttctcgccgcctccgctgggagccgcagatcagtccaagttgacggacaggaggcgaaatgtgcaaatgtttatggtttcatctgtatggaaaaggagctctggtaactttggccaagacttttcagtaggaaatgcttcaaaatacaaagcaagagctattttcaagaaagaccttctaaatttatattaggttgacatgatgaaagaagcattagaaaaacttcagctcaatatagtagagatgaaagatgaaaatgcaactttagatggcggagatgttttattcacaggcagagaattttttgtgggcctttccaaaaggacaaatcaacgaggtgctgaaatcttggctgatacttttaaggactatgcagtctccacagtgccagtggcagatgggttgcatttgaagagtttctgcagcatggctgggcctaacctgatcgcaattgggtctagtgaatctgcacagaaggcccttaagatcatgcaacagatgagtgaccaccgctacgacaaactcactgtgcctgatgacatagcagcaaactgtatatatctaaatatccccaacaaagggcacgtcttgctgcaccgaaccccggaagagtatccagaaagtgcaaaggtttatgagaaactgaaggaccatatgctgatccccgtgagcatgtctgaactggaaaaggtggatgggctgctcacctgctgctcagttttaattaacaagaaagtagactcctgagctgcagagtcccccccggttgccggcaagaccgcacaggcaaggccgatgactctgtgcccactcctgttgttttccttgacaatctactgtgccactgtgctactaactcttgtttacaaaatttgattctaagttgaattgcttcattcaacacccccaccctccctcccctcgaggtggtacctaagctgtggatttgctaaatgaattaagcaacctagaagatacagagctaatgaattatcaaaatgtgattaatcccagtaaggaaacactcatttagtgtctgtatttttggtgtgaaaattatttagttgccagtatattctgaagaatgtcttcttgatcagtcagataagcttgctttttttttttttttttttcatgaatcatgtttggttcctgtgaaagtccctggtccagggatcctcctcctttctcttttacttctgaattctgaaattcagttagttacttttgcctttcgctcttctatcacagccaccttgaccttgggtaaaacccaaggtctttccttctggctaccttcctgcaggtccaccctgtctgccattggtctcctctgcctctgactacatctgccaccaacaaccctcccctcacccctgccaggggcagacaggcttctcagcagaactgtgactgaaatcagagctgctgtctggggcagtgttaactacacagaggcacatcctgacagggtttgccccagagatctaaattccagaaggagggcaccacacctaggaaggtaaatccagtatcagaaggttgctaaaagattaaagatcaagaagcttggaaacatcccatgggtacaatgtcttagaaagtctttaagtcacataccatgaatttttgcttcattactgaccatatatgaccttggaggaactcttttttttttttccttctactcatttctgtttccacctaccctgactcaccgtatttccagtcttctacccctgcagttatcctagtccagcaaagtcatttctttcaaaagagacatcatgtctgaaaataattactggtagtctaatatgagccagagtaaacagctcctcatggtcaatgaacatgttcaggaagcgatcaccttgatgcttgaacccaaccccagacagtggacaattctactttgaaatatccgtgaatatttactgtgggatccaatttaaacttctttcttctctagcctttaaattacacaactttgaactgacacggatctcttacaaagaacaatgcggcactgaaggaagagatgattcctttactcaaacctgcaggaatcagcctattaacaggcaggggaaacggtactttccaatgaatggtaactgatccaggcacattatcacacttcctagtcatctccacctttcctgtattgcctgtggcttgttgtttaagattaagaatcaaagagattaagaagtatcacttcaaatcttgctctgctcacttctatgtttgcagtcaaattattccttatgttggtgacctaaagagaattactttcattcatttcatttcccccgtagcagatggaaggagaaacctctgagaaaatgaaaacatccttaaccactatctttcccttttatttgattattttatgtcagaaatttgcaaaagtttttttctcctccttctcttccttgttgcttaactttttaattcatgccatatgcagatatccaattatgtgcatcctgtgaataaaccacgtcttggtcactgtcatattttgaaccatctcatcagagatgaataatatctttttaccagagagagaacgaatgttagccacatgcccaagttaacaaagaaaaaatgttctcaaggttgtccttttgggttaaatctggcccttccttggcaaaagcaaaaattctccctgtgagagctcaacatctcaaatacaaccacaggaaaaatggcccaatctgccagtttaggcttaccagcatataatttttaatatctttacttctatcatcccaaatcaaagaactcttctctattatgtttaatcaattgcaagcaaatagatttttctttgtaacaatttgttctgcagaaggctgtttttcacttttcctttcttttgcttctttctgtctttccttctcttttgtctggagaaatcacttagactctgtgtgcctcttctacattgcattctgctctgctatgttacctgctaggctggcttctttggactccctatatgattgatgatgtgaaaacctaaattacttgcagcatagtattacttctttgatgttctcattagcataatgttatttttgaaaaggaaagatactatcacataagttttcctcatctgttgtgatatacaccaatggataaactaacggaaactgctttttgacattaaaagacaggagaaattatatttaactaagtaaaagttaagtcagaattacttgggtgatgtgattcaatttagttaaaggatgatatagagaaaatacattatttagcattatttcttcagctataatgaattgctatagaaatcaggcagatctttctaatgtgtattgattggtcttttcagctactctgaacagattactaaggccatctcctcatctctaagggagaaaaatagtctgtagatgaataatgtaaggtaaagagttgcatgtcagtctttgtaattatttacactttaactttctccagaactcagacatgatttcaacatggtgttagatttgtgcattttattttcctgaccacctcattccagccaatgtatggttatccactctgtgtgccaaaaccaatcatgcctttcacggccctttagttcagagaagttctgcactgatttttagtctcttgatgtctcaatcttacatgtataccaatcacaatggaataaagtgttgagttgtactgtg

SEQ ID NO: 8361 - DNA, 1517 bp, Homo sapiens
caagaggagccgacgggcgctcgcaggctcagcgcgcgctgcccgcggcaggacccggccgcctccgccgccgccgccgcccctaagcctcccgaagccatggccgggctcggccaccccgccgccttcggccgggccacccacgccgtggtgcgggcgctacccgagtcgctcggccagcacgcgctgagaagcgccaagggcgaggaggtggacgtcgcccgcgcggaacggcagcaccagctctacgtgggcgtgctgggcagcaagctggggctgcaggtggtggagctgccggccgacgagagccttccggactgcgtcttcgtggaggacgtggccgtggtgtgcgaggagacggccctcatcacccgacccggggcgccgagccggaggaaggaggttgacatgatgaaagaagcattagaaaaacttcagctcaatatagtagagatgaaagatgaaaatgcaactttagatggcggagatgttttattcacaggcagagaattttttgtgggcctttccaaaaggacaaatcaacgaggtgctgaaatcttggctgatacttttaaggactatgcagtctccacagtgccagtggcagatgggttgcatttgaagagtttctgcagcatggctgggcctaacctgatcgcaattgggtctagtgaatctgcacagaaggcccttaagatcatgcaacagatgagtgaccaccgctacgacaaactcactgtgcctgatgacatagcagcaaactgtatatatctaaatatccccaacaaagggcacgtcttgctgcaccgaaccccggaagagtatccagaaagtgcaaaggtttatgagaaactgaaggaccatatgctgatccccgtgagcatgtctgaactggaaaaggtggatgggctgctcacctgctgctcagttttaattaacaagaaagtagactcctgagctgcagagtcccccccggttgccggcaagaccgcacaggcaaggccgatgactctgtgcccactcctgttgttttccttgacaatctgattcaatttagttaaaggatgatatagagaaaatacattatttagcattatttcttcagctataatgaattgctatagaaatcaggcagatctttctaatgtgtattgattggtcttttcagctactctgaacagattactaaggccatctcctcatctctaagggagaaaaatagtctgtagatgaataatgtaaggtaaagagttgcatgtcagtctttgtaattatttacactttaactttctccagaactcagacatgatttcaacatggtgttagatttgtgcattttattttcctgaccacctcattccagccaatgtatggttatccactctgtgtgccaaaaccaatcatgcctttcacggccctttagttcagagaagttctgcactgatttttagtctcttgatgtctcaatcttacatgtataccaatcacaatggaataaagtgttgagttgtactgtg

SEQ ID NO: 8362 - DNA, 1066 bp, Homo sapiens
cagactgttcttcagtaacacaggtggatgttaaaacagggaatctgttgaaaagattgcggaggaactgcttcccaaaagcagttctggatggcaatttgatggcagtcagctatggttgacatgatgaaagaagcattagaaaaacttcagctcaatatagtagagatgaaagatgaaaatgcaactttagatggcggagatgttttattcacaggcagagaattttttgtgggcctttccaaaaggacaaatcaacgaggtgctgaaatcttggctgatacttttaaggactatgcagtctccacagtgccagtggcagatgggttgcatttgaagagtttctgcagcatggctgggcctaacctgatcgcaattgggtctagtgaatctgcacagaaggcccttaagatcatgcaacagatgagtgaccaccgctacgacaaactcactgtgcctgatgacatagcagcaaactgtatatatctaaatatccccaacaaagggcacgtcttgctgcaccgaaccccggaagagtatccagaaagtgcaaaggtttatgagaaactgaaggaccatatgctgatccccgtgagcatgtctgaactggaaaaggtggatgggctgctcacctgctgctcagttttaattaacaagaaagtagactcctgagctgcagagtcccccccggttgccggcaagaccgcacaggcaaggccgatgactctgtgcccactcctgttgttttccttgacaatctactgtgccactgtgctactaactcttgtttacaaaatttgattctaagttgaattgcttcattcaacacccccaccctccctcccctcgaggtggtacctaagctgtggatttgctaaatgaattaagcaacctagaagatacagagctaatgaattatcaaaatgtgattaatcccagtaaggaaacactcatttagtgtctgtatttttggtgtgaaaattatttagttgccagtatattctgaagaatgtcttcttgatcagtcagataagcttgctttttttttttttttttttcatgaatc

SEQ ID NO: 8363 - DNA, 1330 bp, Homo sapiens
cccgcttagacaatgccccggagccgccagaccgtcgcgcccctgccccatcgtagtatatgagctcgcctacacaaggacccgcgctaaaagccagagctcccagtccccgaggcttgaagacggggactcccttctccaccaactctgtcctcggggggtggggccccagccgagatcacagcgcgacaggagtgggggtggccgctggaggtgaagaaacaagaaaactaagaaatccgagcggttggagggggagtctgtgtggatgggatggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtcgatggagtccgcaaagccctgcaagacctggggctccgaattgtggaaataggagacgagaacgcgacgctggatggcactgacgttctcttcaccggccgggagtttttcgtaggcctctccaaatggaccaatcaccgaggagctgagatcgtggcggacacgttccgggacttcgccgtctccactgtgccagtctcgggtccctcccacctgcgcggtctctgcggcatggggggacctcgcactgttgtggcaggcagcagcgacgctgcccaaaaggctgtccgggcaatggcagtgctgacagatcacccatatgcctccctgaccctcccagatgacgcagctgctgactgtctctttcttcgtcctgggttgcctggtgtgccccctttcctcctgcaccgtggaggtggggatctgcccaacagccaggaggcactgcagaagctctctgatgtcaccctggtacctgtgtcctgctcagaactggagaaggctggcgccgggctcagctccctctgcttggtgctcagcacacgcccccacagctgagggcctggccttggggtactgctggccaggggtaggatagtataggaagtagaaggggaaggagggttagatagagaatgctgaataggcagtagttgggagagagcctcaatattgggggaggggagagtgtagggaaaaggatccactgggtgaatcctccctctcagaaccaataaaatagaattgaccttttaga

SEQ ID NO: 8364 - DNA, 1688 bp, Homo sapiens
atactaggtcgcgctaggggcagcgtgaccagccagggcggagagaggatgcttaactccttaggctcgaactcctcccttcctacccacctctctcccttctcgttcgggtattcaggacttccattccccagcccctgcctctccagctttctccttctgtcccataacccctgcgggtcgcgggctggacttccagtccctgcggtagcgagcagctgagggttaagggggcggggctgctgcatttttggggagtgagcgcatcctagtggctgccaagaggggcgcccgacagggacctcacaagcccccaagcaggggcaacaggtgttttggagattagagaccctagccttgttcctcaggctcctcttaaagaatctgacccctgagggtgctgggtagagtgaggtcgacaggagcggaaggtctggagtgggtggggcggagtgggagggacgcctagagatggcaggaggaagacctgggcgctcttaaccacccccaacgcccttgtctgcatgtctttttctctgtctcctccttttctgtttcttctcccagacaggtgaagaaacaagaaaactaagaaatccgagcggttggagggggagtctgtgtggatgggatggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtcgatggagtccgcaaagccctgcaagacctggggctccgaattgtggaaataggagacgagaacgcgacgctggatggcactgacgttctcttcaccggccgggagtttttcgtaggcctctccaaatggaccaatcaccgaggagctgagatcgtggcggacacgttccgggacttcgccgtctccactgtgccagtctcgggtccctcccacctgcgcggtctctgcggcatggggggacctcgcactgttgtggcaggcagcagcgacgctgcccaaaaggctgtccgggcaatggcagtgctgacagatcacccatatgcctccctgaccctcccagatgacgcagctgctgactgtctctttcttcgtcctgggttgcctggtgtgccccctttcctcctgcaccgtggaggtggggatctgcccaacagccaggaggcactgcagaagctctctgatgtcaccctggtacctgtgtcctgctcagaactggagaaggctggcgccgggctcagctccctctgcttggtgctcagcacacgcccccacagctgagggcctggccttggggtactgctggccaggggtaggatagtataggaagtagaaggggaaggagggttagatagagaatgctgaataggcagtagttgggagagagcctcaatattgggggaggggagagtgtagggaaaaggatccactgggtgaatcctccctctcagaaccaataaaatagaattgaccttttaga

SEQ ID NO: 8365 - DNA, 1688 bp, Homo sapiens
ataaaatacagaataaaaatcaagtgtttttacgcaatggggatttaaagtgtgggcgacatggaatgaggggtgggtcagtgatcttgagctcagggcagaagccaggaattaagaagggaaatgtttgtggtggggctgctatgtttcgtgccggtccgccggtccgccgttgcgctgttctgaggtctacgaagcgtttgcagccccgtcgccagggccggccagatctgggtgggcctgggcagcgctcgctgggcggtgccgatttctggcaaggggggcgcagtctggatgtaatgggcgaggcttagcagggcggaatgggcgtggcccgaagaagccccgccccgtcccgcttagacaatgccccggagccgccagaccgtcgcgcccctgccccatcgtagtatatgagctcgcctacacaaggacccgcgctaaaagccagagctcccagtccccgaggcttgaagacggggactcccttctccaccaactctgtcctcggggggtggggccccagccgagatcacagcgcgacaggagtgggggtggccgctggagacaggtgaagaaacaagaaaactaagaaatccgagcggttggagggggagtctgtgtggatgggatggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtcgatggagtccgcaaagccctgcaagacctggggctccgaattgtggaaataggagacgagaacgcgacgctggatggcactgacgttctcttcaccggccgggagtttttcgtaggcctctccaaatggaccaatcaccgaggagctgagatcgtggcggacacgttccgggacttcgccgtctccactgtgccagtctcgggtccctcccacctgcgcggtctctgcggcatggggggacctcgcactgttgtggcaggcagcagcgacgctgcccaaaaggctgtccgggcaatggcagtgctgacagatcacccatatgcctccctgaccctcccagatgacgcagctgctgactgtctctttcttcgtcctgggttgcctggtgtgccccctttcctcctgcaccgtggaggtggggatctgcccaacagccaggaggcactgcagaagctctctgatgtcaccctggtacctgtgtcctgctcagaactggagaaggctggcgccgggctcagctccctctgcttggtgctcagcacacgcccccacagctgagggcctggccttggggtactgctggccaggggtaggatagtataggaagtagaaggggaaggagggttagatagagaatgctgaataggcagtagttgggagagagcctcaatattgggggaggggagagtgtagggaaaaggatccactgggtgaatcctccctctcagaaccaataaaatagaattgaccttttaga

SEQ ID NO: 8366 - DNA, 1330 bp, Homo sapiens
cccgcttagacaatgccccggagccgccagaccgtcgcgcccctgccccatcgtagtatatgagctcgcctacacaaggacccccgctaaaagccagagctcccagtccccgaggcttgaagacggggactcccttctccaccaactctgtcctcggggggtggggccccagccgagatcacagcgcgacaggagtgggggtggccgctggaggtgaagaaacaagaaaactaagaaatccgagcggttggagggggagtctgtgtggatgggatggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtcgatggagtccgcaaagccctgcaagacctggggctccgaattgtggaaataggagacgagaacgcgacgctggatggcactgacgttctcttcaccggccgggagtttttcgtaggcctctccaaatggaccaatcaccgaggagctgagatcgtggcggacacgttccgggacttcgccgtctccactgtgccagtctcgggtccctcccacctgcgcggtctctgcggcatggggggacctcgcactgttgtggcaggcagcagcgacgctgcccaaaaggctgtccgggcaatggcagtgctgacagatcacccatatgcctccctgaccctcccagatgacgcagctgctgactgtctctttcttcgtcctgggttgcctggtgtgccccctttcctcctgcaccgtggaggtggggatctgcccaacagccaggaggcactgcagaagctctctgatgtcaccctggtacctgtgtcctgctcagaactggagaaggctggcgccgggctcagctccctctgcttggtgctcagcacacgcccccacagctgagggcctggccttggggtactgctggccaggggtaggatagtataggaagtagaaggggaaggagggttagatagagaatgctgaataggcagtagttgggagagagcctcaatattgggggaggggagagtgtagggaaaaggatccactgggtgaatcctccctctcagaaccaataaaatagaattgaccttttaga

SEQ ID NO: 8367 - DNA, 1688 bp, Homo sapiens
atactaggtcgtgctaggggcagcgtgaccagccagggcggagagaggatgcttaactccttaggctcgaactcctcccttcctacccacctctctcccttctcgttcgggtattcaggacttccattccccagcccctgcctctccagctttctccttctgtcccataacccctgcgggtcccgggctggacttccagtccctgcggtagcgagcagctgagggttaagggggcggggctgctgcatttttggggagtgagcgcatcctagtggctgccaagaggggcgcccgacagggacctcacaagcccccaagcaggggcaacaggtgttttggagattagagaccctagccttgttcctcaggctcctcttaaagaatctgacccctgagggtgctgggtagagtgaggtcgacaggagcggaaggtctggagtgggtggggcggagtgggagggacgcctagagatggcaggaggaagacctgggcgctcttaaccacccccaacgcccttgtctgcatgtctttttctctgtctcctccttttctgtttcttctcccagacaggtgaagaaacaagaaaactaagaaatccgagcggttggagggggagtctgtgtggatgggatggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtcgatggagtccgcaaagccctgcaagacctggggctccgaattgtggaaataggagacgagaacgcgacgctggatggcactgacgttctcttcaccggccgggagtttttcgtaggcctctccaaatggaccaatcaccgaggagctgagatcgtggcggacacgttccgggacttcgccgtctccactgtgccagtctcgggtccctcccacctgcgcggtctctgcggcatggggggacctcgcactgttgtggcaggcagcagcgacgctgcccaaaaggctgtccgggcaatggcagtgctgacagatcacccatatgcctccctgaccctcccagatgacgcagctgctgactgtctctttcttcgtcctgggttgcctggtgtgccccctttcctcctgcaccgtggaggtggggatctgcccaacagccaggaggcactgcagaagctctctgatgtcaccctggtacctgtgtcctgctcagaactggagaaggctggcgccgggctcagctccctctgcttggtgctcagcacacgcccccacagctgagggcctggccttggggtactgctggccaggggtaggatagtataggaagtagaaggggaaggagggttagatagagaatgctgaataggcagtagttgggagagagcctcaatattgggggaggggagagtgtagggaaaaggatccactgggtgaatcctccctctcagaaccaataaaatagaattgaccttttaga

SEQ ID NO: 8368 - DNA, 1688 bp, Homo sapiens
ataaaatacagaataaaaatcaagtgtttttacgcaatgggggtttaaagtgtgggcgacatggaatgaggggtgggtcagtgatcttgagctcagggcagaagccaggaattaagaagggaaatgtttgtggtggggctgctatgtttcgtgccggtccgccggtccgccgttgcgctgttctgaggtctacgaagcgtttgcagccccgtcgccagggccggccagatctgggtgggcctgggcagcgctcgctgggcggtgccgatttctggcaaggggggcgcagtctggatgtaatgggcgcggcttagcagggcggaatgggcgtggcccgaagaagccccgccccgtcccgcttagacaatgccccggagccgccagaccgtcgcgcccctgccccatcgtagtatatgagctcgcctacacaaggacccccgctaaaagccagagctcccagtccccgaggcttgaagacggggactcccttctccaccaactctgtcctcggggggtggggccccagccgagatcacagcgcgacaggagtgggggtggccgctggagacaggtgaagaaacaagaaaactaagaaatccgagcggttggagggggagtctgtgtggatgggatggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtcgatggagtccgcaaagccctgcaagacctggggctccgaattgtggaaataggagacgagaacgcgacgctggatggcactgacgttctcttcaccggccgggagtttttcgtaggcctctccaaatggaccaatcaccgaggagctgagatcgtggcggacacgttccgggacttcgccgtctccactgtgccagtctcgggtccctcccacctgcgcggtctctgcggcatggggggacctcgcactgttgtggcaggcagcagcgacgctgcccaaaaggctgtccgggcaatggcagtgctgacagatcacccatatgcctccctgaccctcccagatgacgcagctgctgactgtctctttcttcgtcctgggttgcctggtgtgccccctttcctcctgcaccgtggaggtggggatctgcccaacagccaggaggcactgcagaagctctctgatgtcaccctggtacctgtgtcctgctcagaactggagaaggctggcgccgggctcagctccctctgcttggtgctcagcacacgcccccacagctgagggcctggccttggggtactgctggccaggggtaggatagtataggaagtagaaggggaaggagggttagatagagaatgctgaataggcagtagttgggagagagcctcaatattgggggaggggagagtgtagggaaaaggatccactgggtgaatcctccctctcagaaccaataaaatagaattgaccttttaga

SEQ ID NO: 8369 - DNA, 1688 bp, Homo sapiens; identical to SEQ ID NO: 8368

SEQ ID NO: 8370 - DNA, 724 bp, Homo sapiens
tcgtaggccagaggtcgatggagtccgcaaagccctgcaagacctggggctccgaattgtggaaataggagacgagaacgcgacgctggatggcactgacgttctcttcaccggccgggagtttttcgtaggcctctccaaatggaccaatcaccgaggagctgagatcgtggcggacacgttccgggacttcgccgtctccactgtgccagtctcgggtccctcccacctgcgcggtctctgcggcatggggggacctcgcactgttgtggcaggcagcagcgacgctgcccaaaaggctgtccggatgacgcagctgctgactgtctctttcttcgtcctgggttgcctggtgtgccccctttcctcctgcaccgtggaggtggggatctgcccaacagccaggaggcactgcagaagctctctgatgtcaccctggtacctgtgtcctgctcagaactggagaaggctggcgccgggctcagctccctctgcttggtgctcagcacacgcccccacagctgagggcctggccttggggtactgctggccaggggtaggatagtataggaagtagaaggggaaggagggttagatagagaatgctgaataggcagtagttgggagagagcctcaatattgggggaggggagagtgtagggaaaaggatccactgggtgaatcctccctctcagaaccaataaaatagaattgaccttttaga

SEQ ID NO: 8371 - DNA, 724 bp, Homo sapiens; identical to SEQ ID NO: 8370

SEQ ID NO: 8372 - DNA, 1330 bp, Homo sapiens; identical to SEQ ID NO: 8366

SEQ ID NO: 8373 - DNA, 1688 bp, Homo sapiens; identical to SEQ ID NO: 8364

SEQ ID NO: 8374 - DNA, 1688 bp, Homo sapiens; identical to SEQ ID NO: 8364

SEQ ID NO: 8375 - DNA, 887 bp, Homo sapiens
gtttatactaggtcgcgctaggggcagcgtgaccagccagggcggagagaggatgcttaactccttaggctcgaactcctcccttcctacccacctctctcccttctcgttcggacaggtgaagaaacaagaaaactaagaaatccgagcggttggagggggagtctgtgtggatgggatggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtcgatggagtccgcaaagccctgcaagacctggggctccgaattgtggaaataggagacgagaacgcgacgctggatggcactgacgttctcttcaccggccgggagtttttcgtaggcctctccaaatggaccaatcaccgaggagctgagatcgtggcggacacgttccgggacttcgccgtctccactgtgccagtctcgggtccctcccacctgcgcggtctctgcggcatggggggacctcgcactgttgtggcaggcagcagcgacgctgcccaaaaggctgtccgggcaatggcagtgctgacagatcacccatatgcctccctgaccctcccagatgacgcagctgctgactgtctctttcttcgtcctgggttgcctggtgtgccccctttcctcctgcacc

SEQ ID NO: 8376 - DNA, 882 bp, Homo sapiens
ccgacagggacctcacaagcccccaagcaggggcaacaggtgttttggagattagagaccctagccttgttcctcaggctcctcttaaagaatctgacccctgagggtgctgggtagagtgaggtcgacaggagcggaagacaggtgaagaaacaagaaaactaagaaatccgagcggttggagggggagtctgtgtggatgggatggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtcgatggagtccgcaaagccctgcaagacctggggctccgaattgtggaaataggagacgagaacgcgacgctggatggcactgacgttctcttcaccggccgggagtttttcgtaggcctctccaaatggaccaatcaccgaggagctgagatcgtggcggacacgttccgggacttcgccgtctccactgtgccagtctcgggtccctcccacctgcgcggtctctgcggcatggggggacctcgcactgttgtggcaggcagcagcgacgctgcccaaaaggctgtccgggcaatggcagtgctgacagatcacccatatgcctccctgaccctcccagatgacgcagctgctgactgtctctttcttcgtcctggg

SEQ ID NO: 8377 - DNA, 887 bp, Homo sapiens; identical to SEQ ID NO: 8375

SEQ ID NO: 8378 - DNA, 1330 bp, Homo sapiens; identical to SEQ ID NO: 8366

SEQ ID NO: 8379 - DNA, 1330 bp, Homo sapiens; identical to SEQ ID NO: 8366

SEQ ID NO: 8380 - DNA, 1688 bp, Homo sapiens; identical to SEQ ID NO: 8364

SEQ ID NO: 8381 - DNA, 882 bp, Homo sapiens; identical to SEQ ID NO: 8376

SEQ ID NO: 8382 - DNA, 1330 bp, Homo sapiens; identical to SEQ ID NO: 8366

SEQ ID NO: 8383 - DNA, 882 bp, Homo sapiens; identical to SEQ ID NO: 8376

SEQ ID NO: 8384 - DNA, 882 bp, Homo sapiens; identical to SEQ ID NO: 8376

SEQ ID NO: 8385 - DNA, 1688 bp, Homo sapiens
ataaaatacagaataaaaatcaagtgtttttacgcaatgggggtttaaagtgtgggcgacatggaatgaggggtgggtcagtgatcttgagctcagggcagaagccaggaattaagaagggaaatgtttgtggtggggctgctatgtttcgtgccggtccgccggtccgccgttgcgctgttctgaggtctacgaagcgtttgcagccccgtcgccagggccggccagatctgggtgggcctgggcagcgctcgctgggcggtgccgatttctggcaaggggggcgcagtctggatgtaatgggcgaggcttagcagggcggaatgggcgtggcccgaagaagccccgccccgtcccgcttagacaatgccccggagccgccagaccgtcgcgcccctgccccatcgtagtatatgagctcgcctacacaaggacccccgctaaaagccagagctcccagtccccgaggcttgaagacggggactcccttctccaccaactctgtcctcggggggtggggccccagccgagatcacagcgcgacaggagtgggggtggccgctggagacaggtgaagaaacaagaaaactaagaaatccgagcggttggagggggagtctgtgtggatgggatggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtcgatggagtccgcaaagccctgcaagacctggggctccgaattgtggaaataggagacgagaacgcgacgctggatggcactgacgttctcttcaccggccgggagtttttcgtaggcctctccaaatggaccaatcaccgaggagctgagatcgtggcggacacgttccgggacttcgccgtctccactgtgccagtctcgggtccctcccacctgcgcggtctctgcggcatggggggacctcgcactgttgtggcaggcagcagcgacgctgcccaaaaggctgtccgggcaatggcagtgctgacagatcacccatatgcctccctgaccctcccagatgacgcagctgctgactgtctctttcttcgtcctgggttgcctggtgtgccccctttcctcctgcaccgtggaggtggggatctgcccaacagccaggaggcactgcagaagctctctgatgtcaccctggtacctgtgtcctgctcagaactggagaaggctggcgccgggctcagctccctctgcttggtgctcagcacacgcccccacagctgagggcctggccttggggtactgctggccaggggtaggatagtataggaagtagaaggggaaggagggttagatagagaatgctgaataggcagtagttgggagagagcctcaatattgggggaggggagagtgtagggaaaaggatccactgggtgaatcctccctctcagaaccaataaaatagaattgaccttttaga

SEQ ID NO: 8386 - DNA, 882 bp, Homo sapiens; identical to SEQ ID NO: 8376

SEQ ID NO: 8387 - DNA, 724 bp, Homo sapiens; identical to SEQ ID NO: 8370

SEQ ID NO: 8388 - DNA, 724 bp, Homo sapiens; identical to SEQ ID NO: 8370

SEQ ID NO: 8389 - DNA, 882 bp, Homo sapiens; identical to SEQ ID NO: 8376

SEQ ID NO: 8390 - DNA, 1688 bp, Homo sapiens
ataaaatacagaataaaaatcaagtgtttttacgcaatggggatttaaagtgtgggcgacatggaatgaggggtgggtcagtgatcttgagctcagggcagaagccaggaattaagaagggaaatgtttgtggtggggctgctatgtttcgtgccggtccgccggtccgccgttgcgctgttctgaggtctacgaagcgtttgcagccccgtcgccagggccggccagatctgggtgggcctgggcagcgctcgctgggcggtgccgatttctggcaaggggggcgcagtctggatgtaatgggcgaggcttagcagggcggaatgggcgtggcccgaagaagccccgccccgtcccgcttagacaatgccccggagccgccagaccgtcgcgcccctgccccatcgtagtatatgagctcgcctacacaaggacccccgctaaaagccagagctcccagtccccgaggcttgaagacggggactcccttctccaccaactctgtcctcggggggtggggccccagccgagatcacagcgcgacaggagtgggggtggccgctggagacaggtgaagaaacaagaaaactaagaaatccgagcggttggagggggagtctgtgtggatgggatggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtcgatggagtccgcaaagccctgcaagacctggggctccgaattgtggaaataggagacgagaacgcgacgctggatggcactgacgttctcttcaccggccgggagtttttcgtaggcctctccaaatggaccaatcaccgaggagctgagatcgtggcggacacgttccgggacttcgccgtctccactgtgccagtctcgggtccctcccacctgcgcggtctctgcggcatggggggacctcgcactgttgtggcaggcagcagcgacgctgcccaaaaggctgtccgggcaatggcagtgctgacagatcacccatatgcctccctgaccctcccagatgacgcagctgctgactgtctctttcttcgtcctgggttgcctggtgtgccccctttcctcctgcaccgtggaggtggggatctgcccaacagccaggaggcactgcagaagctctctgatgtcaccctggtacctgtgtcctgctcagaactggagaaggctggcgccgggctcagctccctctgcttggtgctcagcacacgcccccacagctgagggcctggccttggggtactgctggccaggggtaggatagtataggaagtagaaggggaaggagggttagatagagaatgctgaataggcagtagttgggagagagcctcaatattgggggaggggagagtgtagggaaaaggatccactgggtgaatcctccctctcagaaccaataaaatagaattgaccttttaga

SEQ ID NO: 8391 - DNA, 887 bp, Homo sapiens
gtttatactaggtcgtgctaggggcagcgtgaccagccagggcggagagaggatgcttaactccttaggctcgaactcctcccttcctacccacctctctcccttctcgttcggacaggtgaagaaacaagaaaactaagaaatccgagcggttggagggggagtctgtgtggatgggatggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtcgatggagtccgcaaagccctgcaagacctggggctccgaattgtggaaataggagacgagaacgcgacgctggatggcactgacgttctcttcaccggccgggagtttttcgtaggcctctccaaatggaccaatcaccgaggagctgagatcgtggcggacacgttccgggacttcgccgtctccactgtgccagtctcgggtccctcccacctgcgcggtctctgcggcatggggggacctcgcactgttgtggcaggcagcagcgacgctgcccaaaaggctgtccgggcaatggcagtgctgacagatcacccatatgcctccctgaccctcccagatgacgcagctgctgactgtctctttcttcgtcctgggttgcctggtgtgccccctttcctcctgcacc

SEQ ID NO: 8392 - DNA, 887 bp, Homo sapiens; identical to SEQ ID NO: 8375

SEQ ID NO: 8393 - DNA, 1688 bp, Homo sapiens; identical to SEQ ID NO: 8367

SEQ ID NO: 8394 - DNA, 880 bp, Homo sapiens
ccgacagggacctcacaagcccccaagcaggggcaacaggtgttttggagattagagaccctagccttgttcctcaggctcctcttaaagaatctgacccctgagggtgctgggtagagtgaggtcgacaggagcggaagacaggtgaagaaacaagaaaactaagaaatccgagcggttggagggggagtctgtgtggatgggatggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtcgatggagtccgcaaagccctgcaagacctggggctccgaattgtggaaataggagacgagaacgcgacgctggatggcactgacgttctcttcaccggccgggagtttttcgtaggcctctccaaatggaccaatcaccgaggagctgagatcgtggcggacacgttccgggacttcgccgtctccactgtgccagtctcgggtccctcccacctgcgcggtctctgcggcatggggggacctcgcactgttgtggcaggcagcagcgacgctgcccaaaaggctgtccgggcaatggcagtgctgacagatcacccatatgcctccctgaccctcccagatgacgcagctgctgactgtctctttcttcgtcctg

SEQ ID NO: 8395 - DNA, 1330 bp, Homo sapiens; identical to SEQ ID NO: 8366

SEQ ID NO: 8396 - DNA, 724 bp, Homo sapiens; identical to SEQ ID NO: 8370

SEQ ID NO: 8397 - DNA, 724 bp, Homo sapiens; identical to SEQ ID NO: 8370

SEQ ID NO: 8398 - DNA, 1688 bp, Homo sapiens; identical to SEQ ID NO: 8385

SEQ ID NO: 8399 - DNA, 887 bp, Homo sapiens; identical to SEQ ID NO: 8375

SEQ ID NO: 8400 - DNA, 724 bp, Homo sapiens; identical to SEQ ID NO: 8370

SEQ ID NO: 8401 - DNA, 1688 bp, Homo sapiens; identical to SEQ ID NO: 8364

SEQ ID NO: 8402 - DNA, 1688 bp, Homo sapiens; identical to SEQ ID NO: 8385

SEQ ID NO: 8403 - DNA, 887 bp, Homo sapiens; identical to SEQ ID NO: 8391

SEQ ID NO: 8404 - DNA, 887 bp, Homo sapiens; identical to SEQ ID NO: 8375

SEQ ID NO: 8405 - DNA, 3097 bp, Homo sapiens
gcgcctgcgccctcggcctcggcctagtcatgctccgtcccggcgcgcagctgctgcggggcctcctgctgcggagctgcccgctgcagggctcccccgggcgcccgcgctctgtctgcggccgggaaggagaggaaaaaccacccttatctgcagaaacacaatggaaagacagagcagaaacagtgataattggaggtggctgtgttggtgtgagtctggcttatcacctggccaaagcagggatgaaagatgtggtcctgctggagaaatcagagctcacggctggatctacctggcacgcagcaggtttaacaacttactttcatcctggaataaacttgaagaaaatacattatgatagcatcaaactttatgagaaactggaagaagaaactggtcaggtggtgggattccatcagccaggtagtatcagacttgctaccacccctgtaagggtagatgaatttaaatatcaaatgactcggactggctggcatgcaacagaacagtatctcattgaacctgaaaaaattcaagagatgttccctttactcaacatgaataaggttttagctggattgtataatcctggagatggtcacattgatccttattctctaactatggcactggctgctggggctaggaaatgtggtgcccttttaaaatatcctgcaccagtaacttctctgaaagccaggtcagatggaacatgggacgttgaaacaccacaggggtctatgagagcaaatagaattgtgaatgctgcaggattttgggctcgtgaagtaggtaaaatgattggactagaacatcctctcattccggttcaacatcaatatgttgttacatcgactatatctgaagtgaaagctttgaaacgagaactgcctgtgctccgtgacctggaaggatcatattatctccgacaggaaagggatgggcttttgtttggtccatatgaaagtcaagagaaaatgaaagttcaggactcctgggtcaccaatggagttcctccaggttttggaaaggaactctttgagtctgatctagatcgaatcatggaacacatcaaagctgccatggaaatggttcctgtcttgaaaaaggctgacatcatcaatgttgtcaatggtcctatcacgtattctcctgacattctgcctatggtggggccccatcagggggtcagaaactactgggtggctataggctttggatatggcataatccacgctggtggggtagggaaatatctcagtgactggatcctgcatggagaacctccttttgatctgatagaattggatcctaatcgctatggcaaatggacaacaacccagtacactgaggccaaagcaagagaatcatatggattcaacaatattgttggttatcctaaagaagaacggtttgctgggaggccgactcaacgagtcagtgggctctatcaaaggctggagtctaagtgttccatggggttccatgctggctgggagcagccgcactggttctacaaaccaggccaggacactcagtacaggccaagttttcgccgcacaaactggtttgagcctgtgggctcggagtataaacaggttatgcaaagagtagcggtaactgacctatcaccatttggcaagtttaacatcaaaggccaagattccattagactactggaccatctctttgcaaatgtcattccaaaggtgggttttacaaatataagtcacatgttaacacccaagggtcgagtgtatgctgagctgactgtttctcaccaatctcctggggagtttcttttaattactggctctggatcagaacttcatgatcttagatggattgaagaagaagcagtcaaaggtggatatgatgttgaaattaaaaacataactgatgagcttggagttcttggagttgctgggccacaggcaagaaaggtccttcagaaactgacctctgaagatcttagtgatgatgttttcaagtttcttcaaaccaagtccttaaaggtttccaacattcctgtcactgctattaggatatcttatactggtgagctgggttgggagctgtatcacagaagagaagattctgtggcgctgtatgacgctatcatgaatgcaggccaggaggagggaatcgacaattttggaacctatgccatgaatgccttacgcctggagaaagccttcagagcctgggggttagagatgaactgtgatacaaatcctttggaagctggactggaatattttgtgaagttaaataagccagcagacttcataggaaagcaagcactgaaacagattaaagccaaggggctgaaacgaagactggtctgcctcaccttggcaacggatgatgttgatccagagggaaatgaaagcatctggtacaatggcaaggtggttggcaacacgacatctggaagctatagctacagcatccagaagagtctggctttcgcatatgtccctgtacaactaagtgaagtgggacagcaagtggaagttgaactattaggcaaaaattacccagcagtcatcatacaagaacctttggtattgaccgaaccaaccagaaaccggcttcagaaaaaaggtggaaaggacaaaacttgaaaaaagaccttcagcagtcaactgaattagagttgctaatgactgtccttgaaattattataactggctcccaggggaatagaggaaaccaggaattcatttcaaaatcatcaaagtctaaatttagaatcttaatgaaacctttctgttaagtgttttctaagcaagacagaataatagataaatgatttacattgttcttttaaatgaagaaatttgaaatgaatgtttttttatttaccccacattacccaatcagtaaaacatttaggtgtttgctaatatacacaatcattactataacctaattaagggacattttataattttagtaacaaatgcattcggttcttgacagctgaaaacaaattaataaattatcttttacataaaaacatgtacaatattgtttatggatttacttctttgagaaatctttccttagatgaataaatgaaagttttaat

SEQ ID NO: 8406 - DNA, 1966 bp, Homo sapiens
ggcctagtcatgctccgtcccggcgcgcagctgctgcggggcctcctgctgcggagctgcccgctgcagggctcccccgggcgcccgcgctctgtctgcggccgggaaggagaggaaaaaccacccttatctgcagaaacacaatggaaagacagagcagaaacagtgataattggaggtggctgtgttggtgtgagtctggcttatcacctggccaaagcagggatgaaagatgtggtcctgctggagaaatcagagctcacggctggatctacctggcacgcagattttgggctcgtgaagtaggtaaaatgattggactagaacatcctctcattccggttcaacatcaatatgttgttacatcgactatatctgaagtgaaagctttgaaacgagaactgcctgtgctccgtgacctggaaggatcatattatctccgacaggaaagggatgggcttttgtttggtccatatgaaagtcaagagaaaatgaaagttcaggactcctgggtcaccaatggagttcctccaggttttggaaaggaactctttgagtctgatctagatcgaatcatggaacacatcaaagctgccatggaaatggttcctgtcttgaaaaaggctgacatcatcaatgttgtcaatggtcctatcacgtattctcctgacattctgcctatggtggggccccatcagggggtcagaaactactgggtggctataggctttggatatggcataatccacgctggtggggtagggaaatatctcagtgactggatcctgcatggagaacctccttttgatctgatagaattggatcctaatcgctatggcaaatggacaacaacccagtacactgaggccaaagcaagagaatcatatggattcaacaatattgttggttatcctaaagaagaacggtttgctgggaggccgactcaacgagtcagtgggctctatcaaaggctggagtctaagtgttccatggggttccatgctggctgggagcagccgcactggttctacaaaccaggccaggacactcagtacaggccaagttttcgccgcacaaactggtttgagcctgtgggctcggagtataaacaggttatgcaaagagtagcggtaactgacctatcaccatttggcaagtttaacatcaaaggccaagattccattagactactggaccatctctttgcaaatgtcattccaaaggtgggttttacaaatataagtcacatgttaacacccaagggtcgagtgtatgctgagctgactgtttctcaccaatctcctggggagtttcttttaattactggctctggatcagaacttcatgatcttagatggattgaagaagaagcagtcaaaggtggatatgatgttgaaattaaaaacataactgatgagcttggagttcttggagttgctgggccacaggcaagaaaggtccttcagaaactgacctctgaagatcttagtgatgatgttttcaagtttcttcaaaccaagtccttaaaggtttccaacattcctgtcactgctattaggatatcttatactggtgagctgggttgggagctgtatcacagaagagaagattctgtggcgctgtatgacgctatcatgaatgcaggccaggaggagggaatcgacaattttggaacctatgccatgaatgccttacgcctggagaaagccttcagagcctgggggttagagatgaactgtgatacaaatcctttggaagctggactggaatattttgtgaagttaaataaggatcagaatagctgctttgcccattttaaggaggaaaatggctgggtgagcagatgggccatcaggccttattagggtgaatcgtgttcttgtcaaaacctgtcagcaagtagggaaaagaacaatggagtactgaagaactctttcatcacaaagggagacggcgcagtggccct

SEQ ID NO: 8407 - DNA, 2777 bp, Homo sapiens
tatctcattgaacctgaaaaaattcaagagatgttccctttactcaacatgaataaggttttagctggattgtataatcctggagatggtcacattgatccttattctctaactatggcactggctgctggggctaggaaatgtggtgcccttttaaaatatcctgcaccagtaacttctctgaaagccaggtcagatggaacatgggacgttgaaacaccacaggggtctatgagagcaaatagaattgtgaatgctgcaggattttgggctcgtgaagtaggtaaaatgattggactagaacatcctctcattccggttcaacatcaatatgttgttacatcgactatatctgaagtgaaagctttgaaacgagaactgcctgtgctccgtgacctggaaggatcatattatctccgacaggaaagggatgggcttttgtttggtccatatgaaagtcaagagaaaatgaaagttcaggactcctgggtcaccaatggagttcctccaggttttggaaaggaactctttgagtctgatctagatcgaatcatggaacacatcaaagctgccatggaaatggttcctgtcttgaaaaaggctgacatcatcaatgttgtcaatggtcctatcacgtattctcctgacattctgcctatggtggggccccatcagggggtcagaaactactgggtggctataggctttggatatggcataatccacgctggtggggtagggaaatatctcagtgactggatcctgcatggagaacctccttttgatctgatagaattggatcctaatcgctatggcaaatggacaacaacccagtacactgaggccaaagcaagagaatcatatggattcaacaatattgttggttatcctaaagaagaacggtttgctgggaggccgactcaacgagtcagtgggctctatcaaaggctggagtctaagtgttccatggggttccatgctggctgggagcagccgcactggttctacaaaccaggccaggacactcagtacaggccaagttttcgccgcacaaactggtttgagcctgtgggctcggagtataaacaggttatgcaaagagtagcggtaactgacctatcaccatttggcaagtttaacatcaaaggccaagattccattagactactggaccatctctttgcaaatgtcattccaaaggtgggttttacaaatataagtcacatgttaacacccaagggtcgagtgtatgctgagctgactgtttctcaccaatctcctggggagtttcttttaattactggctctggatcagaacttcatgatcttagatggattgaagaagaagcagtcaaaggtggatatgatgttgaaattaaaaacataactgatgagcttggagttcttggagttgctgggccacaggcaagaaaggtccttcagaaactgacctctgaagatcttagtgatgatgttttcaagtttcttcaaaccaagtccttaaaggtttccaacattcctgtcactgctattaggatatcttatactggtgagctgggttgggagctgtatcacagaagagaagattctgtggcgctgtatgacgctatcatgaatgcaggccaggaggagggaatcgacaattttggaacctatgccatgaatgccttacgcctggagaaagccttcagagcctgggggttagagatgaactgtgatacaaatcctttggaagctggactggaatattttgtgaagttaaataaggatcagaatagctgctttgcccattttaaggaggaaaatggctgggtgagcagatgggccatcaggccttattagggtgaatcgtgttcttgtcaaaacctgtcagcaagtagggaaaagaacaatggagtactgaagaactctttcatcacaaagggagacggcgcagtggcccttgcttccttccgtcttggagttgttccagcctccttcccctgctgttggcttatgtgaagttgatacacatgtatcattcattcatccgttcatctagtagacatttattaagtaccgctgattagacaccttgctaacccatagatctaaatgttaaagatatactcctgatggctctcagatctcatgaacctggaaacaaataatatttcaggaactaaagctgtagggatacgttcttagccgtaattgtgaagataacccttccgcaagtggagggctctccagccgcatacaacactgccatcttgtgggaagtgctccgtagagccacttcaggaagccttgaccaaagctgcggtaaaaataattgaatctgtacttttaaaatcttcttaactaaaaacgcttcacctgaaacgactcatatcattgttctcaatggtatttttggtatgttccaaaggaagtaacttttgggaggaaaatcagtagcctttgtttagttggagatggaagaaatgcattaatcaagagcaaaaggaaaatcagctgcctttggatggagtcataggcattcctggaattttcatggtggaaatattgaatttttgtccatttctggagaacctccacgaagattcacagagactcaagtattaaacgtaatgtgttgaagcacatcagaagaatttgttttctataatatgtttctccctctttttctcactctctccttctccctctctttccctttttctctctccttcccctctctccccgtgtagagcttctaactagtagaaacagaataaaatgtaatctctattaaa

SEQ ID NO: 8408 - DNA, 2331 bp, Homo sapiens
ctagtcatgctccgtcccggcgcgcagctgctgcggggcctcctgctgcggagctgcccgctgcagggctcccccgggcgcccgcgctctgtctgcggccgggaaggagaggaaaaaccacccttatctgcagaaacacaatggaaagacagagcagaaacagtgataattggaggtggctgtgttggtgtgagtctggcttatcacctggccaaagcagggatgaaagatgtggtcctgctggagaaatcagagctcacggctggatctacctggcacgcagcaggtttaacaacttactttcatcctggaataaacttgaagaaaatacattatgatagcatcaaactttatgagaaactggaagaagaaactggtcaggtggtgggattccatcagccaggtagtatcagacttgctaccacccctgtaagggtagatgaatttaaatatcaaatgactcggactggctggcatgcaacagaacagtatctcattgaacctgaaaaaattcaagagatgttccctttactcaacatgaataaggttttagctggattgtataatcctggagatggtcacattgatccttattctctaactatggcactggctgctggggctaggaaatgtggtgcccttttaaaatatcctgcaccagtaacttctctgaaagccaggtcagatggaacatgggacgttgaaacaccacaggggtctatgagagcaaatagaattgtgaatgctgcaggattttgggctcgtgaagtaggtaaaatgattggactagaacatcctctcattccggttcaacatcaatatgttgttacatcgactatatctgaagtgaaagctttgaaacgagaactgcctgtgctccgtgacctggaaggatcatattatctccgacaggaaagggatgggcttttgtttggtccatatgaaagtcaagagaaaatgaaagttcaggactcctgggtcaccaatggagttcctccaggttttggaaaggaactctttgagtctgatctagatcgaatcatggaacacatcaaagctgccatggaaatggttcctgtcttgaaaaaggctgacatcatcaatgttgtcaatggtcctatcacgtattctcctgacattctgcctatggtggggccccatcagggggtcagaaactactgggtggctataggctttggatatggcataatccacgctggtggggtagggaaatatctcagtgactggatcctgcatggagaacctccttttgatctgatagaattggatcctaatcgctatggcaaatggacaacaacccagtacactgaggccaaagcaagagaatcatatggattcaacaatattgttggttatcctaaagaagaacggtttgctgggaggccgactcaacgagtcagtgggctctatcaaaggctggagtctaagtgttccatggggttccatgctggctgggagcagccgcactggttctacaaaccaggccaggacactcagtacaggccaagttttcgccgcacaaactggtttgagcctgtgggctcggagtataaacaggttatgcaaagagtagcggtaactgacctatcaccatttggcaagtttaacatcaaaggccaagattccattagactactggaccatctctttgcaaatgtcattccaaaggtgggttttacaaatataagtcacatgttaacacccaagggtcgagtgtatgctgagctgactgtttctcaccaatctcctggggagtttcttttaattactggctctggatcagaacttcatgatcttagatggattgaagaagaagcagtcaaaggtggatatgatgttgaaattaaaaacataactgatgagcttggagttcttggagttgctgggccacaggcaagaaaggtccttcagaaactgacctctgaagatcttagtgatgatgttttcaagtttcttcaaaccaagtccttaaaggtttccaacattcctgtcactgctattaggatatcttatactggtgagctgggttgggagctgtatcacagaagagaagattctgtggcgctgtatgacgctatcatgaatgcaggccaggaggagggaatcgacaattttggaacctatgccatgaatgccttacgcctggagaaagccttcagagcctgggggttagagatgaactgtgatacaaatcctttggaagctggactggaatattttgtgaagttaaataaggatcagaatagctgctttgcccattttaaggaggaaaatggctgggtgagcagatgggccatcaggccttattag

SEQ ID NO: 8409 - DNA, 1517 bp, Homo sapiens
ggcctagtcatgctccgtcccggcgcgcagctgctgcggggcctcctgctgcggagctgcccgctgcagggctcccccgggcgcccgcgctctgtctgcggccgggaaggagaggaaaaaccacccttatctgcagaaacacaatggaaagacagagcagaaacagtgataattggaggtggctgtgttggtgtgagtctggcttatcacctggccaaagcagggatgaaagatgtggtcctgctggagaaatcagagctcacggctggatctacctggcacgcaatatggcataatccacgctggtggggtagggaaatatctcagtgactggatcctgcatggagaacctccttttgatctgatagaattggatcctaatcgctatggcaaatggacaacaacccagtacactgaggccaaagcaagagaatcatatggattcaacaatattgttggttatcctaaagaagaacggtttgctgggaggccgactcaacgagtcagtgggctctatcaaaggctggagtctaagtgttccatggggttccatgctggctgggagcagccgcactggttctacaaaccaggccaggacactcagtacaggccaagttttcgccgcacaaactggtttgagcctgtgggctcggagtataaacaggttatgcaaagagtagcggtaactgacctatcaccatttggcaagtttaacatcaaaggccaagattccattagactactggaccatctctttgcaaatgtcattccaaaggtgggttttacaaatataagtcacatgttaacacccaagggtcgagtgtatgctgagctgactgtttctcaccaatctcctggggagtttcttttaattactggctctggatcagaacttcatgatcttagatggattgaagaagaagcagtcaaaggtggatatgatgttgaaattaaaaacataactgatgagcttggagttcttggagttgctgggccacaggcaagaaaggtccttcagaaactgacctctgaagatcttagtgatgatgttttcaagtttcttcaaaccaagtccttaaaggtttccaacattcctgtcactgctattaggatatcttatactggtgagctgggttgggagctgtatcacagaagagaagattctgtggcgctgtatgacgctatcatgaatgcaggccaggaggagggaatcgacaattttggaacctatgccatgaatgccttacgcctggagaaagccttcagagcctgggggttagagatgaactgtgatacaaatcctttggaagctggactggaatattttgtgaagttaaataaggatcagaatagctgctttgcccattttaaggaggaaaatggctgggtgagcagatgggccatcaggccttattagggtgaatcgtgttcttgtcaaaacctgtcagcaagtagggaaaagaacaatggagtactgaagaactctttcatcacaaagggagacggcgcagtggccc

SEQ ID NO: 8410 - DNA, 8593 bp, Homo sapiens
tcttgtcttccggagtgtggctggcggagctgggatggcggaacgaggcctggagccgtcgccggccgcggtggcggcgctgccgcctgaagtgcgggcgcagctggcggagctggagctggagctctcggagggggacatcacccagaagggctatgaaaagaaaaggtccaaactcctatctccttacagcccgcagacacaagaaactgattcagcagtacagaaagaacttagaaaccagacacctgctccatctgcagctcaaacttctgctccctctaagtaccaccgaactcgatctgggggagccagggatgaacgatatcgatcagatatccacacagaagcagttcaggctgcactggcaaagcataaagaacagaagatggctttgcccatgccaaccaaaaggcgatccacatttgttcagtctcctgcagatgcctgcacacctcctgacacatcttcggcctctgaggatgagggctctctgagacgccaagctgcgctctctgctgccttgcaacagagcttacagaatgctgagtcctggatcaaccgttcaattcagggatcgtccacttcttcatccgcatcttctacgctgtcccacggagaggtcaaaggaaccagtgggtctctagctgatgtatttgccaatactcgaatagagaatttctctgctcctcctgatgtcactacaactacctcttcctcctcatcatcttcctcaattcgcccagcaaacattgacctgcccccctcggggatagttaaaggcatgcacaaaggatccaacaggtccagccttatggatacagctgatggtgttcctgtcagtagcagagtatctacaaaaatccagcagcttctgaacactctgaaacgacccaaaaggcctcccttaaaggaattttttgtggatgactctgaagaaattgtggaagtacctcagccagaccccaaccagcccaagccggagggacggcagatgacccctgtgaaaggagagcctttaggagtcatctgtaactggcctcctgctcttgaatctgccctgcagcgctggggtaccactcaagcaaaatgctcctgtctgactgcactggacatgacagggaaaccagtttacactcttacatatggaaagttgtggagcagaagtttaaagttggcctacacacttcttaataaactggggaccaaaaatgaacctgtgttaaaacctggagacagggtagccctggtttaccccaacaatgatccagtcatgtttatggtggctttctatggatgcctcctggcagaagtgattccagtgcctatagaggtacctcttaccagaaaggatgctggaggtcagcagattggcttcttgctaggaagctgtggtattgccttagctcttaccagtgaagtttgtctaaaaggactgccaaaaacccagaatggagaaattgtacagtttaaaggttggccccggctcaaatgggttgtaacagattccaagtacctttcaaagccaccgaaagactggcagccacacatctcacctgctgggacagaaccggcatacattgagtataaaacaagcaaagaagggagtgtaatgggagttacagtatcccggcttgcaatgttgtctcactgccaagctctgtcgcaggcctgcaattattctgaaggggaaacaatagtaaatgtcttagactttaagaaggatgctgggctgtggcacggcatgtttgcgaatgtaatgaataagatgcacacaatcagcgtaccctactctgttatgaaaacctgtcctctctcttgggtccaaagagtacatgctcacaaagccaaggtagctttagtaaaatgtcgggacttgcactgggctatgatggcacatcgggaccaaagagacgtgagcttgagttccctccgaatgttaattgtgactgatggagctaacccctggtccgtgtcatcctgtgatgccttcctgagtctgttccaaagtcatggactgaagcctgaggccatctgtccgtgcgccacgtctgctgaagccatgactgtagcaatccgcaggcctggagttccaggagcccctttgccaggaagagccattctctcaatgaatggattgagctatggggtaatacgggtcaatactgaagataaaaattcagcactgacggtccaggatgtagggcatgtaatgcctggtgggatgatgtgcattgtgaaaccagatggacctccccagctctgcaaaacagatgaaattggagaaatctgtgttagctccagaactggaggcatgatgtactttgggcttgctggtgtgacaaaaaatacatttgaggtaattccagtgaattctgcaggctctcctgttggggatgtgccattcatccgatcaggattgctggggtttgtagggccgggtagtttggtgttcgtggttgggaaaatggatggcttactgatggttagtggtcgaagacataatgctgatgacattgttgctactggattggctgtagaatcaataaagactgtttatagaggaagaattgctgtgttttctgtgtctgtattttatgatgagcgcattgtggtggttgcggaacaaagacctgatgcttctgaggaagatagtttccagtggatgagccgcgtgctgcaggcgatcgatagcattcatcaagtgggggtttattgtcttgctctggtgccagccaatacattgccaaaaactccactaggaggaatccatatatctcagacgaaacaactctttctggagggatcactgcatccttgcaacatcctcatgtgcccccatacatgtgtgacaaacttgccaaagccccggcaaaaacaaccaggtgtaggccctgcttccgtgatggttgggaatctggttgctggaaaacgtatagcacaagctgctggaagggatctgggacaaatagaagagaatgatttggtgaggaagcaccagtttctggcagagatcctacagtggcgagcccaggcgactcctgaccatgtactcttcatgctgttaaatgccaagggaaccactgtatgcacagccagctgccttcagcttcataagcgagcagagaggattgcatctgttcttggtgataagggacatctaaatgcaggagataatgtggtgttgctctatccacctggcattgagttaatcgccgccttctatggctgcctgtatgcgggctgtatacctgtgaccgtcagacctccacatgctcagaacctcacggccacgctgcccactgtccgaatgattgttgatgtcagcaaagcagcctgtattctcaccagtcagaccctaatgaggctactgaggtcccgagaggcagcagcagctgtggatgtgaaaacctggccaaccatcattgacacagatgatttacccaggaaaaggttacctcagctgtataaaccgcccactcctgagatgttggcatatcttgattttagtgtctccacaactggcatgcttacaggagtgaagatgtcccactctgcagtgaacgctctgtgtcgagccatcaagctccagtgtgagttgtactcttctcggcagatcgccatctgccttgacccttactgtggacttggcttcgcgctctggtgtctctgcagtgtctattcaggccaccagtctgtcttaattcctcctatggagttagagaacaaccttttcctctggctctccacagtcaaccagtacaaaataagggacactttctgctcctattcagtgatggagctctgcaccaaaggtcttgggaaccaagtggaagtgctaaagaccagagggatcaacctctcctgcgtccggacctgtgtggtggtggcggaggagaggccccgcgttgcactccagcagtccttctctaagctcttcaaagacatcgggctgtccccgcgggctgtcagcaccacttttggatcaagagtcaatgtagcaatatgtttacagggaacctcagggcctgatccgactactgtgtatgtggatctgaaatcactaagacatgacagggttcgtctcgtggaacgtggcgcccctcagagtttgcttctctcagagtctggaaagattttacctggagtgaaagtggttattgttaatcctgagaccaaagggccggttggagactctcaccttggagagatttgggtgaacagtccccatacagccagcggctactacaccatctatgatagcgagactcttcaagctgatcatttcaacactcgcctcagctttggagatgcagctcagacactctgggctcggacaggataccttggttttgtccgccggaccgagctcacagcggccactggagagcgtcatgatgcattgtatgtggtgggagcgctggatgaaacactggagctgagaggattacgataccacccaattgatattgagacctcggtgtcccggatccacagaagcattgctgaatgtgccgtgttcacatggaccaacttgcttgtggtggttgtggaactgtgcggctctgaacaggaagccctagatctggtcccattagtgaccaacgtggtcctggaagagcattacctcatcgttggcgtcgtggttgtggtggacccaggtgtcatcccgatcaactccagaggagagaagcagaggatgcacctccgtgatagcttcctagctgaccagttagaccccatctacgtggcttataacatgtaaccagccttgtggggactgcagtgggccattctgaagaatcacaaagacagaagacctctggctaagagcaggcttcaaacgatgtgaaataagctgagatggctacatgatattcttcatctcatcctgtgggattctgcaatcataaaacacaggaaaggggaattctgtgatggcaaatgaaaaaaatgttaacatttggtagacatgtgctttgacatagcgtgagcagcacattactaaagcaattacatgcatgttgcatttttttcatctgttgtacatagttgtatttttatctaatgccattttagaattttctaagggaatttaatgaattcacatgaaaggggtagtctgagtgacacagttccccactccgtactgtattttgccattctgccgtagctagatgttctgtggggtttgttaacatggaactactcagctttctttcagtcaacccataagcaaatcagataacccactgactatgagaattactttatatagataattcttgactgtaaaacattttgaccagtgttttacaacatgtacataagaatacacataattcaactagagatttgaagaattggcttgtatagttataacaaccacagtagaaacatttctactttgagagaatttcaatattctcttaatgttgtgtaattgattaggtaactaaaaagcgcaaattgttggcaggttttgctgcacattgttctatgtctttgttggctggtgtattttataaactaaagctgcctatgtttctttttaaagctcgcattcccagaatcagcttaggcttctatgaattcagcctgtttctaaaagctgaaaatctcagtttaaaaatcaaaatgttaacacaaagctaagattcatcagagcccaccctattctaaggaaccacaataacttactctggccccagtgttaaaacgatctttcagatttagagtgactatgtaagaatttaggatttcctcttttccaggcacattgtaaactgtgtctacagtttatccatataacttctcttctgaaaactgaggagtgtcctctgttcttccagttcacgagggcagggggtttaaaacaagaatgataggccaggaaggcagtggggatccaccatcacatggaactgtaaggccatataactacacaaaactgaccaatctgggttgccaaagcagccaggcttatgctgaaaccggggaagtctgacatatgcaggaaactcttttgaaataactttggtgcccaggccaagtagaatgagatgagactgagtttggcctctggctcggtttcctttctttggtctgatacttcatgtatttgaatatagttaaatcgtattatttttttcttaacagaaatatttttaaaaatgaaaaagtactcaaaagtgagaagagttaacttgtcaaagcagaatggttctctttgacccactctggtctattgtgtaaatatttatttagactattttaataatacatattatttaccccactgtaacatcatgtaaactaagtatgtttttaaacaatttttaagacttgtaattaccctgaaaataaggtttataatgcaaagaccagctcctttgcggtggcagtgctctagggctgccattacacggtcttgtgatgtgactaaaagccactttgtgactcccttcatgtaatcctcttttcctccccactcctccacagagggcagagctcaggacatttgccagttccagatctctttttcagcattttcatggaattaatttacacgtaatgagggaagtcctaggatggatagaaaaaaagcacttacattggggcacacaggaaatcccagtgtctagcaatggtttggtttgcagagaacacagcctgatacttaattttcttaaaactatttttaatgatccactaaacaaagcaggggatcctgaagctgatataaataagtctagctctataatccccaagttctaaaagttatggttagatgctattctgtgggttgctttgataattcttactaacacagattagggtataggcatctagagatgcactgtccactgtaaatactataatgagagccacatctgtaatttaaatgtttctagtaaccacatttttttaaaagtaaaaagaaacccatggtattgatttaaatatattttatttaacccaatagctcaaaaacactatcatttcaacataggatcaatataaaaattattaatgagttattttactttttttcatattaggcctttgaaattcagtgtgtattaaacacatctcaattcaaaccatcaccatatttcaagtctttgtagccaaatgtgactagtggctaccatattagacagtgcagatctatactcattccttcaaatacattactctgttaatctcaaagtgtggccaactcccatttacttagaggctgattatctagttttgtagttcctcaggcctctaatttattttttgctttctgctttattgatcttttgcatgtcccccaaagccagaatctgctcatggaggaaggaaggctaagaactgtccttgaggaacttcatcagtaactctggtaaagcatcctgtggagggagaggagagcccagtcatttgcttagatggtgtttgtgggatcacctgcagatttaaagcctactctgccacagactcgagtaagaaaatgttctcttgatgacacagtgctcctactctatccacattaagtagcacttttgtggtagaactgattcttaaggcaggcctgaaaggccattactaatagaaacacagcctttccaatcctctggaacatattctgtctgggtttttaatgtctgtggaaaaaaactaaacaagtctctgtctcagttaagagaaatctattggtctgaaggtttctgaacctctttctggttctcagcagaagtaactgaagtagatcaggaaggggctgcctcaggaaaattcctagatcctaggaattcagtgagaccctgggaaggaccagcatgctaatcagtgtcagtgaatccacagtctttacttcctgcctcataaagggccaggtctccccagtaccaagtcctttcctcatgaagttgtgttgcctcaggctgtttagggaccattgcctgtcttggtcacatgagtctgtctccttactttagtccctgggcaatccttgcttaatgcttttgttgactcaacaagggcccgaggccttaggttttctattaaggtctctgccccaggcatggtgctctatatcttggccaaataaattactttccttgaatatccaggaatcttttagtctaaagcaatgaggagttatcacctcatcctcaaactccaacaagatctatgccttagtgttgtttttgttgtctgctttgatgtaaaagcaagagtatttggagcaagaagctgcaatgcgccaaatacacaataggccttttctttatcattcatacgacatttctggtttaggtgtatgtagttgggccatgttacttgtccagaggaagagactaaagatataagaataattttttagtcctaaatgctgttttgtttactttctgtcaagatatttacccgtgtcaaattcaaactacagtactgtgtaattatgtataaagtttttttatttatttgaagttagactagatatacgtttttaaatttaacatctggctggacagtgttctattaactcattgaatgtgtttcctttgtcttgtgttaataaatattgatgcctgattctgtttaa

SEQ ID NO: 8411 - DNA, 1335 bp, Homo sapiens
acgtgacctttgctcatggcggcggcggcggcggcggcggtgctggtggtgctcggcggccggagccggatcctgtagccgggtgtgggcccgtgtctgtccgtccctccttcggccccctctcttgtcttccggagtgtggctggcggagctgggatggcggaacgaggcctggagccgtcgccggccgcggtggcggcgctgccgcctgaagtgcgggcgcagctggcggagctggagctggagctctcggagggggacatcacccagaagggctatgaaaagaaaaggtccaaactcctatctccttacagcccgcagacacaagaaactgattcagcagtacagaaagaacttagaaaccagacacctgctccatctgcagctcaaacttctgctccctctaagtaccaccgaactcgatctgggggagccagggatgaacgatatcgatcagaattctctcttgtcagaatttactctgaagatatccacacagaagcagttcaggctgcactggcaaagcataaagaacagaagatggctttgcccatgccaaccaaaaggcgatccacatttgttcagtctcctgcagatgcctgcacacctcctgacacatcttcggcctctgaggatgagggctctctgagacgccaagctgcgctctctgctgccttgcaacagagcttacagaatgctgagtcctggatcaaccgttcaattcagggatcgtccacttcttcatccgcatcttctacgctgtcccacggagaggtcaaaggaaccagtgggtctctagctgatgtatttgccaatactcgaatagagaatttctctgctcctcctgatgtcactacaactacctcttcctcctcatcatcttcctcaattcgcccagcaaacattgacctgcccccctcggggatagttaaaggcatgcacaaaggatccaacaggtccagccttatggatacagctgatggtgttcctgtcagtagcagagtatctacaaaaatccagcagcttctgaacactctgaaacgacccaaaaggcctcccttaaaggaattttttgtggatgactctgaagaaattgtggaagtacctcagccagaccccaaccagcccaagccggagggacggcagatgacccctgtgaaaggagagcctttaggagtcatctgtaactggcctcctgctcttgaatctgccctgcagcgctggggtaccactcaagcaaaatgctcctgtctgactgcactggacatgacagggaaaccagtttacactcttacatatggtgagtctgcaagattccagatccttctctcctga

SEQ ID NO: 8412 - DNA, 7894 bp, Homo sapiens
cggtgcggttccgccgggcgcgaggagccgccgagacctccgcctgcgaacaaagaggaggccgtgcggggcgcggcgcccgcggagcatggcggaccgcagcctggagggcatggcgctgcccctggaggtgcgggcgcgcctggccgagctggagctggagctgtcggaaggtgacatcacacaaaaaggatatgaaaagaagaggtcaaagttaattggagcctaccttccgcagcctccgagggtggaccaagctttgccgcaagaacgccgggctcctgtcactccttcctccgcctctcgctaccaccgccgacggtcttcagggtcacgagatgagcgctatcggtcagacgtccacacggaagctgtccaggcggctctggccaaacacaaagagcggaagatggcagtgcctatgccttccaaacgcaggtccctggtcgtgcagacctcgatggacgcctacacccctccagatacctcttctggctcagaagatgaaggctcagtgcagggggactcccagggcacccccacctccagccagggcagcatcaatatggagcactggatcagccaggccatccacggctccaccacgtccaccacctcctcgtcctctacgcagagcgggggcagcggggctgcccacaggctggcggacgtcatggctcagacccacatagaaaatcattctgcacctcctgacgtaaccacgtacacctcagagcactcgatacaggtggagagaccgcagggttccacggggtcccggacagcgcccaagtacggcaacgccgagctcatggagaccggggatggagtaccagtaagtagccgggtgtcagcaaaaatccagcagcttgtcaataccctcaaacgaccgaaacgaccacctttacgagaattctttgtcgatgactttgaagaattattagaagttcaacaaccggatccgaaccaaccaaagccggagggggcccagatgctggccatgcgcggagagcagctgggcgtggtcacgaactggccgccgtcgctggaggccgcactgcagaggtggggcaccatctcgcccaaggcgccctgcctgaccaccatggacaccaacgggaagcccctctacatcctcacttacggcaagctgtggacaagaagtatgaaggtcgcttacagcattctacacaaattaggcacaaagcaggaacccatggtccggcctggagatagggtggcactggtgttccccaacaatgatccggctgccttcatggcggctttctacggctgcctgctggccgaggtggtccccgtgcccatcgaggtgccgctcaccaggaaggacgcagggagccagcagataggtttcttgcttggaagctgtggagttactgtagccttgactagtgacgcctgccataaaggacttccaaaaagcccaacgggagagatcccacagtttaaaggttggccaaagctgctgtggtttgtcacagagtctaaacatctctccaaaccgccccgagactggttcccacacattaaagatgccaataacgacactgcgtatattgagtacaagacgtgtaaggatggcagtgtgctgggtgtgacggtgacgaggactgcgctgctgacacactgccaggccctgacgcaggcgtgtggctacacggaagctgaaaccattgtgaatgtgctggatttcaagaaggacgtcgggctctggcatggcatcctgacaagcgtcatgaacatgatgcatgtgatcagcatcccgtactcgctgatgaaggtgaaccctctctcctggatccagaaggtctgccagtacaaagcaaaagtggcgtgtgtgaaatcgagggatatgcattgggcattagtagcacacagagatcagagagacatcaacctctcctctctgcgaatgctgatagtggcggacggcgcgaacccctggtctatttcttcttgcgatgcatttctcaatgtcttccaaagtaaaggccttcgacaggaggtcatctgtccttgtgccagctcgccagaggccctcactgtggccatccggaggcccacggatgacagtaaccagcccccgggccggggtgtcctctccatgcatggactgacctatggggtcattcgtgtggactcggaagagaagctgtccgtgctcaccgtgcaggatgtcggcctcgtgatgcctggagccatcatgtgttcagtgaagccagacggggttcctcagctgtgcagaacggatgagatcggggagctgtgtgtgtgtgcagttgcgacgggcacgtcctactatggcctctctggcatgaccaagaacacctttgaggtgtttcccatgacaagctccggggctccgatcagtgaatacccattcataaggacaggcttgctggggttcgtgggtcccggaggcctcgtcttcgtggtgggcaagatggatggcctcatggtggtcagcgggcgcaggcacaacgccgacgacatcgtggccactgcgctggccgtagaacccatgaagtttgtctaccggggaaggatagccgtgttctcggtgaccgtgctgcacgacgagaggatcgtgatcgtggctgagcagaggcctgactccacggaagaggacagtttccagtggatgagccgtgtgctgcaggcgattgacagtatacatcaagttggagtttattgcctggccttggtgccagcaaacaccctccccaaaaccccgcttggtgggatccatttatcagaaacaaaacagctttttctggagggctctctgcacccctgcaatgtcctaatgtgcccccacacctgcgtcacaaacttgcctaagcctcgacagaagcagccagaaatcggccctgcctctgtgatggtggggaacctggtctctgggaagagaatcgcccaggccagtggcagagacctgggtcagatcgaagataacgaccaggcacgcaagttcctgttcctctcagaggtcttgcagtggagagcacagaccaccccggaccacatcctctacacgctgctcaactgtcggggtgcgatagcgaactcgctgacctgcgtgcagctgcacaagagagctgagaagatcgccgtgatgctgatggagaggggccaccttcaggacggcgaccacgtggccttggtctaccccccaggaatagacctgatagcagcgttttatggttgcctgtacgcaggctgtgtgccaataaccgtccgtcccccgcacccacagaacatcgcgacgacgttgcctaccgtcaagatgattgtggaggtgagtcgctctgcctgtctgatgacgacacagctgatctgtaagttgctgcggtccagggaggcggcggcggctgtggacgtcaggacgtggcccctcatcctggacacagatgatttgccaaagaagcggcctgcccagatctgcaaaccttgcaacccagacactcttgcatatctcgacttcagcgtgtccacaactgggatgctagctggcgtaaagatgtctcacgcagccaccagtgccttctgccgttccattaagctgcagtgtgaactttacccctctagagaagtggccatctgcctggacccttactgtggactgggatttgtcctctggtgcctctgcagtgtgtattctgggcaccagtccatcctgatcccgccctctgagctggaaaccaaccccgccttgtggcttcttgccgtgagtcagtacaaagtccgagacacgttttgctcctactccgtgatggagctgtgcaccaaggggctgggctcgcaaacagagtccctcaaggcgcgagggctggacttgtcccgagtgaggacctgcgtggttgtggcggaagagaggcctcggatcgcactcacacagtcgttctcaaagctgtttaaggacctgggccttcacccgcgggccgtcagcacctcgttcggttgcagggtgaacctggcgatttgcttgcagggaacctcaggacctgacccaaccactgtctacgtggacatgagagccctgagacacgacagagtccgcttagtggaaagaggatcccctcatagtctgcccctgatggaatcgggaaagatacttccaggggttcggattataattgccaacccagaaacaaaaggaccgctgggggactcacaccttggagagatttgggttcacagtgcccacaatgccagcggttatttcactatttacggagacgaatccctccagtcagatcacttcaactcaagactaagttttggagacacccagaccatctgggcacgcacaggctacttggggttcctgcggagaactgagctcacagatgcaaatggagagcgccatgatgccctctacgtggtaggggcactggacgaagccatggagctgcggggcatgcggtaccacccaatcgacattgagacctcggtcatcagagcccataaaagcgttacggaatgtgctgtgtttacctggacaaatttgttggtggttgtggttgagctggatgggtcggaacaagaagccttggacctggttcccttggtgaccaacgtggtcctggaggagcactacctgatcgtcggagtggtggtcgtggtggacatcggcgtcatccccatcaactcccgtggggagaagcagcgcatgcacctgcgagacgggtttttggcagaccagctagaccccatctatgtggcctacaacatgtagtctcgtctcttggcttccatggacttttctagagatgtagacattgttctccgtgtccactgaagcgtgcagacacagggcaacactcaccagaatacagccatttgtggtgagagtggaggaggaagaggaggaggaagaggacttctcacagcagccacgattggcatgggggtgaaatgtgaatttaccactgaatttcgctcagaaggactttggattactgccttcagtttgttggaaaagcccatttcaaaactttcttttcttttctttcttttttaattattggataataagtgctttcttcgtaaatgtggtattttgttaagccgaaatagcaattaaaaaaatatcctgccctccagatgggttcttttaaacaatttatgtagtgtgacaaagaattgttttctctgttttaatgtgtcatgaaatcttaatgacatggatctgttactaatttaagccattgctagatctcatccttttaggaaagtttgaggtacgagaaaaccttccaaatagcaccttccaattagataatagcagctttctttgtcagaaatgtgctgaagaaacaaaggctggtatacggccttcgaagttagtatagaatgagaagaaattataaataaggtgtatttcggcaattatcttgcaaatatctttgtactaaactaaaaagataaaataagttaacttcctcaatatgtaattatgtacaaaacgtttaatttattttgatctctttagaactataaaagagaaaaacattcaagaatattaaagtcttgtaatgtttgctaatataaaaaagtgttgtattatcttgcgtggatagtatcacaacaaatatatatatatgaaatataaattcactaatgaacaaaggagattttaaagtttaagatgcagaacttgtcacttgcatggtgtgccccccgtactcacatacactctgctgttgccagcagtcgcagaccgcaggagccctgtctaaaagtttcttctagaaccagagaccagcaagtgaaattattgccatctcaaggatggcaaaagaattcaaagctcaatgtgcactatttttttctttgctgtgggacaacagtgaatgtgtttatgccagcgtgtgctgatgatactgaggggctttaggttggcaaatagcactgttttcttagctgcaagaattcattgcacaatgtttttcatcatttttgttaatgtcatctttttttggtccttgctacgaaaaggaatgcgattctgtggtcattcgcactgggttgcattgattccccctctgatggccaatgtggagtggacaaagtgtccggaactcacatcggtgatcgtcccctcgtcttaagacccagcccgctctgtgtgagcctctggggctccctcgctcagtgagcacagttccccgggggttcatgccagagctccggctgaagcaagaagtcctccagctgcgtcgtttgccgcctgtggacgagtgcgccccagtttctgccctggcagctcctggccacaccttctcagagctcacctgtgcacttctaaattgaattggcccacggtgtccaaccaagaaggagcatctgcactccgagaaagatgtgttctgtaactgccccagtgtgaccccgcagtggctctcggtgctagatatgcatgactaagattgatgctgggcaaaatgtagatgatctttcattatgttgtgggcagcgtctttctctgcctttgctatatgcagtcagcagtaagccttttgctaaaagagttttgtttgacttctgagatccaaggctgattgttgttaaaaaaaaaaaaaaaaaaaaagtggcacatttaaaaaaatgtgtctgcatatgtggtgcatccttccatctccacaaaccatttgattcttgaaatattgtttgacctcattgctgtgtgtgaatatttctccacatgcttcagatgcacattcctagtctctgcttcctaaggggggaaccaccacacattggggggaaaaaagacattttcctacacccacccaccttgttgaaagggaggtaggtttggggcttcaggccaggcactgactatgaaacattagctgcagtgtgcaggacagctttgaggtccagctgaagtcaggaagcaaaacaaatgtagatgtcacttcaaacataatttcaactgtcaccagatcaactctacattcaaggagtgtggacgctgcagtgcagttgtgagggcagttagcagccgcctcttctgcatcctgtcaactctgattagttagagtttaggctcaaaagagttggtggactgagattgaaatttggttgtgcaagagaaaggaaaggagacacttagtaccaccagtttcagcaataaagaagggtcattctgtattcaaaattgtactgtagataaatcattcatgagattgtaaaaaatgtttgtcttgtgaccttgtgcttttgaagtcagacaaaaccgtgtaatcaacttgcacaaaaagagggtacacagtgaacatataaacacagacctaatcaaacaggagcagattcctcatggtgcttgtttattatatatatttaatcctgcttgacactttacccaagggagatggtcccttttatcagttgaatgttagcagcgttatttcagagtgtggtgactggttagagaaactcatgtactcaaccagccacagtttcaaacaaaatttttatgtgcaaaggacagcaaccttcttgtatgttaaaccaccagtacgctttgtacatctgtgataacgcctgttttatattcaaatgaacaaataaaagcttttatttttgttgctctgaaaatagcagtttcttaattggtcccctggaaagatgtctgggacagctttaatcccgggaaggaagtgactcctacagggaaatgtatctgactctgtttacataatttgttgcattacttagtacagataatcatactttgaaaaatgtttaaattttgatgtgggcatttattgctaaaaataattcctatggcaacaaatgttttgtgaaatgttttttttaattcttttaaatatatctaaatatatttgttcacattttgctgcaa

SEQ ID NO: 8413 - DNA, 4205 bp, Homo sapiens
cacatttgtggctgctcaaagctgctctccttctgcgtcattacaggcgatctctaggcacgtgcttggttcttggagaagtggcgtctggctgtggaggatgaccgtggcagaactgcttccggctgttgagcgctggctgagagctgcttggcgtgcacagatcggtttcagcacagtctcgggagcagccccgggcagtgcagaaagcgaggcccaggtgacatcacacaaaaaggatatgaaaagaagaggtcaaagttaattggagcctaccttccgcagcctccgagggtggaccaagctttgccgcaagaacgccgggctcctgtcactccttcctccgcctctcgctaccaccgccgacggtcttcagggtcacgagatgagcgctatcggtcagacgtccacacggaagctgtccaggcggctctggccaaacacaaagagcggaagatggcagtgcctatgccttccaaacgcaggtccctggtcgtgcagacctcgatggacgcctacacccctccagatacctcttctggctcagaagatgaaggctcagtgcagggggactcccagggcacccccacctccagccagggcagcatcaatatggagcactggatcagccaggccatccacggctccaccacgtccaccacctcctcgtcctctacgcagagcgggggcagcggggctgcccacaggctggcggacgtcatggctcagacccacatagaaaatcattctgcacctcctgacgtaaccacgtacacctcagagcactcgatacaggtggagagaccgcagggttccacggggtcccggacagcgcccaagtacggcaacgccgagctcatggagaccggggatggagtaccagtaagtagccgggtgtcagcaaaaatccagcagcttgtcaataccctcaaacgaccgaaacgaccacctttacgagaattctttgtcgatgactttgaagaattattagaagttcaacaaccggatccgaaccaaccaaagccggagggggcccagatgctggccatgcgcggagagcagctgggcgtggtcacgaactggccgccgtcgctggaggccgcactgcagaggtggggcaccatctcgcccaaggcgccctgcctgaccaccatggacaccaacgggaagcccctctacatcctcacttacggcaagctgtggacaagaagtatgaaggtcgcttacagcattctacacaaattaggcacaaagcaggaacccatggtccggcctggagatagggtggcactggtgttccccaacaatgatccggctgccttcatggcggctttctacggctgcctgctggccgaggtggtccccgtgcccatcgaggtgccgctcaccaggaaggacgcagggagccagcagataggtttcttgcttggaagctgtggagttactgtagccttgactagtgacgcctgccataaaggacttccaaaaagcccaacgggagagatcccacagtttaaaggttggccaaagctgctgtggtttgtcacagagtctaaacatctctccaaaccgccccgagactggttcccacacattaaagatgccaataacgacactgcgtatattgagtacaagacgtgtaaggatggcagtgtgctgggtgtgacggtgacgaggactgcgctgctgacacactgccaggccctgacgcaggcgtgtggctacacggaagctgaaaccattgtgaatgtgctggatttcaagaaggacgtcgggctctggcatggcatcctgacaagcgtcatgaacatgatgcatgtgatcagcatcccgtactcgctgatgaaggtgaaccctctctcctggatccagaaggtctgccagtacaaagcaaaagtggcgtgtgtgaaatcgagggatatgcattgggcattagtagcacacagagatcagagagacatcaacctctcctctctgcgaatgctgatagtggcggacggcgcgaacccctggtctatttcttcttgcgatgcatttctcaatgtcttccaaagtaaaggccttcgacaggaggtcatctgtccttgtgccagctcgccagaggccctcactgtggccatccggaggcccacggatgacagtaaccagcccccgggccggggtgtcctctccatgcatggactgacctatggggtcattcgtgtggactcggaagagaagctgtccgtgctcaccgtgcaggatgtcggcctcgtgatgcctggagccatcatgtgttcagtgaagccagacggggttcctcagctgtgcagaacggatgagatcggggagctgtgtgtgtgtgcagttgcgacgggcacgtcctactatggcctctctggcatgaccaagaacacctttgagcatacttccaacaagggcaaataacattttatgaatgaagagagattactttaaaactaacagacgttgtttaaaatgtaccttgactcttcactcgtcttttacattgtggttttgtaaaccaagtaatcagttactgctgattggcctcctgtgagacttctgggtgttatctgttcagggttcagaggcaggaggctccagcaggtgtttcccatgacaagctccggggctccgatcagtgaatacccattcataaggacaggcttgctggggttcgtgggtcccggaggcctcgtcttcgtggtgggcaagatggatggcctcatggtggtcagcgggcgcaggcacaacgccgacgacatcgtggccactgcgctggccgtagaacccatgaagtttgtctaccggggaaggatagccgtgttctcggtgaccgtgctgcacgacgagaggatcgtgatcgtggctgagcagaggcctgactccacggaagaggacagtttccagtggatgagccgtgtgctgcaggcgattgacagtatacatcaagttggagtttattgcctggccttggtgccagcaaacaccctccccaaaaccccgcttggtgggatccatttatcagaaacaaaacagctttttctggagggctctctgcacccctgcaatgtcctaatgtgcccccacacctgcgtcacaaacttgcctaagcctcgacagaagcagccagaaatcggccctgcctctgtgatggtggggaacctggtctctgggaagagaatcgcccaggccagtggcagagacctgggtcagatcgaagataacgaccaggcacgcaagttcctgttcctctcagaggtcttgcagtggagagcacagaccaccccggaccacatcctctacacgctgctcaactgtcgggtgaggcgcggagctggccttccctggctactggcctcaaggggcctagcctggttcctgggagcgctcctgcttctttctttgaatccttttgcttcagtcttatgggaattctttttatgttttgctattttgactgagacttttgtacctagggattgtttttaaacgtaaccatttgtgcagttatttacacctatttgtgtgtacagatattttagcaacctatttacaatatttctcccccaaaatgagtaatgatatctgcaagagagaaatcgtaagtctatgagatatttgcatttttattttgattactaaactagtttttgttttgttttgtgttttgaggcagtctcgctctgttgcccaggctagagttcagtggcacgatctccgctcactgcaacctccacctccctggttgaagcaattctcgtgcatcagcctccgggtagctgggactacaagtgcccaccaccacatctggctaatttttgtatttttagtatttagagatggggtttcaccatgttggcgaggatggtcttgaattcctggccttgagtgatccacctgccttggcctcccaaagtgctgggattacaggcgtgagtcaccacaccgagccctaaaccacttttttatacaccagaagttatgtttattgcagactcaggaatgaaaatcatttccactttgtaattaaatttcctgtttacactttacatgagaaaactacactcatcaaatattgttccaccgtagtacttaagagtaaggcattaaataaacaagctaatactattaacaagaaaaattaaatgcaaaaatcttaatatgcttgttactactttttaccatggaaataaagcttg

SEQ ID NO: 8414 - DNA, 827 bp, Homo sapiens
gcgtctgggtgagtcgctctgcctgtctgatgacgacacagctgatctgtaagttgctgcggtccagggaggcggcggcggctgtggacgtcaggacgtggcccctcatcctggacacagatgatttgccaaagaagcggcctgcccagatctgcaaaccttgcaacccagacactcttgcatatctcgacttcagcgtgtccacaactgggatgctagctggcgtaaagatgtctcacgcagccaccagtgccttctgccgttccattaagctgcagtgtgaactttacccctctagagaagtggccatctgcctggacccttactgtggactgggatttgtcctctggtgcctctgcagtgtgtattctgggcaccagtccatcctgatcccgccctctgagctggaaaccaaccccgccttgtggcttcttgccgtgagtcagtacaaagtccgagacacgttttgctcctactccgtgatggagctgtgcaccaaggggctgggctcgcaaacagagtccctcaaggcgcgagggctggacttgtcccgagtgaggacctgcgtggttgtggcggaagagaggcctcggatcgcactcacacagtcgttctcaaagctgtttaaggacctgggccttcacccgcgggccgtcagcacctcgttcggttgcagggtgaacctggcgatttgcttgcagtgctgggattacaggcatgagccaccacgcccagccccaaaatgttttaagatggtttacaaggaaggagtacgctcagtaggagaagataaaatacgtgaaaaaagaaccaaaacatggagatga

SEQ ID NO: 8415 - DNA, 731 bp, Homo sapiens
ctgaaaccattgtgaatgtgctggatttcaagaaggacgtcgggctctggcatggcatcctgacaagcgtcatgaacatgatgcatgtgatcagcatcccgtactcgctgatgaaggtgaaccctctctcctggatccagaaggtctgccagtacaaagcaaaagtggcgtgtgtgaaatcgagggatatgcattgggcattagtagcacacagagatcagagagacatcaacctctcctctctgcgaatgctgatagtggcggacggcgcgaacccctggtctatttcttcttgcgatgcatttctcaatgtcttccaaagtaaaggccttcgacaggaggtcatctgtccttgtgccagctcgccagaggccctcactgtggccatccggaggcccacggatgacagtaaccagcccccgggccggggtgtcctctccatgcatggactgacctatggggtcattcgtgtggactcggaagagaagctgtccgtgctcaccgtgcaggatgtcggcctcgtgatgcctggagccatcatgtgttcagtgaagccagacggggttcctcagctgtgcagaacggatgagatcggggagctgtgtgtgtgtgcagttgcgacgggcacgtcctactatggcctctctggcatgaccaagaacacctttgagcatacttccaacaagggcaaataacattttatgaatgaagagagattactttaaaactaa

SEQ ID NO: 8416 - DNA, 727 bp, Homo sapiens
ctgaggaggcgccgaggggagggaggtccctgcgcgcccgccgcccgcctcccgcgcccgcgccgccgcctcctcctcggtgcggttccgccgggcgcgaggagccgccgagacctccgcctgcgaacaaagaggaggccgtgcggggcgcggcgcccgcggagcatggcggaccgcagcctggagggcatggcgctgcccctggaggtgcgggcgcgcctggccgagctggagctggagctgtcggaaggtgacatcacacaaaaaggatatgaaaagaagaggtcaaagttaattggagcctaccttccgcagcctccgacagcgaatggagctgccgtggttcggtgtagactgcagcacagtgaaggagcgccgaggagaacattccgctctgcccacatcggggtgtgcgacgtccgagaagctgcggctcgggagcgggtggccagcaccgcagggaaccggcctctgttttactttcgtttcggggtggaccaagctttgccgcaagaacgccgggctcctgtcactccttcctccgcctctcgctaccaccgccgacggtcttcagggtcacgagatgagcgctatcggtcagacgtccacacggaagctgtccaggcggctctggccaaacacaaagagcggaagatggcagtgcctatgccttccaaacgcaggtccctggtcgtgcagacctcgatggacgcctacacccctccag

SEQ ID NO: 8417 - DNA, 721 bp, Homo sapiens
tgtgtattctgggcaccagtccatcctgatcccgccctctgagctggaaaccaaccccgccttgtggcttcttgccgtgagtcagtacaaagtccgagacacgttttgctcctactccgtgatggagctgtgcaccaaggggctgggctcgcaaacagagtccctcaaggcgcgagggctggacttgtcccgagtgaggacctgcgtggttgtggcggaagagaggcctcggatcgcactcacacagtcgttctcaaagctgtttaaggacctgggccttcacccgcgggccgtcagcacctcgttcggttgcagggtgaacctggcgatttgcttgcagtgctgggattacaggcatgagccaccacgcccagccccaaaatgttttaagatggtttacaaggaaggagtacgctcagtaggagaagataaaatacgtgaaaaaagaaccaaaacatggagatgaaagaaaaacagcgcaggaaagggacagaatgaagaacagagttggcgtgctggtgttttccacaaggcttctgaagcgtgccaccgtccttacctcggcaccagggcggggcctgacacgtggtggatattgaatgaatgtgcgccgtgggagtgttgagcacggttctgtattcttaataggaaatggcaatatgttcttgtgcagaagacaattctgtcaatatgaccgctaaatcaaaattcagtattctaa

SEQ ID NO: 8418 - DNA, 1781 bp, Homo sapiens
atctgggtgagtcgctctgcctgtctgatgacgacacagctgatctgtaagttgctgcggtccagggaggcggcggcggctgtggacgtcaggacgtggcccctcatcctggacacagatgatttgccaaagaagcggcctgcccagatctgcaaaccttgcaacccagacactcttgcatatctcgacttcagcgtgtccacaactgggatgctagctggcgtaaagatgtctcacgcagccaccagtgccttctgccgttccattaagctgcagtgtgaactttacccctctagagaagtggccatctgcctggacccttactgtggactgggatttgtcctctggtgcctctgcagtgtgtattctgggcaccagtccatcctgatcccgccctctgagctggaaaccaaccccgccttgtggcttcttgccgtgagtcagtacaaagtccgagacacgttttgctcctactccgtgatggagctgtgcaccaaggggctgggctcgcaaacagagtccctcaaggcgcgagggctggacttgtcccgagtgaggacctgcgtggttgtggcggaagagaggcctcggatcgcactcacacagtcgttctcaaagctgtttaaggacctgggccttcacccgcgggccgtcagcacctcgttcggttgcagggtgaacctggcgatttgcttgcagggaacctcaggacctgacccaaccactgtctacgtggacatgagagccctgagacacgacagagtccgcttagtggaaagaggatcccctcatagtctgcccctgatggaatcgggaaagatacttccaggggttcggattataattgccaacccagaaacaaaaggaccgctgggggactcacaccttggagagatttgggttcacagtgcccacaatgccagcggttatttcactatttacggagacgaatccctccagtcagatcacttcaactcaagactaagttttggagacacccagaccatctgggcacgcacaggctacttggggttcctgcggagaactgagctcacagatgcaaatggagagcgccatgatgccctctacgtggtaggggcactggacgaagccatggagctgcggggcatgcggtaccacccaatcgacattgagacctcggtcatcagagcccataaaagcgttacggaatgtgctgtgtttacctggacaaatttgttggtggttgtggttgagctggatgggtcggaacaagaagccttggacctggttcccttggtgaccaacgtggtcctggaggagcactacctgatcgtcggagtggtggtcgtggtggacatcggcgtcatccccatcaactcccgtggggagaagcagcgcatgcacctgcgagacgggtttttggcagaccagctagaccccatctatgtggcctacaacatgtagtctcgtctcttggcttccatggacttttctagagatgtagacattgttctccgtgtccactgaagcgtgcagacacagggcaacactcaccagaatacagccatttgtggtgagagtggaggaggaagaggaggaggaagaggacttctcacagcagccacgattggcatgggggtgaaatgtgaatttaccactgaatttcgctcagaaggactttggattactgccttcagtttgttggaaaagcccatttcaaaactttcttttcttttctttcttttttaattattggataataagtgctttcttcgtaaatgtggtattttgttaagccg

SEQ ID NO: 8419 - DNA, 1358 bp, Homo sapiens
actcagtgtcctgggatcagaggcaaagaccagggaggggcgggcactcaggtcagcaggggctatgctctgggtctgagtcctgccgagccccaccacccacttgggcagtgaagtcaacctttctgtgcccgaatcttctcatctgaaagtgaggaataatagccataggcttatggcccacggatgacagtaaccagcccccgggccggggtgtcctctccatgcatggactgacctatggggtcattcgtgtggactcggaagagaagctgtccgtgctcaccgtgcaggatgtcggcctcgtgatgcctggagccatcatgtgttcagtgaagccagacggggttcctcagctgtgcagaacggatgagatcggggagctgtgtgtgtgtgcagttgcgacgggcacgtcctactatggcctctctggcatgaccaagaacacctttgaggtgtttcccatgacaagctccggggctccgatcagtgaatacccattcataaggacaggcttgctggggttcgtgggtcccggaggcctcgtcttcgtggtgggcaagatggatggcctcatggtggtcagcgggcgcaggcacaacgccgacgacatcgtggccactgcgctggccgtagaacccatgaagtttgtctaccggggaaggatagccgtgttctcggtgaccgtgctgcacgacgagaggatcgtgatcgtggctgagcagaggcctgactccacggaagaggacagtttccagtggatgagccgtgtgctgcaggcgattgacagtatacatcaagttggagtttattgcctggccttggtgccagcaaacaccctccccaaaaccccgcttggtgggatccatttatcagaaacaaaacagctttttctggagggctctctgcacccctgcaatgtcctaatgtgcccccacacctgcgtcacaaacttgcctaagcctcgacagaagcagccagaaatcggccctgcctctgtgatggtggggaacctggtctctgggaagagaatcgcccaggccagtggcagagacctgggtcagatcgaagataacgaccaggcacgcaagttcctgttcctctcagaggtcttgcagtggagagcacagaccaccccggaccacatcctctacacgctgctcaactgtcgggtgaggcgcggagctggccttccctggctactggcctcaaggggcctagcctggttcctgggagcgctcctgcttctttctttgaatccttttgcttcagtcttatgggaattctttttatgttttgctattttgactgagacttttgtacctagggattgtttttaaacgtaaccatttgtgcag

SEQ ID NO: 8420 - DNA, 1598 bp, Homo sapiens
cctctggtgcctctcctggcaggcagagtggctcctcacagcctgaagctcatccttctgcacgggccagccaggccagcacagaggcaccagggcagcagtgcacacaggtccccggggaccccaccatgtggagcggatggtggctgtggccccttgtggccgtctgcactgcagacttctttcgggacgaggcagagaggatcatgagggactcccctgtcattgatgggcacaatgacctcccctggcagctgctggatatgttcaacaaccggctgcaggacgagagggccaacctgaccaccttggccggcacacacaccaacatccccaagctgagggccggctttgtgggaggccagttctggtccgtgtacacgccctgcgacacccagaacaaagacgccgtgcggaggacgctggagcagatggacgtggtccaccgcatgtgccggatgtacccggagaccttcctgtatgtcaccagcagtgcaggcattcggcaggccttccgggaagggaaggtggccagcctgatcggcgtggagggcggccactccattgacagcagtttgggcgtcctgcgggcactctatcagctgggcatgcggtacctgaccctcacccacagctgcaacacgccctgggctgacaactggctggtggacacgggagacagcgagccccagagccaaggcttgtcaccctttgggcagcgtgtggtgaaggagctgaaccgtctgggggtcctcatcgacttggctcacgtgtctgtggccaccatgaaggccaccctgcagctgtccagagccccggtcatcttcagccactcctcggcctacagcgtgtgcgcaagccggcgcaacgtgcctgacgacgtcctgaggctggtgaaacagacagacagcctggtgatggtgaacttctacaacaattacatttcctgcaccaacaaggccaacctgtcccaagtggccgaccatctggatcacatcaaggaggtggcaggagccagagccgtgggttttggtggggactttgatggtgttccaagggtccctgaggggctggaggacgtctccaagtatccagacctgatcgctgagctgctcaggaggaactggacggaggcggaggtcaagggcgcactggctgacaacctgctgagggtcttcgaggctgtggaacaggccagcaacctcacacaggctcccgaggaggagcccatcccgctggaccagctgggtggctcctgcaggacccattacggctactcctctggggcttccagcctccatcgccactgggggctcctgctggcctccctcgctcccctggtcctctgtctgtctctcctgtgaaacctgggagaccagagtcccctttagggttcccggagctccgggaagacccgcccatcccaggactccagatgccaggagccctgctgcccacatgcaaggaccagcatctcctgagaggacgcctgggcttacctggggggcaggatgcctggggacagttcaggacacacacacagtaggcccgcaataaaagcaacaccccttcacatcctggggtacgtgtcatcggca

SEQ ID NO: 8421 - DNA, 1735 bp, Homo sapiens
ggggtactgtgcgagccctcaaggaggtggctgttctgtagctggagagctccgtgggtggcaggactgaacttgaacaccagaaacaacccccaagccttgtgacctgggaggcaggaggcgggtctgtctccctgggacttgggtggctgagccgaggtactcgggaccctgtcccgcgcatggcagagtggctcctcacagcctgaagctcatccttctgcacgggccagccaggccagcacagaggcaccagggcagcagtgcacacaggtccccggggaccccaccatgtggagcggatggtggctgtggccccttgtggccgtctgcactgcagacttctttcgggacgaggcagagaggatcatgagggactcccctgtcattgatgggcacaatgacctcccctggcagctgctggatatgttcaacaaccggctgcaggacgagagggccaacctgaccaccttggccggcacacacaccaacatccccaagctgagggccggctttgtgggaggccagttctggtccgtgtacacgccctgcgacacccagaacaaagacgccgtgcggaggacgctggagcagatggacgtggtccaccgcatgtgccggatgtacccggagaccttcctgtatgtcaccagcagtgcaggcattcggcaggccttccgggaagggaaggtggccagcctgatcggcgtggagggcggccactccattgacagcagtttgggcgtcctgcgggcactctatcagctgggcatgcggtacctgaccctcacccacagctgcaacacgccctgggctgacaactggctggtggacacgggagacagcgagccccagagccaaggcttgtcaccctttgggcagcgtgtggtgaaggagctgaaccgtctgggggtcctcatcgacttggctcacgtgtctgtggccaccatgaaggccaccctgcagctgtccagagccccggtcatcttcagccactcctcggcctacagcgtgtgcgcaagccggcgcaacgtgcctgacgacgtcctgaggctggtgaaacagacagacagcctggtgatggtgaacttctacaacaattacatttcctgcaccaacaaggccaacctgtcccaagtggccgaccatctggatcacatcaaggaggtggcaggagccagagccgtgggttttggtggggactttgatggtgttccaagggtccctgaggggctggaggacgtctccaagtatccagacctgatcgctgagctgctcaggaggaactggacggaggcggaggtcaagggcgcactggctgacaacctgctgagggtcttcgaggctgtggaacaggccagcaacctcacacaggctcccgaggaggagcccatcccgctggaccagctgggtggctcctgcaggacccattacggctactcctctggggcttccagcctccatcgccactgggggctcctgctggcctccctcgctcccctggtcctctgtctgtctctcctgtgaaacctgggagaccagagtcccctttagggttcccggagctccgggaagacccgcccatcccaggactccagatgccaggagccctgctgcccacatgcaaggaccagcatctcctgagaggacgcctgggcttacctggggggcaggatgcctggggacagttcaggacacacacacagtaggcccgcaataaaagcaacaccccttc

SEQ ID NO: 8422 - DNA, 1647 bp, Homo sapiens
ggcacatccacacatgagggaaaaacactgccaggacatctcagggcactctcaggaaatgaggaagctgctggagaagtttctagccttgggggaggcagagtggctcctcacagcctgaagctcatccttctgcacgggccagccaggccagcacagaggcaccagggcagcagtgcacacaggtccccggggaccccaccatgtggagcggatggtggctgtggccccttgtggccgtctgcactgcagacttctttcgggacgaggcagagaggatcatgagggactcccctgtcattgatgggcacaatgacctcccctggcagctgctggatatgttcaacaaccggctgcaggacgagagggccaacctgaccaccttggccggcacacacaccaacatccccaagctgagggccggctttgtgggaggccagttctggtccgtgtacacgccctgcgacacccagaacaaagacgccgtgcggaggacgctggagcagatggacgtggtccaccgcatgtgccggatgtacccggagaccttcctgtatgtcaccagcagtgcaggcattcggcaggccttccgggaagggaaggtggccagcctgatcggcgtggagggcggccactccattgacagcagtttgggcgtcctgcgggcactctatcagctgggcatgcggtacctgaccctcacccacagctgcaacacgccctgggctgacaactggctggtggacacgggagacagcgagccccagagccaaggcttgtcaccctttgggcagcgtgtggtgaaggagctgaaccgtctgggggtcctcatcgacttggctcacgtgtctgtggccaccatgaaggccaccctgcagctgtccagagccccggtcatcttcagccactcctcggcctacagcgtgtgcgcaagccggcgcaacgtgcctgacgacgtcctgaggctggtgaaacagacagacagcctggtgatggtgaacttctacaacaattacatttcctgcaccaacaaggccaacctgtcccaagtggccgaccatctggatcacatcaaggaggtggcaggagccagagccgtgggttttggtggggactttgatggtgttccaagggtccctgaggggctggaggacgtctccaagtatccagacctgatcgctgagctgctcaggaggaactggacggaggcggaggtcaagggcgcactggctgacaacctgctgagggtcttcgaggctgtggaacaggccagcaacctcacacaggctcccgaggaggagcccatcccgctggaccagctgggtggctcctgcaggacccattacggctactcctctggggcttccagcctccatcgccactgggggctcctgctggcctccctcgctcccctggtcctctgtctgtctctcctgtgaaacctgggagaccagagtcccctttagggttcccggagctccgggaagacccgcccatcccaggactccagatgccaggagccctgctgcccacatgcaaggaccagcatctcctgagaggacgcctgggcttacctggggggcaggatgcctggggacagttcaggacacacacacagtaggcccgcaataaaagcaacaccccttc

SEQ ID NO: 8423 - DNA, 993 bp, Homo sapiens
attgtttcttgggaattgtctgtatcagacatcatgggagcagatccagggcgacatcaaagggaagcatgagtctccaggaccagaggggcttggatgcagatgatcatcatctgggcactgctggatactgagctctctgactgccacccctgcctgcctgcccggccctgcacaacatgcagccctccggcctcgagggtcccggcacgtttggtcggtggcctctgctgagtctgctgctcctgctgctgctgctccagcctgtaacctgtgcctacaccacgccaggcccccccagagccctcaccacgctgggcgcccccagagcccacaccatgccgggcacctacgctccctcgaccacactcagtagtcccagcacccagggcctgcaagagcaggcacgggccctgatgcgggacttcccgctcgtggacggttctggtcagcctatgtgccatgccagacccaggaccgggatgccctgcgcctcaccctggagcagattgacctcatacgccgcatgtgtgcctcctattctgagctggagcttgtgacctcggctaaaggtaggcaagttgatgggaagcgttaggaacttgattgagctactccagccctggaaagtaatcacctgacctacctgcccccagctctgaacgacactcagaaattggcctgcctcatcggtgtagagggtggccactcgctggacaatagcctctccatcttacctaccttctacatgctgggagtgcgctacctgacgctcacccacacctgcaacacaccctggtgagcctagtgcagatggtgtgggaccgctgaggcaggggcagagatctgcctgaggtcactgtgggcccagaacaagctttacccatgggatgtggcactgactctggagtggggaggggagctgggattctggttttcagaatacgacttgacccctggccagacgcggtggctcatgcctgtaatcccaaa

SEQ ID NO: 8424 - DNA, 1309 bp, Homo sapiens
atgcagccctccggcctcgagggtcccggcacgtttggtcggtggcctctgctgagtctgctgctcctgctgctgctgctccagcctgtaacctgtgcctacaccacgccaggcccccccagagccctcttctggtcagcctatgtgccatgccagacccaggaccgggatgccctgcgcctcaccctggagcagattgacctcatacgccgcatgtgtgcctcctattctgagctggagcttgtgacctcggctaaagctctgaacgacactcagaaattggcctgcctcatcggtgtagagggtggccactcgctggacaatagcctctccatcttacctaccttctacatgctgggagtgcgctacctgacgctcacccacacctgcaacacaccctgggcagagagctccgctaagggcgtccactccttctacaacaacatcagcgggctgactgactttggtgagaaggtggtggcagaaatgaaccgcctgggcatgatggtagacttatcccatgtctcagatgctgtggcacggcgggccctggaagtgtcacaggcacctgtgatcttctcccactcggctgcccggggtgtgtgcaacagtgctcggaatgttcctgatgacatcctgcagcttctgaagaagaacggtggcgtcgtgatggtgtctttgtccatgggagtaatacagtgcaacccatcagccaatgtgtccactgtggcagatcacttcgaccacatcaaggctgtcattggatccaagttcatcgggattggtggagattatgatggggccggcaaattccctcaggggctggaagacgtgtccacatacccggtcctgatagaggagttgctgagtcgtggctggagtgaggaagagcttcagggtgtccttcgtggaaacctgctgcgggtcttcagacaagtggaaaaggtacaggaagaaaacaaatggcaaagccccttggaggacaagttcccggatgagcagctgagcagttcctgccactccgacctctcacgtctgcgtcagagacagagtctgacttcaggccaggaactcactgagattcccatacactggacagccaagttaccagccaagtggtcagtctcagagtcctccccccacatggccccagtccttgcagttgtggccaccttcccagtccttattctgtggctctgatgacccagttagtcctgccagatgtcactgtagcaagccacagacaccccacaaagttcccctgttgtgcaggcacaaatatttcctgaaataaatgttttggacatag

SEQ ID NO: 8425 - DNA, 1697 bp, Homo sapiens
cggaattggtgggttcttggtctcactgagttctagaatgaagctgcagaccctcgcagtgagtgttacagctcttaaggctctctgactgccacccctgcctgcctgcccggccctgcacaacatgcagccctccggcctcgagggtcccggcacgtttggtcggtggcctctgctgagtctgctgctcctgctgctgctgctccagcctgtaacctgtgcctacaccacgccaggcccccccagagccctcaccacgctgggcgcccccagagcccacaccatgccgggcacctacgctccctcgaccacactcagtagtcccagcacccagggcctgcaagagcaggcacgggccctgatgcgggacttcccgctcgtggacggccacaacgacctgcccctggtcctaaggcaggtttaccagaaagggctacaggatgttaacctgcgcaatttcagctacggccagaccagcctggacaggcttagagatggcctcgtgggcgcccagttctggtcagcctatgtgccatgccagacccaggaccgggatgccctgcgcctcaccctggagcagattgacctcatacgccgcatgtgtgcctcctattctgagctggagcttgtgacctcggctaaagctctgaacgacactcagaaattggcctgcctcatcggtgtagagggtggccactcgctggacaatagcctctccatcttacctaccttctacatgctgggagtgcgctacctgacgctcacccacacctgcaacacaccctgggcagagagctccgctaagggcgtccactccttctacaacaacatcagcgggctgactgactttggtgagaaggtggtggcagaaatgaaccgcctgggcatgatggtagacttatcccatgtctcagatgctgtggcacggcgggccctggaagtgtcacaggcacctgtgatcttctcccactcggctgcccggggtgtgtgcaacagtgctcggaatgttcctgatgacatcctgcagcttctgaagaagaacggtggcgtcgtgatggtgtctttgtccatgggagtaatacagtgcaacccatcagccaatgtgtccactgtggcagatcacttcgaccacatcaaggctgtcattggatccaagttcatcgggattggtggagattatgatggggccggcaaattccctcaggggctggaagacgtgtccacatacccggtcctgatagaggagttgctgagtcgtggctggagtgaggaagagcttcagggtgtccttcgtggaaacctgctgcgggtcttcagacaagtggaaaaggtacaggaagaaaacaaatggcaaagccccttggaggacaagttcccggatgagcagctgagcagttcctgccactccgacctctcacgtctgcgtcagagacagagtctgacttcaggccaggaactcactgagattcccatacactggacagccaagttaccagccaagtggtcagtctcagagtcctccccccacatggccccagtccttgcagttgtggccaccttcccagtccttattctgtggctctgatgacccagttagtcctgccagatgtcactgtagcaagccacagacaccccacaaagttcccctgttgtgcaggcacaaatatttcctgaaataaatgttttggacatagaaa

SEQ ID NO: 8426 - DNA, 2236 bp, Homo sapiens
agactattgtttcttgggaattgtctgtatcagacatcatgggagcagatccagggcgacatcaaagggaagcatgagtctccaggaccagaggggcttggatgcagatgatcatcatctgggcactgctggatactgaagttctcattatgttgcctagactggtctcaaacctccggcttcaagagatcctctcacctcgaccttcaaattactgggattacaggcatgagccaccatgtcctaccagactttgttaaaagaggaacaggccaggcatcgtgggctcacatgaacactcatgccccagaagtaaacaagtgttagccaaccaggaggcctatcctccccctaacctcacccaaagccatctctgtgccctcccccttgcaggggaaacagcacacactagtgaaatcttgtcttagtgtgtccggaattggtgggttcttggtctcactgagttctagaatgaagctgcagaccctcgcagtgagtgttacagctcttaaggtagcgcgtctggagtttgtttcttttgatgtttggatgtttggagtttcttccttctggtgggtttgtggtcttgttggctcaggagtgaagctgcagaccttcgtggctctctgactgccacccctgcctgcctgcccggccctgcacaacatgcagccctccggcctcgagggtcccggcacgtttggtcggtggcctctgctgagtctgctgctcctgctgctgctgctccagcctgtaacctgtgcctacaccacgccaggcccccccagagccctcaccacgctgggcgcccccagagcccacaccatgccgggcacctacgctccctcgaccacactcagtagtcccagcacccagggcctgcaagagcaggcacgggccctgatgcgggacttcccgctcgtggacggccacaacgacctgcccctggtcctaaggcaggtttaccagaaagggctacaggatgttaacctgcgcaatttcagctacggccagaccagcctggacaggcttagagatggcctcgtgggcgcccagttctggtcagcctatgtgccatgccagacccaggaccgggatgccctgcgcctcaccctggagcagattgacctcatacgccgcatgtgtgcctcctattctgagctggagcttgtgacctcggctaaagctctgaacgacactcagaaattggcctgcctcatcggtgtagagggtggccactcgctggacaatagcctctccatcttacctaccttctacatgctgggagtgcgctacctgacgctcacccacacctgcaacacaccctgggcagagagctccgctaagggcgtccactccttctacaacaacatcagcgggctgactgactttggtgagaaggtggtggcagaaatgaaccgcctgggcatgatggtagacttatcccatgtctcagatgctgtggcacggcgggccctggaagtgtcacaggcacctgtgatcttctcccactcggctgcccggggtgtgtgcaacagtgctcggaatgttcctgatgacatcctgcagcttctgaagaagaacggtggcgtcgtgatggtgtctttgtccatgggagtaatacagtgcaacccatcagccaatgtgtccactgtggcagatcacttcgaccacatcaaggctgtcattggatccaagttcatcgggattggtggagattatgatggggccggcaaattccctcaggggctggaagacgtgtccacatacccggtcctgatagaggagttgctgagtcgtggctggagtgaggaagagcttcagggtgtccttcgtggaaacctgctgcgggtcttcagacaagtggaaaaggtacaggaagaaaacaaatggcaaagccccttggaggacaagttcccggatgagcagctgagcagttcctgccactccgacctctcacgtctgcgtcagagacagagtctgacttcaggccaggaactcactgagattcccatacactggacagccaagttaccagccaagtggtcagtctcagagtcctccccccacatggccccagtccttgcagttgtggccaccttcccagtccttattctgtggctctgatgacccagttagtcctgccagatgtcactgtagcaagccacagacaccccacaaagttcccctgttgtgcaggcacaaatatttcctgaaataaatgttttggacatag

SEQ ID NO: 8427 - DNA, 1999 bp, Homo sapiens
aaaccagacagaccgaattaactcttctgagtcgcagcttagaatatttgacctgcctaggagctgggcacaagccggcagctaaccgccacgtgggcctgggtaggaggtgagatcaggaagatccctgggcccctactagttccctgcctggcctcctcccccactcgtgtgggggtctacggagccagcgctgggggtggaagggcgaggagtcctcgacgctgcagcggcggttccggcccatgggggcgctctcctgcttgggggcggaaaagccgtggcgcccccttgcgtggcgcgtcggtctcagagtcgcgtgacttcaaccccctcttcgggaggctgggtcgtcatgatccggaccccattgtcggcctctgcccatcgcctgctcctcccaggctcccgcggccgacccccgcgcaacatgcagcccacgggccgcgagggttcccgcgcgctcagccggcggtatctgcggcgtctgctgctcctgctactgctgctgctgctgcggcagcccgtaacccgcgcggagaccacgccgggcgcccccagagccctctccacgctgggctcccccagcctcttcaccacgccgggtgtccccagcgccctcactaccccaggcctcactacgccaggcacccccaaaaccctggaccttcggggtcgcgcgcaggccctgatgcggagtttcccactcgtggacggccacaatgacctgccccaggtcctgagacagcgttacaagaatgtgcttcaggatgttaacctgcgaaatttcagccatggtcagaccagcctggacaggcttagagacggcctcgtgggtgcccagttctggtcagcctccgtctcatgccagtcccaggaccagactgccgtgcgcctcgccctggagcagattgacctcattcaccgcatgtgtgcctcctactctgaactcgagcttgtgacctcagctgaaggtctgaacagctctcaaaagctggcctgcctcattggcgtggagggtggtcactcactggacagcagcctctctgtgctgcgcagtttctatgtgctgggggtgcgctacctgacacttaccttcacctgcagtacaccatgggcagagagttccaccaagttcagacaccacatgtacaccaacgtcagcggattgacaagctttggtgagaaagtagtagaggagttgaaccgcctgggcatgatgatagatttgtcctatgcatcggacaccttgataagaagggtcctggaagtgtctcaggctcctgtgatcttctcccactcagctgccagagctgtgtgtgacaatttgttgaatgttcccgatgatatcctgcagcttctgaagaagaacggtggcatcgtgatggtgacactgtccatgggggtgctgcagtgcaacctgcttgctaacgtgtccactgtggcagatcactttgaccacatcagggcagtcattggatctgagttcatcgggattggtggaaattatgacgggactggccggttccctcaggggctggaggatgtgtccacatacccagtcctgatagaggagttgctgagtcgtagctggagcgaggaagagcttcaaggtgtccttcgtggaaacctgctgcgggtcttcagacaagtggaaaaggtgagagaggagagcagggcgcagagccccgtggaggctgagtttccatatgggcaactgagcacatcctgccactcccacctcgtgcctcagaatggacaccaggctactcatctggaggtgaccaagcagccaaccaatcgggtcccctggaggtcctcaaatgcctccccataccttgttccaggccttgtggctgctgccaccatcccaaccttcacccagtggctctgctgacacagtcggtccccgcagaggtcactgtggcaaagcctcacaaagccccctctcctagttcattcacaagcatatgctgagaataaacatgttacacatgga

SEQ ID NO: 8428 - DNA, 3052 bp, Homo sapiens
ggctgggctcccgcgcctccctcttctcaccctcccccgccccgccccagttccaggctctcctgcttctccacggactctgcgggaagttagagcctctgcgtgcgctccggggcccggcgagaggatgcgcaaggtggagagccgcggggaagggggcagagaggaactgggaagtaacagccctccacagagaaactggaagggaattgctattgctctgctggtgattttagttgtatgctcactcatcactatgtcagtcatcctcttaaccccagatgaactcacaaattcgtcagaaaccagattgtctttggaagacctctttaggaaagactttgtgcttcacgatccagaggctcggtggatcaatgatacagatgtggtgtataaaagcgagaatggacatgtcattaaactgaatatagaaacaaatgctaccacattattattggaaaacacaacttttgtaaccttcaaagcatcaagacattcagtttcaccagatttaaaatatgtccttctggcatatgatgtcaaacagatttttcattattcgtatactgcttcatatgtgatttacaacatacacactagggaagtttgggagttaaatcctccagaagtagaggactccgtcttgcagtacgcggcctggggtgtccaagggcagcagctgatttatatttttgaaaataatatctactatcaacctgatataaagagcagttcattgcgactgacatcttctggaaaagaagaaataatttttaatgggattgctgactggttatatgaagaggaactcctgcattctcacatcgcccactggtggtcaccagatggagaaagacttgccttcctgatgataaatgactctttggtacccaccatggttatccctcggtttactggagcgttgtatcccaaaggaaagcagtatccgtatcctaaggcaggtcaagtgaacccaacaataaaattatatgttgtaaacctgtatggaccaactcacactttggagctcatgccacctgacagctttaaatcaagagaatactatatcactatggttaaatgggtaagcaataccaagactgtggtaagatggttaaaccgagctcagaacatctccatcctcacagtctgtgagaccactacaggtgcttgtagtaaaaaatatgagatgacatcagatacgtggctctctcagcagaatgaggagcccgtgttttctagagacggcagcaaattctttatgacagtgcctgttaagcaagggggacgtggagaatttcaccacgtagctatgttcctcatccagagtaaaagtgagcaaattaccgtgcggcatctgacatcaggaaactgggaagtgataaagatcttggcatacgatgaaactactcaaaaaatttactttctgagcactgaatcttctcccagaggaaggcagctgtacagtgcttctactgaaggattattgaatcgccaatgcatttcatgtaatttcatgaaagaacaatgtacatattttgatgccagttttagtcccatgaatcaacatttcttattattctgtgaaggtccaagggtcccagtggtcagcctacatagtacggacaacccagcaaaatattttatattggaaagcaattctatgctgaaggaagctatcctgaagaagaagataggaaagccagaaattaaaatccttcatattgacgactatgaacttcctttacagttgtcccttcccaaagattttatggaccgaaaccagtatgctcttctgttaataatggatgaagaaccaggaggccagctggttacagataagttccatattgactgggattccgtactcattgacatggataatgtcattgtagcaagatttgatggcagaggaagtggattccagggtctgaaaattttgcaggagattcatcgaagattaggttcagtagaagtaaaggaccaaataacagctgtgaaatttttgctgaaactgccttacattgactccaaaagattaagcatttttggaaagggttatggtggctatattgcatcaatgatcttaaaatcagatgaaaagctttttaaatgtggatccgtggttgcacctatcacagacttgaaattgtatgcctcagctttctctgaaagataccttgggatgccatctaaggaagaaagcacttaccaggcagccagtgtgctacataatgttcatggcttgaaagaagaaaatatattaataattcatggaactgctgacacaaaagttcatttccaacactcagcagaattaatcaagcacctaataaaagctggagtgaattatactatgcaggtctacccagatgaaggtcataacgtatctgagaagagcaagtatcatctctacagcacaatcctcaaattcttcagtgattgtttgaaggaagaaatatctgtgctaccacaggaaccagaagaagatgaataatggactgtatttatacagaactgaagggaatattgaggctcaatgaaacctgacaaagagactgtaatattgtagttgctccagaatgtcaagggcagcttacggagatgtcactggagcagcacgctcagagacagtgaactagcatttgaatacacaagtccaagtctactgtgttgctaggggtgcagaacccgtttctttgtatgagagaggtcaaagggttggtttcctgggagaaattagttttgcattaaagtaggagtagtgcatgttttcttctgttatccccctgtttgttctgtaactagttgctctcattttaatttcactggccaccatcatctttgcatataatgcacaatctatcatctgtcctacagtccctgatctttcatggctgagctgcaatctaacactttactgtacctttataataagtgcaattctttcattgtctattattatgcttaagaaaatattcagttaataaaaaacagagtattttatgtaatttctgtttttaaaaagacattattaaatgggtcaaaggac

SEQ ID NO: 8429 - DNA, 2758 bp, Homo sapiens
aagaaggcacgaggcgtcgccgcagctcggtcaggggccggggccccgccgctcgccgctgcactaacttgccgcttggtctcgcctcgccgccgcggctcgctgcgctttgggtggcggggggcggggagagcggggagtcagagggtctgcggtggccgagggagggaccctacgacggggagcccgcccggtgccgctcttcttcccctccccgcccctccgctccccccaccccgtcccttccgccgattccgggagcgacgggcgcccgtgacctgcgaacgctgccaagtgacggtccccgagtctgaagcgcccgcgaggaagcgagcgccagcgcgggccgccggcgatgacggccgcgaagcaggagccgcagcccaccccgggggccagggcgagccaggcgcagccggcggaccaggaactgggaagtaacagccctccacagagaaactggaagggaattgctattgctctgctggtgattttagttgtatgctcactcatcactatgtcagtcatcctcttaaccccagatgaactcacaaattcgtcagaaaccagattgtctttggaagacctctttaggaaagactttgtgcttcacgatccagaggctcggtggatcaatgatacagatgtggtgtataaaagcgagaatggacatgtcattaaactgaatatagaaacaaatgctaccacattattattggaaaacacaacttttgtaaccttcaaagcatcaagacattcagtttcaccagatttaaaatatgtccttctggcatatgatgtcaaacagatttttcattattcgtatactgcttcatatgtgatttacaacatacacactagggaagtttgggagttaaatcctccagaagtagaggactccgtcttgcagtacgcggcctggggtgtccaagggcagcagctgatttatatttttgaaaataatatctactatcaacctgatataaagagcagttcattgcgactgacatcttctggaaaagaagaaataatttttaatgggattgctgactggttatatgaagaggaactcctgcattctcacatcgcccactggtggtcaccagatggagaaagacttgccttcctgatgataaatgactctttggtacccaccatggttatccctcggtttactggagcgttgtatcccaaaggaaagcagtatccgtatcctaaggcaggtcaagtgaacccaacaataaaattatatgttgtaaacctgtatggaccaactcacactttggagctcatgccacctgacagctttaaatcaagagaatactatatcactatggttaaatgggtaagcaataccaagactgtggtaagatggttaaaccgagctcagaacatctccatcctcacagtctgtgagaccactacaggtgcttgtagtaaaaaatatgagatgacatcagatacgtggctctctcagcagaatgaggagcccgtgttttctagagacggcagcaaattctttatgacagtgcctgttaagcaagggggacgtggagaatttcaccacgtagctatgttcctcatccagagtaaaagtgagcaaattaccgtgcggcatctgacatcaggaaactgggaagtgataaagatcttggcatacgatgaaactactcaaaaaatttactttctgagcactgaatcttctcccagaggaaggcagctgtacagtgcttctactgaaggattattgaatcgccaatgcatttcatgtaatttcatgaaagaacaatgtacatattttgatgccagttttagtcccatgaatcaacatttcttattattctgtgaaggtccaagggtcccagtggtcagcctacatagtacggacaacccagcaaaatattttatattggaaagcaattctatgctgaaggaagctatcctgaagaagaagataggaaagccagaaattaaaatccttcatattgacgactatgaacttcctttacagttgtcccttcccaaagattttatggaccgaaaccagtatgctcttctgttaataatggatgaagaaccaggaggccagctggttacagataagttccatattgactgggattccgtactcattgacatggataatgtcattgtagcaagatttgatggcagaggaagtggattccagggtctgaaaattttgcaggagattcatcgaagattaggttcagtagaagtaaaggaccaaataacagctgtgaaatttttgctgaaactgccttacattgactccaaaagattaagcatttttggaaagggttatggtggctatattgcatcaatgatcttaaaatcagatgaaaagctttttaaatgtggatccgtggttgcacctatcacagacttgaaattgtatgcctcagctttctctgaaagataccttgggatgccatctaaggaagaaagcacttaccaggcagccagtgtgctacataatgttcatggcttgaaagaagaaaatatattaataattcatggaactgctgacacaaaagttcatttccaacactcagcagaattaatcaagcacctaataaaagctggagtgaattatactatgcaggtctacccagatgaaggtcataacgtatctgagaagagcaagtatcatctctacagcacaatcctcaaattcttcagtgattgtttgaaggaagaaatatctgtgctaccacaggaaccagaagaagatgaataa

SEQ ID NO: 8430 - DNA, 6278 bp, Homo sapiens
aaatattttgcactggaaaaactataatctggagagacagaggagttgagagtgcccctttaaactgcaggactgcaattgatctctgtatgttttctggttttcgtccctttgaaaggggaatgagagccaggatcattggctgtactgtggagctgtcacatctccatactgaaaaggtacactgcaagtgaatttaaaccgtttttggctttctattgcatattgccaagagctttgagactgatgaaccaagtaaatgctctatttagggctaagtgagatacagattcctccaatctgatagcgtttcagcctccggagtgaggaagcagcagaaacagaagcagcagaagcaacagcagtagcagcggcagcagcaacagcagcagcccctactgaagtccaatagaggagacttgatctctagttcattctggaactccgcctgggattgtgcactgtccagggtcctgaaacatgaaccaaactgccagcgtgtcccatcacatcaagtgtcaaccctcaaaaacaatcaaggaactgggaagtaacagccctccacagagaaactggaagggaattgctattgctctgctggtgattttagttgtatgctcactcatcactatgtcagtcatcctcttaaccccagatgaactcacaaattcgtcagaaaccagattgtctttggaagacctctttaggaaagactttgtgcttcacgatccagaggctcggtggatcaatgatacagatgtggtgtataaaagcgagaatggacatgtcattaaactgaatatagaaacaaatgctaccacattattattggaaaacacaacttttgtaaccttcaaagcatcaagacattcagtttcaccagatttaaaatatgtccttctggcatatgatgtcaaacagatttttcattattcgtatactgcttcatatgtgatttacaacatacacactagggaagtttgggagttaaatcctccagaagtagaggactccgtcttgcagtacgcggcctggggtgtccaagggcagcagctgatttatatttttgaaaataatatctactatcaacctgatataaagagcagttcattgcgactgacatcttctggaaaagaagaaataatttttaatgggattgctgactggttatatgaagaggaactcctgcattctcacatcgcccactggtggtcaccagatggagaaagacttgccttcctgatgataaatgactctttggtacccaccatggttatccctcggtttactggagcgttgtatcccaaaggaaagcagtatccgtatcctaaggcaggtcaagtgaacccaacaataaaattatatgttgtaaacctgtatggaccaactcacactttggagctcatgccacctgacagctttaaatcaagagaatactatatcactatggttaaatgggtaagcaataccaagactgtggtaagatggttaaaccgagctcagaacatctccatcctcacagtctgtgagaccactacaggtgcttgtagtaaaaaatatgagatgacatcagatacgtggctctctcagcagaatgaggagcccgtgttttctagagacggcagcaaattctttatgacagtgcctgttaagcaagggggacgtggagaatttcaccacgtagctatgttcctcatccagagtaaaagtgagcaaattaccgtgcggcatctgacatcaggaaactgggaagtgataaagatcttggcatacgatgaaactactcaaaaaatttactttctgagcactgaatcttctcccagaggaaggcagctgtacagtgcttctactgaaggattattgaatcgccaatgcatttcatgtaatttcatgaaagaacaatgtacatattttgatgccagttttagtcccatgaatcaacatttcttattattctgtgaaggtccaagggtcccagtggtcagcctacatagtacggacaacccagcaaaatattttatattggaaagcaattctatgctgaaggaagctatcctgaagaagaagataggaaagccagaaattaaaatccttcatattgacgactatgaacttcctttacagttgtcccttcccaaagattttatggaccgaaaccagtatgctcttctgttaataatggatgaagaaccaggaggccagctggttacagataagttccatattgactgggattccgtactcattgacatggataatgtcattgtagcaagatttgatggcagaggaagtggattccagggtctgaaaattttgcaggagattcatcgaagattaggttcagtagaagtaaaggaccaaataacagctgtgaaatttttgctgaaactgccttacattgactccaaaagattaagcatttttggaaagggttatggtggctatattgcatcaatgatcttaaaatcagatgaaaagctttttaaatgtggatccgtggttgcacctatcacagacttgaaattgtatgcctcagctttctctgaaagataccttgggatgccatctaaggaagaaagcacttaccaggcagccagtgtgctacataatgttcatggcttgaaagaagaaaatatattaataattcatggaactgctgacacaaaagttcatttccaacactcagcagaattaatcaagcacctaataaaagctggagtgaattatactatgcaggtctacccagatgaaggtcataacgtatctgagaagagcaagtatcatctctacagcacaatcctcaaattcttcagtgattgtttgaaggaagaaatatctgtgctaccacaggaaccagaagaagatgaataatggactgtatttatacagaactgaagggaatattgaggctcaatgaaacctgacaaagagactgtaatattgtagttgctccagaatgtcaagggcagcttacggagatgtcactggagcagcacgctcagagacagtgaactagcatttgaatacacaagtccaagtctactgtgttgctaggggtgcagaacccgtttctttgtatgagagaggtcaaagggttggtttcctgggagaaattagttttgcattaaagtaggagtagtgcatgttttcttctgttatccccctgtttgttctgtaactagttgctctcattttaatttcactggccaccatcatctttgcatataatgcacaatctatcatctgtcctacagtccctgatctttcatggctgagctgcaatctaacactttactgtacctttataataagtgcaattctttcattgtctattattatgcttaagaaaatattcagttaataaaaaacagagtattttatgtaatttctgtttttaaaaagacattattaaatgggtcaaaggacatatagaaatgtggatttcagcaccttccaaagttcagccagttatcagtagatacaatatctttaaatgaacacacgagtgtatgtctcacaatatatatacacaagtgtgcatatacagttaatgaaactatctttaaatgttattcatgctataaagagtaaacgtttgatgaattagaagagatgctcttttccaagctataatggatgctttgtttaatgagccaaatatgatgaaacattttttccaattcaaattctagctattgctttcctataaatgtttgggttgtgtttggtattgtttttagtggttaatagttttccagttgcatttaattttttgaatatgataccttgtcacatgtaaattagatacttaaatattaaattatagtttctgataaagaaattttgttaacaatgcaatgccactgagtgctattttgctcttttggtggagaaggcttttttcaaaactcttggtccttttacttctttctctcagtgcagaatcaattctcattttcatcgtaaaagcaaatagctggattatttcatttgccagtttctatttagtattccatgcctgcccaattcatctgttactgtttaatttcaattcttctggtgagaattagaaatgaaatattttttattcattggccaaaaagttcacagacagcagtgtttgctatttactttgaattgaaggcacaaaatgcatcaattcctgtgctgtgttgacttgcagtagtaagtaactgagagcataaaataaacctgactgtatgaagtcaatttaagtgatgagaacatttaactttggtgactaaagtcagaatatcttctcacttcacttaagggatcttccagaagatatctaaaagtctgtaataagcttagaagttcagataaatctaggcaggatactgcatttttgtggttttaaaaaagtccttaggacagactgaattatcataacttatggcatcaggaggaaactttaaaatatcaaggaatcactcagtcaccctcctgttttgttgaaggatcaaccccaaattctgggtatttgagtacatgtgaatcatggatttggtattcaactttttccctggatgctttggaatcgtgtcttccatgctccactgggttcaatttaaaataggagaggctttctcttctgaaagatccattttaggtctttttcaagaatagtgaacacattttttaacaaaataagttgtaattttaaaaggaaagttttgcctattttattaagatggaaatttctttttaggctaatttgaaatccaactgaagctttttaaccaatattttaaatttgaaccactagagttttttatgatgcaaatgattatgttgtctgaaaggtgtggttttattgaatgtctatttgagtatcatttaaaaagtatttgccttttactgtcatcatttctcttgttttattattattatcaatgtttatctatttttcaattaatttaatacagtttctaatgtgaaagacatttttctggaacccgttttccccttaaacactaaagagacctcaagtgaaagcatattgcttagtaggaaggtagaaaatgttaatccctgcgattctttgagttttaatgacagggtcattttcagtaaaggaaatgctcaccaacacatagtcaccaactattaaaggaatcatgtgattggattttcccctgtatacatgtacccttggtcataatcccactatttcatacatatttatgcattgctagattttcctaggactccaatagcatgctttccaagtgttattattcccttaatgttaaagaaaaaaatcaatatattgaattctttaattaaataggtaagcagtattaaatcatccacagagataaacaatctcttgaaactcttttgaaagagaaaagtgtttgttcactttcattgccttcattaagatctccaaatactcagagactaagcaggctattctcatctctttgagtttcctgacagaactaaaggaaggaatcactcttcaaaagatggatctcacttcactctgaaaatgtgcctttttttaattgggtgtttagcataaaaatcactattggggatcttacagatgtctgttgtagatctattacaatgaggtgacttagacattgggctttaccatattagagaattacttaagccattgtccttcaaatgttgggcttggagacagaagtaccttggactgaattgctttcaagtctctagaatcactgacagcacatagcttctatgaggagttatatatgaaataccacttgtgtccctcctcaagttctctgaccaccttcacatcctgcggccaccaacactgtatggatacaatctggcctctcagctctgctcactttcactttctgttctggggattctctgatactaattttggctacttggtagaaccaagagacaaatcgcttacatgctgcaaaccgatgtgaaggtgttactaacccgctaaaacacaattaatgaaagactgtagcaggtaactgatctttccctcagatattctacatggtccatggaagactctgtgggccgcagaagcccatagctgcatacccttctattttcctcttccccatttcactcttttaagctccctactcctattccctatgatcactttccaaaataaacggcaggtgtgctagctgttgtcttagactctgctttctggaaactatttttcccctccacaagaaattatcactgtgaatattacaggaggagaaataaaataagaataaatcagtggtttattttca

SEQ ID NO: 8431 - DNA, 565 bp, Homo sapiens
gtacaaaggattctcaggtcaatagctagattttactaaactggccctgaaaattttataattttgattctcaatagcagttttctgtactctagtctgtgagttactggggaacatttgaaggcaagaagaatagcagttaatacggcgtgccaccttctcaccatgcacactggattcgcaggaactgggaagtaacagccctccacagagaaactggaagggaattgctattgctctgctggtgattttagttgtatgctcactcatcactatgtcagtcatcctcttaaccccagatgaactcacaaattcgtcagaaaccagattgtctttggaagacctctttaggaaagactttgtgcttcacgatccagaggctcggtggatcaatgatacagatgtggtgtataaaagcgagaatggacatgtcattaaactgaatatagaaacaaatgctaccacattattattggaaaacacaacttttgtaaccttcaaagcatcaagacattcagtttcaccagatttaaaatatgtccttctggcatatgatgtcaaacag

SEQ ID NO: 8432 - DNA, 4646 bp, Homo sapiens
ctctctatccttatactgacatctaatgaactcacaaattcgtcagaaaccagattgtctttggaagacctctttaggaaagactttgtgcttcacgatccagaggctcggtggatcaatgatacagatgtggtgtataaaagcgagaatggacatgtcattaaactgaatatagaaacaaatgctaccacattattattggaaaacacaacttttgtaaccttcaaagcatcaagacattcagtttcaccagatttaaaatatgtccttctggcatatgatgtcaaacagatttttcattattcgtatactgcttcatatgtgatttacaacatacacactagggaagtttgggagttaaatcctccagaagtagaggactccgtcttgcagtacgcggcctggggtgtccaagggcagcagctgatttatatttttgaaaataatatctactatcaacctgatataaagagcagttcattgcgactgacatcttctggaaaagaagaaataatttttaatgggattgctgactggttatatgaagaggaactcctgcattctcacatcgcccactggtggtcaccagatggagaaagacttgccttcctgatgataaatgactctttggtacccaccatggttatccctcggtttactggagcgttgtatcccaaaggaaagcagtatccgtatcctaaggcaggtcaagtgaacccaacaataaaattatatgttgtaaacctgtatggaccaactcacactttggagctcatgccacctgacagctttaaatcaagagaatactatatcactatggttaaatgggtaagcaataccaagactgtggtaagatggttaaaccgagctcagaacatctccatcctcacagtctgtgagaccactacaggtgcttgtagtaaaaaatatgagatgacatcagatacgtggctctctcagcagaatgaggagcccgtgttttctagagacggcagcaaattctttatgacagtgcctgttaagcaagggggacgtggagaatttcaccacgtagctatgttcctcatccagagtaaaagtgagcaaattaccgtgcggcatctgacatcaggaaactgggaagtgataaagatcttggcatacgatgaaactactcaaaaaatttactttctgagcactgaatcttctcccagaggaaggcagctgtacagtgcttctactgaaggattattgaatcgccaatgcatttcatgtaatttcatgaaagaacaatgtacatattttgatgccagttttagtcccatgaatcaacatttcttattattctgtgaaggtccaagggtcccagtggtcagcctacatagtacggacaacccagcaaaatattttatattggaaagcaattctatgctgaaggaagctatcctgaagaagaagataggaaagccagaaattaaaatccttcatattgacgactatgaacttcctttacagttgtcccttcccaaagattttatggaccgaaaccagtatgctcttctgttaataatggatgaagaaccaggaggccagctggttacagataagttccatattgactgggattccgtactcattgacatggataatgtcattgtagcaagatttgatggcagaggaagtggattccagggtctgaaaattttgcaggagattcatcgaagattaggttcagtagaagtaaaggaccaaataacagctgtgaaatttttgctgaaactgccttacattgactccaaaagattaagcatttttggaaagggttatggtggctatattgcatcaatgatcttaaaatcagatgaaaagctttttaaatgtggatccgtggttgcacctatcacagacttgaaattgtatgcctcagctttctctgaaagataccttgggatgccatctaaggaagaaagcacttaccaggcagccagtgtgctacataatgttcatggcttgaaagaagaaaatatattaataattcatggaactgctgacacaaaagttcatttccaacactcagcagaattaatcaagcacctaataaaagctggagtgaattatactatgcaggtctacccagatgaaggtcataacgtatctgagaagagcaagtatcatctctacagcacaatcctcaaattcttcagtgattgtttgaaggaagaaatatctgtgctaccacaggaaccagaagaagatgaataatggactgtatttatacagaactgaagggaatattgaggctcaatgaaacctgacaaagagactgtaatattgtagttgctccagaatgtcaagggcagcttacggagatgtcactggagcagcacgctcagagacagtgaactagcatttgaatacacaagtccaagtctactgtgttgctaggggtgcagaacccgtttctttgtatgagagaggtcaaagggttggtttcctgggagaaattagttttgcattaaagtaggagtagtgcatgttttcttctgttatccccctgtttgttctgtaactagttgctctcattttaatttcactggccaccatcatctttgcatataatgcacaatctatcatctgtcctacagtccctgatctttcatggctgagctgcaatctaacactttactgtacctttataataagtgcaattctttcattgtctattattatgcttaagaaaatattcagttaataaaaaacagagtattttatgtaatttctgtttttaaaaagacattattaaatgggtcaaaggacatatagaaatgtggatttcagcaccttccaaagttcagccagttatcagtagatacaatatctttaaatgaacacacgagtgtatgtctcacaatatatatacacaagtgtgcatatacagttaatgaaactatctttaaatgttattcatgctataaagagtaaacgtttgatgaattagaagagatgctcttttccaagctataatggatgctttgtttaatgagccaaatatgatgaaacattttttccaattcaaattctagctattgctttcctataaatgtttgggttgtgtttggtattgtttttagtggttaatagttttccagttgcatttaattttttgaatatgataccttgtcacatgtaaattagatacttaaatattaaattatagtttctgataaagaaattttgttaacaatgcaatgccactgagtgctattttgctcttttggtggagaaggcttttttcaaaactcttggtccttttacttctttctctcagtgcagaatcaattctcattttcatcgtaaaagcaaatagctggattatttcatttgccagtttctatttagtattccatgcctgcccaattcatctgttactgtttaatttcaattcttctggtgagaattagaaatgaaatattttttattcattggccaaaaagttcacagacagcagtgtttgctatttactttgaattgaaggcacaaaatgcatcaattcctgtgctgtgttgacttgcagtagtaagtaactgagagcataaaataaacctgactgtatgaagtcaatttaagtgatgagaacatttaactttggtgactaaagtcagaatatcttctcacttcacttaagggatcttccagaagatatctaaaagtctgtaataagcttagaagttcagataaatctaggcaggatactgcatttttgtggttttaaaaaagtccttaggacagactgaattatcataacttatggcatcaggaggaaactttaaaatatcaaggaatcactcagtcaccctcctgttttgttgaaggatcaaccccaaattctgggtatttgagtacatgtgaatcatggatttggtattcaactttttccctggatgctttggaatcgtgtcttccatgctccactgggttcaatttaaaataggagaggctttctcttctgaaagatccattttaggtctttttcaagaatagtgaacacattttttaacaaaataagttgtaattttaaaaggaaagttttgcctattttattaagatggaaatttctttttaggctaatttgaaatccaactgaagctttttaaccaatattttaaatttgaaccactagagttttttatgatgcaaatgattatgttgtctgaaaggtgtggttttattgaatgtctatttgagtatcatttaaaaagtatttgccttttactgtcatcatttctcttgttttattattattatcaatgtttatctatttttcaattaatttaatacagtttctaatgtgaaagacatttttctggaacccgttttccccttaaacactaaagagacctcaagtgaaagcatattgcttagtaggaaggtagaaaatgttaatccctgcgattctttgagttttaatgacagggtcattttcagtaaaggaaatgctcaccaacacatagtcaccaactattaaaggaatcatgtgattggattttcccctgtatacatgtacccttggtcataatcccactatttcatacatatttatgcattgctagattttcctaggactccaatagcatgctttccaagtgttattattcccttaatgttaa

SEQ ID NO: 8433 - DNA, 3883 bp, Homo sapiens
aagacctagaaggctttaagaaagacagggtaatattttgctggtgtagagggcctgctcttcggagacaaatacttgcttttcattttgatcagccgtctgcacttaaaagcctcctagccagggacatgttaattaaacagtctggggctcagtgctgccatccgtaaattggaggattagagaaataatatacacaagtacctggtacataccaaatatgatagaagatatcttcaacctttagctataagaagaatggaaaatgaaaaagagacaggtggagagagggagggagatgagagctgcgtggagctggtatgctggttaggaggtaggaaataatgaggcctcgaccatctaagatacagaagtctccctgctgaatcgaaaggaagtgctacaatattctttcaaattcatcgcagttgagagaaaactggagcagagtgtgatatcaagaaagggcttcaccaggatgatcaatgcaaatggatatggagctttcttggaatgaaacattatcccgtaacaccaggtatacatacatgaagagtggcttcaggactggaactgggaagtaacagccctccacagagaaactggaagggaattgctattgctctgctggtgattttagttgtatgctcactcatcactatgtcagtcatcctcttaaccccagatgaactcacaaattcgtcagaaaccagattgtctttggaagacctctttaggaaagactttgtgcttcacgatccagaggctcggtggatcaatgatacagatgtggtgtataaaagcgagaatggacatgtcattaaactgaatatagaaacaaatgctaccacattattattggaaaacacaacttttgtaaccttcaaagcatcaagacattcagtttcaccagatttaaaatatgtccttctggcatatgatgtcaaacagatttttcattattcgtatactgcttcatatgtgatttacaacatacacactagggaagtttgggagttaaatcctccagaagtagaggactccgtcttgcagtacgcggcctggggtgtccaagggcagcagctgatttatatttttgaaaataatatctactatcaacctgatataaagagcagttcattgcgactgacatcttctggaaaagaagaaataatttttaatgggattgctgactggttatatgaagaggaactcctgcattctcacatcgcccactggtggtcaccagatggagaaagacttgccttcctgatgataaatgactctttggtacccaccatggttatccctcggtttactggagcgttgtatcccaaaggaaagcagtatccgtatcctaaggcaggtcaagtgaacccaacaataaaattatatgttgtaaacctgtatggaccaactcacactttggagctcatgccacctgacagctttaaatcaagagaatactatatcactatggttaaatgggtaagcaataccaagactgtggtaagatggttaaaccgagctcagaacatctccatcctcacagtctgtgagaccactacaggtgcttgtagtaaaaaatatgagatgacatcagatacgtggctctctcagcagaatgaggagcccgtgttttctagagacggcagcaaattctttatgacagtgcctgttaagcaagggggacgtggagaatttcaccacgtagctatgttcctcatccagagtaaaagtgagcaaattaccgtgcggcatctgacatcaggaaactgggaagtgataaagatcttggcatacgatgaaactactcaaaaaatttactttctgagcactgaatcttctcccagaggaaggcagctgtacagtgcttctactgaaggattattgaatcgccaatgcatttcatgtaatttcatgaaagaacaatgtacatattttgatgccagttttagtcccatgaatcaacatttcttattattctgtgaaggtccaagggtcccagtggtcagcctacatagtacggacaacccagcaaaatattttatattggaaagcaattctatgctgaaggaagctatcctgaagaagaagataggaaagccagaaattaaaatccttcatattgacgactatgaacttcctttacagttgtcccttcccaaagattttatggaccgaaaccagtatgctcttctgttaataatggatgaagaaccaggaggccagctggttacagataagttccatattgactgggattccgtactcattgacatggataatgtcattgtagcaagatttgatggcagaggaagtggattccagggtctgaaaattttgcaggagattcatcgaagattaggttcagtagaagtaaaggaccaaataacagctgtgaaatttttgctgaaactgccttacattgactccaaaagattaagcatttttggaaagggttatggtggctatattgcatcaatgatcttaaaatcagatgaaaagctttttaaatgtggatccgtggttgcacctatcacagacttgaaattgtatgcctcagctttctctgaaagataccttgggatgccatctaaggaagaaagcacttaccaggcagccagtgtgctacataatgttcatggcttgaaagaagaaaatatattaataattcatggaactgctgacacaaaagttcatttccaacactcagcagaattaatcaagcacctaataaaagctggagtgaattatactatgcaggtctacccagatgaaggtcataacgtatctgagaagagcaagtatcatctctacagcacaatcctcaaattcttcagtgattgtttgaaggaagaaatatctgtgctaccacaggaaccagaagaagatgaataatggactgtatttatacagaactgaagggaatattgaggctcaatgaaacctgacaaagagactgtaatattgtagttgctccagaatgtcaagggcagcttacggagatgtcactggagcagcacgctcagagacagtgaactagcatttgaatacacaagtccaagtctactgtgttgctaggggtgcagaacccgtttctttgtatgagagaggtcaaagggttggtttcctgggagaaattagttttgcattaaagtaggagtagtgcatgttttcttctgttatccccctgtttgttctgtaactagttgctctcattttaatttcactggccaccatcatctttgcatataatgcacaatctatcatctgtcctacagtccctgatctttcatggctgagctgcaatctaacactttactgtacctttataataagtgcaattctttcattgtctattattatgcttaagaaaatattcagttaataaaaaacagagtattttatgtaatttctgtttttaaaaagacattattaaatgggtcaaaggacatatagaaatgtggatttcagcaccttccaaagttcagccagttatcagtagatacaatatctttaaatgaacacacgagtgtatgtctcacaatatatatacacaagtgtgcatatacagttaatgaaactatctttaaatgttattcatgctataaagagtaaacgtttgatgaattagaagagatgctcttttccaagctataatggatgctttgtttaatgagccaaatatgatgaaacattttttccaattcaaattctagctattgctttcctataaatgtttgggttgtgtttggtattgtttttagtggttaatagttttccagttgcatttaattttttgaatatgataccttgtcacatgtaaattagatacttaaatattaaattatagtttctgataaagaaattttgttaacaa

SEQ ID NO: 8434 - DNA, 1389 bp, Homo sapiens
gcgaacggagcagctgctgcagcagggcccatggcggacacccagtacatcctgcccaatgacatcggcgtgtctagcctggactgccgtgaggccttccgcctgctgtcacccacagagcgcctctatgcctaccacctgtcccgtgccgcctggtacggaggcctggctgtgctgcttcagacctcccctgaggccccctacatctatgctctgctcagccgcctcttccgcgcccaggaccccgaccagctgcgccaacatgccctggctgaaggccttaccgaggaggagtatcaggcgttcctggtctatgccgcgggtgtttactccaacatgggcaactacaagtcctttggtgacaccaagtttgttcccaacttgcccaaggaaaagctggaacgggtgatcctagggagtgaggctgctcagcagcacccagaagaagtcaggggcctctggcagacctgcggggagcttatgttctctctggagccaaggcttcgacacctcggactggggaaggagggaatcaccacctatttctctgggaattgtaccatggaagatgcccgggtccgcctcgaccgcagcaagatccggtctgtgggcaagcctgctctagagcgcttcctgcggagacttcaggtgctgaagtccacaggggatgtggccggagggcgggccctgtacgaggggtatgcaacagtcactgatgcgccccccgagtgcttcctcaccctcagggacacggtgctgctgcgtaaggaatctcggaagctcattgttcagcccaacactcgccttgaaggctcagacgtgcagcttctggaatacgaggcgtcagctgctggcctcatccgatccttctctgagcgtttcccagaggatggacccgagttggaggagatcctcacacagctggccacagccgatgcccgattctggaagggccccagtgaggccccatctggccaagcttgaggaagatgtgtggccttgcccccaattccatcagaccaaggctgcaagtggccctccattcgtgtgtgtatttaggggctggggagggggaggggcaggagcttggaccttggtactacctcagctgagggtggtgacacaaccccttccatttgtcagcactttccagcctgccaattgcttcccctctgtgatctcatttcatctgcactgccatacgtggagtgagcaagacagggcttaccatcctgtctaccagatgaggaaatggcagttctgagaagtcactggtctagatcccgcaggtggcacgtgacagctagggttcaaaacgttctcaccaaatccaatgctcctcacatattaattttataaccagacaaataaatattagagacaaccacc

SEQ ID NO: 8435 - DNA, 2687 bp, Homo sapiens
aatgaatgggggagccggaagcaggaagtgagtttgcgaacggagcagctgctgcagcagggcccatggcggacacccagtacatcctgcccaatgacatcggcgtgtctagcctggactgccgtgaggccttccgcctgctgtcacccacagagcgcctctatgcctaccacctgtcccgtgccgcctggtacggaggcctggctgtgctgcttcagacctcccctgaggccccctacatctatgctctgctcagccgcctcttccgcgcccaggaccccgaccagctgcgccaacatgccctggctgaaggccttaccgaggaggagtatcaggcgttcctggtctatgccgcgggtgtttactccaacatgggcaactacaagtcctttggtgacaccaagtttgttcccaacttgcccaaggaaaagctggaacgggtgatcctagggagtgaggctgctcagcagcacccagaagaagtcaggggcctctggcagacctgcggggagcttatgttctctctggagccaaggcttcgacacctcggactggggaaggagggaatcaccacctatttctctgggaattgtaccatggaagatgccaaattggcccaggactttctggactcacagaacctcagtgcctacaacacccggctcttcaaagaggtcgatggagaagggaagccctactacgaggtgcggctggcttctgtgcttggctcagagccttccctggactctgaggtgacttccaagctgaagagctatgaattccggggaagccctttccaggtgacccggggggactacgcgcccatcctccagaaggtggtggagcagctggagaaagccaaggcctatgcagccaacagccaccaggggcagatgctggcccagtatatagagagcttcacccagggctccatcgaggcccacaagaggggctcccgcttctggatccaggacaaaggccccatcgtggagagttacatcgggttcatcgagagctaccgcgacccctttggttcccgaggagaatttgaaggtttcgtagctgtggtgaacaaggccatgagtgccaagtttgagcggctggtggcgagcgcagagcagctgctgaaggagctgccctggcccccaacctttgagaaggacaagttcctcacccctgacttcacctccctggatgttctcaccttcgctggctccggcatccctgccggcatcaacatccccaactacgatgatctgaggcagacggaaggctttaagaacgtgtcgctggggaatgtgctggctgtggcctacgccacgcagcgggagaagcttacctttctggaggaggatgacaaggacctgtacatcctctggaaggggccctccttcgatgtgcaggtgggcctgcacgagctgctgggccatggcagtggcaagctcttcgtacaggacgaaaaaggagcattcaactttgaccaggaaacagtgatcaacccagagacgggcgagcagattcagagctggtatcggagcggggagacctgggatagcaagttcagcaccatcgcctccagctacgaagagtgccgggctgagagcgtgggtctctacctctgtctccacccgcaagtgctggagatctttggctttgagggggctgatgcggaggacgtgatctacgtgaactggctcaacatggttcgggccgggctgctcgctctggagttctacacacctgaggccttcaactggcgacaggcccatatgcaggcccggtttgtgatcctgagagtcttgctggaggctggcgagggactcgttaccatcactcccaccacaggctccgatgggcgcccagatgcccgggtccgcctcgaccgcagcaagatccggtctgtgggcaagcctgctctagagcgcttcctgcggagacttcaggtgctgaagtccacaggggatgtggccggagggcgggccctgtacgaggggtatgcaacagtcactgatgcgccccccgagtgcttcctcaccctcagggacacggtgctgctgcgtaaggaatctcggaagctcattgttcagcccaacactcgccttgaaggctcagacgtgcagcttctggaatacgaggcgtcagctgctggcctcatccgatccttctctgagcgtttcccagaggatggacccgagttggaggagatcctcacacagctggccacagccgatgcccgattctggaagggccccagtgaggccccatctggccaagcttgaggaagatgtgtggccttgcccccaattccatcagaccaaggctgcaagtggccctccattcgtgtgtgtatttaggggctggggagggggaggggcaggagcttggaccttggtactacctcagctgagggtggtgacacaaccccttccatttgtcagcactttccagcctgccaattgcttcccctctgtgatctcatttcatctgcactgccatacgtggagtgagcaagacagggcttaccatcctgtctaccagatgaggaaatggcagttctgagaagtcactggtctagatcccgcaggtggcacgtgacagctagggttcaaaacgttctcaccaaatccaatgctcctcacatattaattttataaccagacaaataaatattagagacaaccaccatc

SEQ ID NO: 8436 - DNA, 2684 bp, Homo sapiens
aatgaatgggggagccggaagcaggaagtgagtttgcgaacggagcagctgctgcagggcccatggcggacacccagtacatcctgcccaatgacatcggcgtgtctagcctggactgccgtgaggccttccgcctgctgtcacccacagagcgcctctatgcctaccacctgtcccgtgccgcctggtacggaggcctggctgtgctgcttcagacctcccctgaggccccctacatctatgctctgctcagccgcctcttccgcgcccaggaccccgaccagctgcgccaacatgccctggctgaaggccttaccgaggaggagtatcaggcgttcctggtctatgccgcgggtgtttactccaacatgggcaactacaagtcctttggtgacaccaagtttgttcccaacttgcccaaggaaaagctggaacgggtgatcctagggagtgaggctgctcagcagcacccagaagaagtcaggggcctctggcagacctgcggggagcttatgttctctctggagccaaggcttcgacacctcggactggggaaggagggaatcaccacctatttctctgggaattgtaccatggaagatgccaaattggcccaggactttctggactcacagaacctcagtgcctacaacacccggctcttcaaagaggtcgatggagaagggaagccctactacgaggtgcggctggcttctgtgcttggctcagagccttccctggactctgaggtgacttccaagctgaagagctatgaattccggggaagccctttccaggtgacccggggggactacgcgcccatcctccagaaggtggtggagcagctggagaaagccaaggcctatgcagccaacagccaccaggggcagatgctggcccagtatatagagagcttcacccagggctccatcgaggcccacaagaggggctcccgcttctggatccaggacaaaggccccatcgtggagagttacatcgggttcatcgagagctaccgcgacccctttggttcccgaggagaatttgaaggtttcgtagctgtggtgaacaaggccatgagtgccaagtttgagcggctggtggcgagcgcagagcagctgctgaaggagctgccctggcccccaacctttgagaaggacaagttcctcacccctgacttcacctccctggatgttctcaccttcgctggctccggcatccctgccggcatcaacatccccaactacgatgatctgaggcagacggaaggctttaagaacgtgtcgctggggaatgtgctggctgtggcctacgccacgcagcgggagaagcttacctttctggaggaggatgacaaggacctgtacatcctctggaaggggccctccttcgatgtgcaggtgggcctgcacgagctgctgggccatggcagtggcaagctcttcgtacaggacgaaaaaggagcattcaactttgaccaggaaacagtgatcaacccagagacgggcgagcagattcagagctggtatcggagcggggagacctgggatagcaagttcagcaccatcgcctccagctacgaagagtgccgggctgagagcgtgggtctctacctctgtctccacccgcaagtgctggagatctttggctttgagggggctgatgcggaggacgtgatctacgtgaactggctcaacatggttcgggccgggctgctcgctctggagttctacacacctgaggccttcaactggcgacaggcccatatgcaggcccggtttgtgatcctgagagtcttgctggaggctggcgagggactcgttaccatcactcccaccacaggctccgatgggcgcccagatgcccgggtccgcctcgaccgcagcaagatccggtctgtgggcaagcctgctctagagcgcttcctgcggagacttcaggtgctgaagtccacaggggatgtggccggagggcgggccctgtacgaggggtatgcaacagtcactgatgcgccccccgagtgcttcctcaccctcagggacacggtgctgctgcgtaaggaatctcggaagctcattgttcagcccaacactcgccttgaaggctcagacgtgcagcttctggaatacgaggcgtcagctgctggcctcatccgatccttctctgagcgtttcccagaggatggacccgagttggaggagatcctcacacagctggccacagccgatgcccgattctggaagggccccagtgaggccccatctggccaagcttgaggaagatgtgtggccttgcccccaattccatcagaccaaggctgcaagtggccctccattcgtgtgtgtatttaggggctggggagggggaggggcaggagcttggaccttggtactacctcagctgagggtggtgacacaaccccttccatttgtcagcactttccagcctgccaattgcttcccctctgtgatctcatttcatctgcactgccatacgtggagtgagcaagacagggcttaccatcctgtctaccagatgaggaaatggcagttctgagaagtcactggtctagatcccgcaggtggcacgtgacagctagggttcaaaacgttctcaccaaatccaatgctcctcacatattaattttataaccagacaaataaatattagagacaaccaccatc

SEQ ID NO: 8437 - DNA, 563 bp, Homo sapiens
gagaatgccccgggttggggaatccccgggttccaacggggctgtcagaccttcagtaaattgttgccctttccaagcctcagtttccctatctgtaaaatgggctttcttctggttgtgaacttctgtggcttccctggtggagcacagggagcgagcaggagaatggagggccaaggaaaaggcatttagagggatgagaatgggacagtttcaagcaaaatcatttattgctgtggatactttccgtccagggcgacttcatctgattagcgcacccacctgcagggcccatggcggacacccagtacatcctgcccaatgacatcggcgtgtctagcctggactgccgtgaggccttccgcctgctgtcacccacagagcgcctctatgcctaccacctgtcccgtgccgcctggtacggaggcctggctgtgctgcttcagacctcccctgaggccccctacatctatgctctgctcagccgcctcttccgcgcccaggaccccgaccagctgcgccaacatgccctggctgaaggccttaccgaggaggagtatcag

SEQ ID NO: 8438 - DNA, 733 bp, Homo sapiens
tacaatagtattcccttccacatgggcttttgggaggattaaatgagatcataagagttcagagccaggtatgcaattggtatggggtaaacaacagctgtgatgacagtgatggttctcagcagggcccatggcggacacccagtacatcctgcccaatgacatcggcgtgtctagcctggactgccgtgaggccttccgcctgctgtcacccacagagcgcctctatgcctaccacctgtcccgtgccgcctggtacggaggcctggctgtgctgcttcagacctcccctgaggccccctacatctatgctctgctcagccgcctcttccgcgcccaggaccccgaccagctgcgccaacatgccctggctgaaggccttaccgaggaggagtatcaggcgttcctggtctatgccgcgggtgtttactccaacatgggcaactacaagtcctttggtgacaccaagtttgttcccaacttgcccaaggaaaagctggaacgggtgatcctagggagtgaggctgctcagcagcacccagaagaagtcaggggcctctggcagacctgcggggagcttatgttctctctggagccaaggcttcgacacctcggactggggaaggagggaatcaccacctatttctctgggaattgtaccatggaagatgccaaattggcccaggactttctggactcacagaacctcagtgcctacaacacccggctcttc

SEQ ID NO: 8439 - DNA, 2974 bp, Homo sapiens
attactcctattgtgtaggttcccacctgcaagagtgctgtcgggtcctctgaggtgaaaccccaaaggaaagcgggatcgggactgggggagggggattcccaagtccctgacacccgcgccgtctcggcctgggcttggtgacctcgtcagtcccgtctgccgggactaggccgcggccaggccgggcacagcggtacccggtccggcgcgtgtgcggcctgctgacaaaaggccgagcccgcagggccaatccgcgcgccaccccgtagcgcctgggggcgggagcgggcgagccgagaagctcgtcttggcgcgtctattggctggtactgacgcccatccggaccccgaggccaggcagttggccaaggggggcggggttcgcagagccccaatgaatgggggagccggaagcaggaagtgagtttgcgaacggagcagctgctgcagcagggcccatggcggacacccagtacatcctgcccaatgacatcggcgtgtctagcctggactgccgtgaggccttccgcctgctgtcacccacagagcgcctctatgcctaccacctgtcccgtgccgcctggtacggaggcctggctgtgctgcttcagacctcccctgaggccccctacatctatgctctgctcagccgcctcttccgcgcccaggaccccgaccagctgcgccaacatgccctggctgaaggccttaccgaggaggagtatcaggcgttcctggtctatgccgcgggtgtttactccaacatgggcaactacaagtcctttggtgacaccaagtttgttcccaacttgcccaaggaaaagctggaacgggtgatcctagggagtgaggctgctcagcagcacccagaagaagtcaggggcctctggcagacctgcggggagcttatgttctctctggagccaaggcttcgacacctcggactggggaaggagggaatcaccacctatttctctgggaattgtaccatggaagatgccaaattggcccaggactttctggactcacagaacctcagtgcctacaacacccggctcttcaaagaggtcgatggagaagggaagccctactacgaggtgcggctggcttctgtgcttggctcagagccttccctggactctgaggtgacttccaagctgaagagctatgaattccggggaagccctttccaggtgacccggggggactacgcgcccatcctccagaaggtggtggagcagctggagaaagccaaggcctatgcagccaacagccaccaggggcagatgctggcccagtatatagagagcttcacccagggctccatcgaggcccacaagaggggctcccgcttctggatccaggacaaaggccccatcgtggagagttacatcgggttcatcgagagctaccgcgacccctttggttcccgaggagaatttgaaggtttcgtagctgtggtgaacaaggccatgagtgccaagtttgagcggctggtggcgagcgcagagcagctgctgaaggagctgccctggcccccaacctttgagaaggacaagttcctcacccctgacttcacctccctggatgttctcaccttcgctggctccggcatccctgccggcatcaacatccccaactacgatgatctgaggcagacggaaggctttaagaacgtgtcgctggggaatgtgctggctgtggcctacgccacgcagcgggagaagcttacctttctggaggaggatgacaaggacctgtacatcctctggaaggggccctccttcgatgtgcaggtgggcctgcacgagctgctgggccatggcagtggcaagctcttcgtacaggacgaaaaaggagcattcaactttgaccaggaaacagtgatcaacccagagacgggcgagcagattcagagctggtatcggagcggggagacctgggatagcaagttcagcaccatcgcctccagctacgaagagtgccgggctgagagcgtgggtctctacctctgtctccacccgcaagtgctggagatctttggctttgagggggctgatgcggaggacgtgatctacgtgaactggctcaacatggttcgggccgggctgctcgctctggagttctacacacctgaggccttcaactggcgacaggcccatatgcaggcccggtttgtgatcctgagagtcttgctggaggctggcgagggactcgttaccatcactcccaccacaggctccgatgggcgcccagatgcccgggtccgcctcgaccgcagcaagatccggtctgtgggcaagcctgctctagagcgcttcctgcggagacttcaggtgctgaagtccacaggggatgtggccggagggcgggccctgtacgaggggtatgcaacagtcactgatgcgccccccgagtgcttcctcaccctcagggacacggtgctgctgcgtaaggaatctcggaagctcattgttcagcccaacactcgccttgaaggctcagacgtgcagcttctggaatacgaggcgtcagctgctggcctcatccgatccttctctgagcgtttcccagaggatggacccgagttggaggagatcctcacacagctggccacagccgatgcccgattctggaagggccccagtgaggccccatctggccaagcttgaggaagatgtgtggccttgcccccaattccatcagaccaaggctgcaagtggccctccattcgtgtgtgtatttaggggctggggagggggaggggcaggagcttggaccttggtactacctcagctgagggtggtgacacaaccccttccatttgtcagcactttccagcctgccaattgcttcccctctgtgatctcatttcatctgcactgccatacgtggagtgagcaagacagggcttaccatcctgtctaccagatgaggaaatggcagttctgagaagtcactggtctagatc

SEQ ID NO: 8440 - DNA, 3078 bp, Homo sapiens
attactcctattgtgtaggttcccacctgcaagagtgctgtcgggtcctctgaggtgaaaccccaaaggaaagcgggatcgggactgggggagggggattcccaagtccctgacacccgcgccgtctcggcctgggcttggtgacctcgtcagtcccgtctgccgggactaggccgcggccaggccgggcacagcggtacccggtccggcgcgtgtgcggcctgctgacaaaaggccgagcccgcagggccaatccgcgcgccaccccgtagcgcctgggggcgggagcgggcgagccgagaagctcgtcttggcgcgtctattggctggtactgacgcccatccggaccccgaggccaggcagttggccaaggggggcggggttcgcagagccccaatgaatgggggagccggaagcaggaagtgagtttgcgaacggagcagctgctgcagggcccatggcggacacccagtacatcctgcccaatgacatcggcgtgtctagcctggactgccgtgaggccttccgcctgctgtcacccacagagcgcctctatgcctaccacctgtcccgtgccgcctggtacggaggcctggctgtgctgcttcagacctcccctgaggccccctacatctatgctctgctcagccgcctcttccgcgcccaggaccccgaccagctgcgccaacatgccctggctgaaggccttaccgaggaggagtatcaggcgttcctggtctatgccgcgggtgtttactccaacatgggcaactacaagtcctttggtgacaccaagtttgttcccaacttgcccaaggaaaagctggaacgggtgatcctagggagtgaggctgctcagcagcacccagaagaagtcaggggcctctggcagacctgcggggagcttatgttctctctggagccaaggcttcgacacctcggactggggaaggagggaatcaccacctatttctctgggaattgtaccatggaagatgccaaattggcccaggactttctggactcacagaacctcagtgcctacaacacccggctcttcaaagaggtcgatggagaagggaagccctactacgaggtgcggctggcttctgtgcttggctcagagccttccctggactctgaggtgacttccaagctgaagagctatgaattccggggaagccctttccaggtgacccggggggactacgcgcccatcctccagaaggtggtggagcagctggagaaagccaaggcctatgcagccaacagccaccaggggcagatgctggcccagtatatagagagcttcacccagggctccatcgaggcccacaagaggggctcccgcttctggatccaggacaaaggccccatcgtggagagttacatcgggttcatcgagagctaccgcgacccctttggttcccgaggagaatttgaaggtttcgtagctgtggtgaacaaggccatgagtgccaagtttgagcggctggtggcgagcgcagagcagctgctgaaggagctgccctggcccccaacctttgagaaggacaagttcctcacccctgacttcacctccctggatgttctcaccttcgctggctccggcatccctgccggcatcaacatccccaactacgatgatctgaggcagacggaaggctttaagaacgtgtcgctggggaatgtgctggctgtggcctacgccacgcagcgggagaagcttacctttctggaggaggatgacaaggacctgtacatcctctggaaggggccctccttcgatgtgcaggtgggcctgcacgagctgctgggccatggcagtggcaagctcttcgtacaggacgaaaaaggagcattcaactttgaccaggaaacagtgatcaacccagagacgggcgagcagattcagagctggtatcggagcggggagacctgggatagcaagttcagcaccatcgcctccagctacgaagagtgccgggctgagagcgtgggtctctacctctgtctccacccgcaagtgctggagatctttggctttgagggggctgatgcggaggacgtgatctacgtgaactggctcaacatggttcgggccgggctgctcgctctggagttctacacacctgaggccttcaactggcgacaggcccatatgcaggcccggtttgtgatcctgagagtcttgctggaggctggcgagggactcgttaccatcactcccaccacaggctccgatgggcgcccagatgcccgggtccgcctcgaccgcagcaagatccggtctgtgggcaagcctgctctagagcgcttcctgcggagacttcaggtgctgaagtccacaggggatgtggccggagggcgggccctgtacgaggggtatgcaacagtcactgatgcgccccccgagtgcttcctcaccctcagggacacggtgctgctgcgtaaggaatctcggaagctcattgttcagcccaacactcgccttgaaggctcagacgtgcagcttctggaatacgaggcgtcagctgctggcctcatccgatccttctctgagcgtttcccagaggatggacccgagttggaggagatcctcacacagctggccacagccgatgcccgattctggaagggccccagtgaggccccatctggccaagcttgaggaagatgtgtggccttgcccccaattccatcagaccaaggctgcaagtggccctccattcgtgtgtgtatttaggggctggggagggggaggggcaggagcttggaccttggtactacctcagctgagggtggtgacacaaccccttccatttgtcagcactttccagcctgccaattgcttcccctctgtgatctcatttcatctgcactgccatacgtggagtgagcaagacagggcttaccatcctgtctaccagatgaggaaatggcagttctgagaagtcactggtctagatcccgcaggtggcacgtgacagctagggttcaaaacgttctcaccaaatccaatgctcctcacatattaattttataaccagacaaataaatattagagacaaccacca

SEQ ID NO: 8441 - DNA, 2676 bp, Homo sapiens
aggaagtgagtttgcgaacggagcagctgctgcagtgatggttctcagcagggcccatggcggacacccagtacatcctgcccaatgacatcggcgtgtctagcctggactgccgtgaggccttccgcctgctgtcacccacagagcgcctctatgcctaccacctgtcccgtgccgcctggtacggaggcctggctgtgctgcttcagacctcccctgaggccccctacatctatgctctgctcagccgcctcttccgcgcccaggaccccgaccagctgcgccaacatgccctggctgaaggccttaccgaggaggagtatcaggcgttcctggtctatgccgcgggtgtttactccaacatgggcaactacaagtcctttggtgacaccaagtttgttcccaacttgcccaaggaaaagctggaacgggtgatcctagggagtgaggctgctcagcagcacccagaagaagtcaggggcctctggcagacctgcggggagcttatgttctctctggagccaaggcttcgacacctcggactggggaaggagggaatcaccacctatttctctgggaattgtaccatggaagatgccaaattggcccaggactttctggactcacagaacctcagtgcctacaacacccggctcttcaaagaggtcgatggagaagggaagccctactacgaggtgcggctggcttctgtgcttggctcagagccttccctggactctgaggtgacttccaagctgaagagctatgaattccggggaagccctttccaggtgacccggggggactacgcgcccatcctccagaaggtggtggagcagctggagaaagccaaggcctatgcagccaacagccaccaggggcagatgctggcccagtatatagagagcttcacccagggctccatcgaggcccacaagaggggctcccgcttctggatccaggacaaaggccccatcgtggagagttacatcgggttcatcgagagctaccgcgacccctttggttcccgaggagaatttgaaggtttcgtagctgtggtgaacaaggccatgagtgccaagtttgagcggctggtggcgagcgcagagcagctgctgaaggagctgccctggcccccaacctttgagaaggacaagttcctcacccctgacttcacctccctggatgttctcaccttcgctggctccggcatccctgccggcatcaacatccccaactacgatgatctgaggcagacggaaggctttaagaacgtgtcgctggggaatgtgctggctgtggcctacgccacgcagcgggagaagcttacctttctggaggaggatgacaaggacctgtacatcctctggaaggggccctccttcgatgtgcaggtgggcctgcacgagctgctgggccatggcagtggcaagctcttcgtacaggacgaaaaaggagcattcaactttgaccaggaaacagtgatcaacccagagacgggcgagcagattcagagctggtatcggagcggggagacctgggatagcaagttcagcaccatcgcctccagctacgaagagtgccgggctgagagcgtgggtctctacctctgtctccacccgcaagtgctggagatctttggctttgagggggctgatgcggaggacgtgatctacgtgaactggctcaacatggttcgggccgggctgctcgctctggagttctacacacctgaggccttcaactggcgacaggcccatatgcaggcccggtttgtgatcctgagagtcttgctggaggctggcgagggactcgttaccatcactcccaccacaggctccgatgggcgcccagatgcccgggtccgcctcgaccgcagcaagatccggtctgtgggcaagcctgctctagagcgcttcctgcggagacttcaggtgctgaagtccacaggggatgtggccggagggcgggccctgtacgaggggtatgcaacagtcactgatgcgccccccgagtgcttcctcaccctcagggacacggtgctgctgcgtaaggaatctcggaagctcattgttcagcccaacactcgccttgaaggctcagacgtgcagcttctggaatacgaggcgtcagctgctggcctcatccgatccttctctgagcgtttcccagaggatggacccgagttggaggagatcctcacacagctggccacagccgatgcccgattctggaagggccccagtgaggccccatctggccaagcttgaggaagatgtgtggccttgcccccaattccatcagaccaaggctgcaagtggccctccattcgtgtgtgtatttaggggctggggagggggaggggcaggagcttggaccttggtactacctcagctgagggtggtgacacaaccccttccatttgtcagcactttccagcctgccaattgcttcccctctgtgatctcatttcatctgcactgccatacgtggagtgagcaagacagggcttaccatcctgtctaccagatgaggaaatggcagttctgagaagtcactggtctagatcccgcaggtggcacgtgacagctagggttcaaaacgttctcaccaaatccaatgctcctcacatattaattttataaccagacaaataaatattagagacaaccacca

SEQ ID NO: 8442 - DNA, 2403 bp, Homo sapiens
agtttgcgaacggagcagctgctgcagggcccatggcggacacccagtacatcctgcccaatgacatcggcgtgtctagcctggactgccgtgaggccttccgcctgctgtcacccacagagcgcctctatgcctaccacctgtcccgtgccgcctcttccgcgcccaggaccccgaccagctgcgccaacatgccctggctgaaggccttaccgaggaggagtatcaggcgttcctggtctatgccgcgggtgtttactccaacatgggcaactacaagtcctttggtgacaccaagtttgttcccaacttgcccaaggaaaagctggaacgggtgatcctagggagtgaggctgctcagcagcacccagaagaagtcaggggcctctggcagacctgcggggagcttatgttctctctggagccaaggcttcgacacctcggactggggaaggagggaatcaccacctatttctctgggaattgtaccatggaagatgccaaattggcccaggactttctggactcacagaacctcagtgcctacaacacccggctcttcaaagaggtcgatggagaagggaagccctactacgaggtgcggctggcttctgtgcttggctcagagccttccctggactctgaggtgacttccaagctgaagagctatgaattccggggaagccctttccaggtgacccggggggactacgcgcccatcctccagaaggtggtggagcagctggagaaagccaaggcctatgcagccaacagccaccaggggcagatgctggcccagtatatagagagcttcacccagggctccatcgaggcccacaagaggggctcccgcttctggatccaggacaaaggccccatcgtggagagttacatcgggttcatcgagagctaccgcgacccctttggttcccgaggagaatttgaaggtttcgtagctgtggtgaacaaggccatgagtgccaagtttgagcggctggtggcgagcgcagagcagctgctgaaggagctgccctggcccccaacctttgagaaggacaagttcctcacccctgacttcacctccctggatgttctcaccttcgctggctccggcatccctgccggcatcaacatccccaactacgatgatctgaggcagacggaaggctttaagaacgtgtcgctggggaatgtgctggctgtggcctacgccacgcagcgggagaagcttacctttctggaggaggatgacaaggacctgtacatcctctggaaggggccctccttcgatgtgcaggtgggcctgcacgagctgctgggccatggcagtggcaagctcttcgtacaggacgaaaaaggagcattcaactttgaccaggaaacagtgatcaacccagagacgggcgagcagattcagagctggtatcggagcggggagacctgggatagcaagttcagcaccatcgcctccagctacgaagagtgccgggctgagagcgtgggtctctacctctgtctccacccgcaagtgctggagatctttggctttgagggggctgatgcggaggacgtgatctacgtgaactggctcaacatggttcgggccgggctgctcgctctggagttctacacacctgaggccttcaactggcgacaggcccatatgcaggcccggtttgtgatcctgagagtcttgctggaggctggcgagggactcgttaccatcactcccaccacaggctccgatgggcgcccagatgcccgggtccgcctcgaccgcagcaagatccggtctgtgggcaagcctgctctagagcgcttcctgcggagacttcaggtgctgaagtccacaggggatgtggccggagggcgggccctgtacgaggggtatgcaacagtcactgatgcgccccccgagtgcttcctcaccctcagggacacggtgctgctgcgtaaggaatctcggaagctcattgttcagcccaacactcgccttgaaggctcagacgtgcagcttctggaatacgaggcgtcagctgctggcctcatccgatccttctctgagcgtttcccagaggatggacccgagttggaggagatcctcacacagctggccacagccgatgcccgattctggaagggccccagtgaggccccatctggccaagcttgaggaagatgtgtggccttgcccccaattccatcagaccaaggctgcaagtggccctccattcgtgtgtgtatttaggggctggggagggggaggggcaggagcttggaccttggtactacctcagctgagggtggtgacacaaccccttccatttgtcagcactttccagcctgccaattgcttcccctctgtgatctcatttcatctgcactgccatacgtggagtgagc

SEQ ID NO: 8443 - DNA, 3768 bp, Homo sapiens
tgcgccgtgggcgccgggccgggaggcgggcgaggaggcagcgcgcatcactcgggtccccttcctgcacccagccgccacttgccggttgctaagcagttatcattgtttctgtggcgattgcagaggctgttgctaattggagaagccccactaagcagcggcagcttcctgcttcggatcctctctctgctgcttgcatttaaagagcaaactcgtcttgtctacccaccctccctcccccatcctccccaaaatagccttgtgatttcggaagtatggactaaaatcacactcctccttaccttaccgcttggactctggtggctcccaactcgccgtcagaccccacctgccccggtggtgggaagcgcctggacagaccatgaccacagccaaggagccaagcgcttcggggaaatccgtgcagcagcaggaacaggagctggtggggagtaaccctccgcagaggaattggaaaggaatagcaattgcactgcttgtcattctggtcatctgctccttgatcgtcacctcggtcatacttctgacaccagcggaagataatagtctgtctcaaaagaagaaggtcactgtagaagatctcttcagtgaagacttcaaaattcatgaccccgaggctaagtggataagtgatacagaattcatctacagagaacagaaaggaacagtgagactgtggaatgttgaaacaaatacttctactgtcttaatagaaggcaaaaaaattgaatcattaagagccatcagatatgaaatatctccagatagagagtatgcacttttttcatacaatgtggaacccatatatcaacactcgtatactggatattacgtcctgagcaaaattcctcatggggatcctcaaagtctggacccaccagaagtcagcaatgcaaaacttcagtatgcaggatggggccctaaaggccaacagctgatatttatttttgaaaacaatatctactactgtgcacatgtcgggaaacaggccatccgtgtggtctccactggcaaggaaggtgtgatttacaatggcctcagtgactggctgtatgaagaggagattttgaagacacacatcgcacactggtggtctccggatggcacgagactcgcctacgccgccatcaatgattcccgtgtccccatcatggagctcccaacttacaccggctccatctaccccaccgtgaagccctaccactatcccaaggctggaagtgagaaccccagcatttccctacacgttattggcttaaatggacccacccatgatctggagatgatgccgcctgatgatccacggatgagggagtactacatcaccatggtgaagtgggccaccagcaccaaggtcgccgtgacctggctgaaccgggcgcagaacgtgtccatcctcaccctctgcgacgccaccacgggggtctgcacgaagaaacacgaggatgaaagtgaggcctggctccacagacagaatgaagaacctgtgttctccaaggatggccgaaagtttttcttcatcagagccatcccccagggaggacgagggaaattctatcacatcacggtgtcctcgtcccagcccaacagcagcaacgacaacatccagtccatcacctccggggactgggacgtgaccaagatcctagcctacgatgagaaggggaataagatctacttcctgagcacggaggacctgcctcggagacgacaactctacagtgccaacacggtgggcaacttcaacaggcagtgcctctcctgtgacctggttgagaactgcacctacttcagcgcttccttcagccatagcatggacttcttcctgctcaagtgcgaaggtcctggtgttcctatggtgacggtgcacaacacaacagataagaaaaaaatgtttgacctagaaacaaatgaacatgtcaagaaggccataaatgaccgacagatgcctaaagtggaatacagggacattgagattgatgattacaacctgcccatgcagatactgaagccagcaaccttcaccgacaccacccactaccctctgctcctggtggtggatggcaccccaggcagccagagtgtggctgagaagttcgaggtgagctgggagacggtgatggtgagcagccacggcgcggtggtggtaaagtgtgacggccgtggcagcggcttccaagggaccaagctcctgcacgaagtgaggcggcggctgggcttgctggaggagaaggaccagatggaggccgtgcggacgatgctgaaggagcagtacattgacaggacgcgcgtggccgtgtttgggaaggattacggtggctacctgagcacctacatcctcccagcaaagggagaaaatcaaggccagacattcacctgcggctctgctctctctccaataacagacttcaaactctatgcctctgcgttttccgagaggtacttgggcctccatggacttgacaacagagcatacgagatgaccaaggtagcccatcgagtctccgcgctggaagaacagcagttcctgatcattcatcccactgccgatgaaaaaattcatttccagcacacagcagaactcattacacaactaattaggggaaaggctaattacagcttacagatttacccggacgaaagccattactttaccagctccagcctcaaacagcatctgtaccggtccatcatcaacttcttcgtggaatgcttcaggatccaggacaaactgctgacagtcacagcgaaagaggacgaggaggaggactaagctcaggtcgctctaagcacaaacgtggctctttctacaaccagatgcaaccgagggatttccctgccctccctcttccctcggaggggcggggcggggcggggccgggtgttccatagcatgtgtgtctcggatgcggaaggcagttttgcttgggaaacaagctccttccccggggtcatcactcacggcctccatggcaccagggacaacgctgtccccgcagcagcgcctcctcccggcgcccgagagaccggcacgccacggcccctcccccaaggaacagagcaaaggatggtggccgcaggccccacgcgagcccacaggacaccggcccctagattccagccaccaagcggaagcatgagacccgcccacactagcctctgtgttcccgttagggacatcacaccctgtctcacgtcgcagtgccatggacgcagcagttacagcaccattgttttagcagtgcgtgttcatatatgggcttgctacttcctgtaatgaggacgttcaacatggtgaggggctacaagaaaacgcttttctgtacagagtcttactgtagctacgctaatggttaacctgatagaattaactcgtatttttctatggttttaacctgatgctccactgtctccgtcatggggttgttttgctgtttggggttgggccttgtttccctttcctttctccagtccacgtgtagactttgcgcttgatgaagaagcagatcggaagtaactgctccctcctcaaggttgtcttcagacgtcttggggacgttcctaaacactgagggggaagacagccaatagcacccattaaaagaaatacctaaataaaacctctctcccactcagctatgctagggcttggctgtaggtgtgcactgtctatttacatccgtccttacaaccatccttgtcctccttggtaccgtatcaagctctttcccatgacatttggtt

SEQ ID NO: 8444 - DNA, 3710 bp, Homo sapiens
gcttgccttgctgctgctgctgctgctgcctccccaccgcctttttttttttttaatctggagcggggtggggagtgggaaccggagagaaagcaaaatattaaaaagccccaaagacagccagcaggagcgcggtgcccgatggcttcgctgtaccagaggttcactggcaagatcaacacctcgaggtccttccccgcgcccccggaggcgagtcacctcctgggcggccaggggcccgaggaggacggcggcgcaggagccaagcccctcggcccgcgggcgcaggcggcggcgccccgggagcgcggcggcggcggcggcggcgcgggtggccggccccggttccagtaccaggcgcggagcgatggtgacgaggaggacgagctggtggggagtaaccctccgcagaggaattggaaaggaatagcaattgcactgcttgtcattctggtcatctgctccttgatcgtcacctcggtcatacttctgacaccagcggaagataatagtctgtctcaaaagaagaaggtcactgtagaagatctcttcagtgaagacttcaaaattcatgaccccgaggctaagtggataagtgatacagaattcatctacagagaacagaaaggaacagtgagactgtggaatgttgaaacaaatacttctactgtcttaatagaaggcaaaaaaattgaatcattaagagccatcagatatgaaatatctccagatagagagtatgcacttttttcatacaatgtggaacccatatatcaacactcgtatactggatattacgtcctgagcaaaattcctcatggggatcctcaaagtctggacccaccagaagtcagcaatgcaaaacttcagtatgcaggatggggccctaaaggccaacagctgatatttatttttgaaaacaatatctactactgtgcacatgtcgggaaacaggccatccgtgtggtctccactggcaaggaaggtgtgatttacaatggcctcagtgactggctgtatgaagaggagattttgaagacacacatcgcacactggtggtctccggatggcacgagactcgcctacgccgccatcaatgattcccgtgtccccatcatggagctcccaacttacaccggctccatctaccccaccgtgaagccctaccactatcccaaggctggaagtgagaaccccagcatttccctacacgttattggcttaaatggacccacccatgatctggagatgatgccgcctgatgatccacggatgagggagtactacatcaccatggtgaagtgggccaccagcaccaaggtcgccgtgacctggctgaaccgggcgcagaacgtgtccatcctcaccctctgcgacgccaccacgggggtctgcacgaagaaacacgaggatgaaagtgaggcctggctccacagacagaatgaagaacctgtgttctccaaggatggccgaaagtttttcttcatcagagccatcccccagggaggacgagggaaattctatcacatcacggtgtcctcgtcccagcccaacagcagcaacgacaacatccagtccatcacctccggggactgggacgtgaccaagatcctagcctacgatgagaaggggaataagatctacttcctgagcacggaggacctgcctcggagacgacaactctacagtgccaacacggtgggcaacttcaacaggcagtgcctctcctgtgacctggttgagaactgcacctacttcagcgcttccttcagccatagcatggacttcttcctgctcaagtgcgaaggtcctggtgttcctatggtgacggtgcacaacacaacagataagaaaaaaatgtttgacctagaaacaaatgaacatgtcaagaaggccataaatgaccgacagatgcctaaagtggaatacagggacattgagattgatgattacaacctgcccatgcagatactgaagccagcaaccttcaccgacaccacccactaccctctgctcctggtggtggatggcaccccaggcagccagagtgtggctgagaagttcgaggtgagctgggagacggtgatggtgagcagccacggcgcggtggtggtaaagtgtgacggccgtggcagcggcttccaagggaccaagctcctgcacgaagtgaggcggcggctgggcttgctggaggagaaggaccagatggaggccgtgcggacgatgctgaaggagcagtacattgacaggacgcgcgtggccgtgtttgggaaggattacggtggctacctgagcacctacatcctcccagcaaagggagaaaatcaaggccagacattcacctgcggctctgctctctctccaataacagacttcaaactctatgcctctgcgttttccgagaggtacttgggcctccatggacttgacaacagagcatacgagatgaccaaggtagcccatcgagtctccgcgctggaagaacagcagttcctgatcattcatcccactgccgatgaaaaaattcatttccagcacacagcagaactcattacacaactaattaggggaaaggctaattacagcttacagatttacccggacgaaagccattactttaccagctccagcctcaaacagcatctgtaccggtccatcatcaacttcttcgtggaatgcttcaggatccaggacaaactgctgacagtcacagcgaaagaggacgaggaggaggactaagctcaggtcgctctaagcacaaacgtggctctttctacaaccagatgcaaccgagggatttccctgccctccctcttccctcggaggggcggggcggggcggggccgggtgttccatagcatgtgtgtctcggatgcggaaggcagttttgcttgggaaacaagctccttccccggggtcatcactcacggcctccatggcaccagggacaacgctgtccccgcagcagcgcctcctcccggcgcccgagagaccggcacgccacggcccctcccccaaggaacagagcaaaggatggtggccgcaggccccacgcgagcccacaggacaccggcccctagattccagccaccaagcggaagcatgagacccgcccacactagcctctgtgttcccgttagggacatcacaccctgtctcacgtcgcagtgccatggacgcagcagttacagcaccattgttttagcagtgcgtgttcatatatgggcttgctacttcctgtaatgaggacgttcaacatggtgaggggctacaagaaaacgcttttctgtacagagtcttactgtagctacgctaatggttaacctgatagaattaactcgtatttttctatggttttaacctgatgctccactgtctccgtcatggggttgttttgctgtttggggttgggccttgtttccctttcctttctccagtccacgtgtagactttgcgcttgatgaagaagcagatcggaagtaactgctccctcctcaaggttgtcttcagacgtcttggggacgttcctaaacactgagggggaagacagccaatagcacccattaaaagaaatacctaaataaaacctctctcccactcagctatgctagggcttggctgtaggtgtgcactgtctatttacatccgtccttacaaccatccttgtcctccttggtaccgtatcaagctctttcccatgacatttggtt

SEQ ID NO: 8445 - DNA, 4798 bp, Homo sapiens
agttcagacagaaaacctggcgcgcgcgcgcgcacacacacacgcctcccctggcgtcgccgcccggccgggtccctgcccttagggaccagagcggcgaccgctgcaccccgcaccgcctgctggaggagcccccggagccggggccgagccgccggcgtccccgagtgcgccccctgtgcgtgccgccgcgctgttgctcgcagtgtgctggcgccgagctcggtggacacgcgcgcagtcagagctgcctctcgccctcgctagctgggctcgcagcctcttcctccctccctggctcctggctttttgtttaaagcaacacccaccctccatccaggctttttttctttctttctttattggtagcggccaaaaagagttgattgctattgggatccgctgagtaaagacacgggcaggggtgcgcggaggtgagaaaactgaagacctggaagatttttttttccttcaaaaacccgtttccatccagtcttcagccagtccagtctactttaatcctcaccaggacaatggattaagtttctcttccctggaccagaagtcgggttcggacttggggcaaaatgaaggaaaaggccatgatcaagaccgctaagatgcaggggaacgtgatggagctggtggggagtaaccctccgcagaggaattggaaaggaatagcaattgcactgcttgtcattctggtcatctgctccttgatcgtcacctcggtcatacttctgacaccagcggaagataatagtctgtctcaaaagaagaaggtcactgtagaagatctcttcagtgaagacttcaaaattcatgaccccgaggctaagtggataagtgatacagaattcatctacagagaacagaaaggaacagtgagactgtggaatgttgaaacaaatacttctactgtcttaatagaaggcaaaaaaattgaatcattaagagccatcagatatgaaatatctccagatagagagtatgcacttttttcatacaatgtggaacccatatatcaacactcgtatactggatattacgtcctgagcaaaattcctcatggggatcctcaaagtctggacccaccagaagtcagcaatgcaaaacttcagtatgcaggatggggccctaaaggccaacagctgatatttatttttgaaaacaatatctactactgtgcacatgtcgggaaacaggccatccgtgtggtctccactggcaaggaaggtgtgatttacaatggcctcagtgactggctgtatgaagaggagattttgaagacacacatcgcacactggtggtctccggatggcacgagactcgcctacgccgccatcaatgattcccgtgtccccatcatggagctcccaacttacaccggctccatctaccccaccgtgaagccctaccactatcccaaggctggaagtgagaaccccagcatttccctacacgttattggcttaaatggacccacccatgatctggagatgatgccgcctgatgatccacggatgagggagtactacatcaccatggtgaagtgggccaccagcaccaaggtcgccgtgacctggctgaaccgggcgcagaacgtgtccatcctcaccctctgcgacgccaccacgggggtctgcacgaagaaacacgaggatgaaagtgaggcctggctccacagacagaatgaagaacctgtgttctccaaggatggccgaaagtttttcttcatcagagccatcccccagggaggacgagggaaattctatcacatcacggtgtcctcgtcccagcccaacagcagcaacgacaacatccagtccatcacctccggggactgggacgtgaccaagatcctagcctacgatgagaaggggaataagatctacttcctgagcacggaggacctgcctcggagacgacaactctacagtgccaacacggtgggcaacttcaacaggcagtgcctctcctgtgacctggttgagaactgcacctacttcagcgcttccttcagccatagcatggacttcttcctgctcaagtgcgaaggtcctggtgttcctatggtgacggtgcacaacacaacagataagaaaaaaatgtttgacctagaaacaaatgaacatgtcaagaaggccataaatgaccgacagatgcctaaagtggaatacagggacattgagattgatgattacaacctgcccatgcagatactgaagccagcaaccttcaccgacaccacccactaccctctgctcctggtggtggatggcaccccaggcagccagagtgtggctgagaagttcgaggtgagctgggagacggtgatggtgagcagccacggcgcggtggtggtaaagtgtgacggccgtggcagcggcttccaagggaccaagctcctgcacgaagtgaggcggcggctgggcttgctggaggagaaggaccagatggaggccgtgcggacgatgctgaaggagcagtacattgacaggacgcgcgtggccgtgtttgggaaggattacggtggctacctgagcacctacatcctcccagcaaagggagaaaatcaaggccagacattcacctgcggctctgctctctctccaataacagacttcaaactctatgcctctgcgttttccgagaggtacttgggcctccatggacttgacaacagagcatacgagatgaccaaggtagcccatcgagtctccgcgctggaagaacagcagttcctgatcattcatcccactgccgatgaaaaaattcatttccagcacacagcagaactcattacacaactaattaggggaaaggctaattacagcttacagatttacccggacgaaagccattactttaccagctccagcctcaaacagcatctgtaccggtccatcatcaacttcttcgtggaatgcttcaggatccaggacaaactgctgacagtcacagcgaaagaggacgaggaggaggactaagctcaggtcgctctaagcacaaacgtggctctttctacaaccagatgcaaccgagggatttccctgccctccctcttccctcggaggggcggggcggggcggggccgggtgttccatagcatgtgtgtctcggatgcggaaggcagttttgcttgggaaacaagctccttccccggggtcatcactcacggcctccatggcaccagggacaacgctgtccccgcagcagcgcctcctcccggcgcccgagagaccggcacgccacggcccctcccccaaggaacagagcaaaggatggtggccgcaggccccacgcgagcccacaggacaccggcccctagattccagccaccaagcggaagcatgagacccgcccacactagcctctgtgttcccgttagggacatcacaccctgtctcacgtcgcagtgccatggacgcagcagttacagcaccattgttttagcagtgcgtgttcatatatgggcttgctacttcctgtaatgaggacgttcaacatggtgaggggctacaagaaaacgcttttctgtacagagtcttactgtagctacgctaatggttaacctgatagaattaactcgtatttttctatggttttaacctgatgctccactgtctccgtcatggggttgttttgctgtttggggttgggccttgtttccctttcctttctccagtccacgtgtagactttgcgcttgatgaagaagcagatcggaagtaactgctccctcctcaaggttgtcttcagacgtcttggggacgttcctaaacactgagggggaagacagccaatagcacccattaaaagaaatacctaaataaaacctctctcccactcagctatgctagggcttggctgtaggtgtgcactgtctatttacatccgtccttacaaccatccttgtcctccttggtaccgtatcaagctctttcccatgacatttggtttaaaaaaaaaaaaaaaaaaaaaaaaaaaacagaaaaaagacaaagcgtcaactccacccacaggcccgctgtgtgtgctcgggccacgggagtcctgagggttctgtgggcctgcgcgcatccctctcccatcgtgggggtggctccgtgaccttcctgccacgagcaggaggttgatgatgtgctacgttagccttgtaagatacacccccaccaaatgtgcagccggtgttcccagtgtatatttcattctcttgtatataaaggaagcaatgtgtgtcaggcctctgtgcagtcaacccagcctcctcccgccagtgctaaccccgtgttgagcctgcatgctgacactgtggccgatctggactctagaagtgctagtttgaaatatatccattactgtcatttccttttgagcttgtggacaagctgaatgtcaggactgacttcgccagctcccagccctgcgggggtgtccttggcatcccatcagcagaggagatgcgtccctgttgcattttggcgtttggggctttgggtttatccacatgagctctgaacgtccgttatagttagggtgattggaaggtctccatcactgggtgttttaaaggtgattcaccaccatttgtgaaaggaccaacgtgctgataaacaggaccgatccgagtgctacatgactgtgcgtttgctatttcaatgggcctgaacgactacaaagccagctaggtctggaaggggaagccagctctggccacgacatctggtcggagggaagtggggatgtggcatggtagcgtctgttcatccatggaataaaacattattttacca

SEQ ID NO: 8446 - DNA, 2388 bp, Homo sapiens
aactcgccgtcagaccccacctgccccggtggtgggaagcgcctggacagaccatgaccacagccaaggagccaagcgcttcggggaaatccgtgcagcagcaggaacaggagctggtggggagtaaccctccgcagaggaattggaaaggaatagcaattgcactgcttgtcattctggtcatctgctccttgatcgtcacctcggtcatacttctgacaccagcggaagataatagtctgtctcaaaagaagaaggtcactgtagaagatctcttcagtgaagacttcaaaattcatgaccccgaggctaagtggataagtgatacagaattcatctacagagaacagaaaggaacagtgagactgtggaatgttgaaacaaatacttctactgtcttaatagaaggcaaaaaaattgaatcattaagagccatcagatatgaaatatctccagatagagagtatgcacttttttcatacaatgtggaacccatatttatttttgaaaacaatatctactactgtgcacatgtcgggaaacaggccatccgtgtggtctccactggcaaggaaggtgtgatttacaatggcctcagtgactggctgtatgaagaggagattttgaagacacacatcgcacactggtggtctccggatggcacgagactcgcctacgccgccatcaatgattcccgtgtccccatcatggagctcccaacttacaccggctccatctaccccaccgtgaagccctaccactatcccaaggctggaagtgagaaccccagcatttccctacacgttattggcttaaatggacccacccatgatctggagatgatgccgcctgatgatccacggatgagggagtactacatcaccatggtgaagtgggccaccagcaccaaggtcgccgtgacctggctgaaccgggcgcagaacgtgtccatcctcaccctctgcgacgccaccacgggggtctgcacgaagaaacacgaggatgaaagtgaggcctggctccacagacagaatgaagaacctgtgttctccaaggatggccgaaagtttttcttcatcagagccatcccccagggaggacgagggaaattctatcacatcacggtgtcctcgtcccagcccaacagcagcaacgacaacatccagtccatcacctccggggactgggacgtgaccaagatcctagcctacgatgagaaggggaataagatctacttcctgagcacggaggacctgcctcggagacgacaactctacagtgccaacacggtgggcaacttcaacaggcagtgcctctcctgtgacctggttgagaactgcacctacttcagcgcttccttcagccatagcatggacttcttcctgctcaagtgcgaaggtcctggtgttcctatggtgacggtgcacaacacaacagataagaaaaaaatgtttgacctagaaacaaatgaacatgtcaagaaggccataaatgaccgacagatgcctaaagtggaatacagggacattgagattgatgattacaacctgcccatgcagatactgaagccagcaaccttcaccgacaccacccactaccctctgctcctggtggtggatggcaccccaggcagccagagtgtggctgagaagttcgaggtgagctgggagacggtgatggtgagcagccacggcgcggtggtggtaaagtgtgacggccgtggcagcggcttccaagggaccaagctcctgcacgaagtgaggcggcggctgggcttgctggaggagaaggaccagatggaggccgtgcggacgatgctgaaggagcagtacattgacaggacgcgcgtggccgtgtttgggaaggattacggtggctacctgagcacctacatcctcccagcaaagggagaaaatcaaggccagacattcacctgcggctctgctctctctccaataacagacttcaaactctatgcctctgcgttttccgagaggtacttgggcctccatggacttgacaacagagcatacgagatgaccaaggtagcccatcgagtctccgcgctggaagaacagcagttcctgatcattcatcccactgccgatgaaaaaattcatttccagcacacagcagaactcattacacaactaattaggggaaaggctaattacagcttacagatttacccggacgaaagccattactttaccagctccagcctcaaacagcatctgtaccggtccatcatcaacttcttcgtggaatgcttcaggatccaggacaaactgctgacagtcacagcgaaagaggacgaggaggaggactaagctcaggtcgctctaagcacaaacgtggctctttctacaaccagatgcaaccgaggga

SEQ ID NO: 8447 - DNA, 3139 bp, Homo sapiens
gcaacgaaccggaagtgctaaagcctccgaggccaaggccgctgctactgccgccgctgcttcttagtgccgcgttcgccgcctgggttgtcaccggcgccgccgccgaggaagccactgcaaccaggaccggagtggaggcggcgcagcatgaagcggcgcaggcccgctccatagcgcacgtcgggacggtccgggcggggccggggggaaggaaaatgcaacatggcagcagcaatggaaacagaacagctgggtgttgagatatttgaaactgcggactgtgaggagaatattgaatcacaggatcggcctaaattggagcctttttatgttgagcggtattcctggagtcagcttaaaaagctgcttgccgataccagaaaatatcatggctacatgatggctaaggcaccacatgatttcatgtttgtgaagaggaatgatccagatggacctcattcagacagaatctattaccttgccatgtctggtgagaacagagaaaatacactgttttattctgaaattcccaaaactatcaatagagcagcagtcttaatgctctcttggaagcctcttttggatctttttcaggcaacactggactatggaatgtattctcgagaagaagaactattaagagaaagaaaacgcattggaacagtcggaattgcttcttacgattatcaccaaggaagtggaacatttctgtttcaagccggtagtggaatttatcacgtaaaagatggagggccacaaggatttacgcaacaacctttaaggcccaatctagtggaaactagttgtcccaacatacggatggatccaaaattatgccctgctgatccagactggattgcttttatacatagcaacgatatttggatatctaacatcgtaaccagagaagaaaggagactcacttatgtgcacaatgagctagccaacatggaagaagatgccagatcagctggagtcgctacctttgttctccaagaagaatttgatagatattctggctattggtggtgtccaaaagctgaaacaactcccagtggtggtaaaattcttagaattctatatgaagaaaatgatgaatctgaggtggaaattattcatgttacatcccctatgttggaaacaaggagggcagattcattccgttatcctaaaacaggtacagcaaatcctaaagtcacttttaagatgtcagaaataatgattgatgctgaaggaaggatcatagatgtcatagataaggaactaattcaaccttttgagattctatttgaaggagttgaatatattgccagagctggatggactcctgagggaaaatatgcttggtccatcctactagatcgctcccagactcgcctacagatagtgttgatctcacctgaattatttatcccagtagaagatgatgttatggaaaggcagagactcattgagtcagtgcctgattctgtgacgccactaattatctatgaagaaacaacagacatctggataaatatccatgacatctttcatgtttttccccaaagtcacgaagaggaaattgagtttatttttgcctctgaatgcaaaacaggtttccgtcatttatacaaaattacatctattttaaaggaaagcaaatataaacgatccagtggtgggctgcctgctccaagtgatttcaagtgtcctatcaaagaggagatagcaattaccagtggtgaatgggaagttcttggccggcatggatctaatatccaagttgatgaagtcagaaggctggtatattttgaaggcaccaaagactcccctttagagcatcacctgtacgtagtcagttacgtaaatcctggagaggtgacaaggctgactgaccgtggctactcacattcttgctgcatcagtcagcactgtgacttctttataagtaagtatagtaaccagaagaatccacactgtgtgtccctttacaagctatcaagtcctgaagatgacccaacttgcaaaacaaaggaattttgggccaccattttggattcagcaggtcctcttcctgactatactcctccagaaattttctcttttgaaagtactactggatttacattgtatgggatgctctacaagcctcatgatctacagcctggaaagaaatatcctactgtgctgttcatatatggtggtcctcaggtgcagttggtgaataatcggtttaaaggagtcaagtatttccgcttgaataccctagcctctctaggttatgtggttgtagtgatagacaacaggggatcctgtcaccgagggcttaaatttgaaggcgcctttaaatataaaatgggtcaaatagaaattgacgatcaggtggaaggactccaatatctagcttctcgatatgatttcattgacttagatcgtgtgggcatccacggctggtcctatggaggatacctctccctgatggcattaatgcagaggtcagatatcttcagggttgctattgctggggccccagtcactctgtggatcttctatgatacaggatacacggaacgttatatgggtcaccctgaccagaatgaacagggctattacttaggatctgtggccatgcaagcagaaaagttcccctctgaaccaaatcgtttactgctcttacatggtttcctggatgagaatgtccattttgcacataccagtatattactgagttttttagtgagggctggaaagccatatgatttacagatctatcctcaggagagacacagcataagagttcctgaatcgggagaacattatgaactgcatcttttgcactaccttcaagaaaaccttggatcacgtattgctgctctaaaagtgatataattttgacctgtgtagaactctctggtatacactggctatttaaccaaatgaggaggtttaatcaacagaaaacacagaattgatcatcacattttgatacctgccatgtaacatctactcctgaaaataaatgtggtgccatgcaggggtctacggtttgtggtagtaatctaataccttaaccccacatgctcaaaatcaaatgatacatattcctgagagacccagcaataccataagaattactaaaaaaaaaaaaaaaaaa

SEQ ID NO: 8448 - DNA, 3099 bp, Homo sapiens
gaagtgctaaagcctccgaggccaaggccgctgctactgccgccgctgcttcttagtgccgcgttcgccgcctgggttgtcaccggcgccgccgccgaggaagccactgcaaccaggaccggagtggaggcggcgcagcatgaagcggcgcaggcccgctccatagcgcacgtcgggacggtccgggcggggccggggggaaggctttgatggtgaggaaaggaaagattcctgtgagaagagcaggatgagcagagggattctatgcttgaagtcgagtcacttgaaaaagatctctttgaatgtggaagagatctgagcagatgaaaataaaatcaggaaaatgcaacatggcagcagcaatggaaacagaacagctgggtgttgagatatttgaaactgcggactgtgaggagaatattgaatcacaggatcggcctaaattggagcctttttatgttgagcggtattcctggagtcagcttaaaaagctgcttgccgataccagaaaatatcatggctacatgatggctaaggcaccacatgatttcatgtttgtgaagaggaatgatccagatggacctcattcagacagaatctattaccttgccatgtctggtgagaacagagaaaatacactgttttattctgaaattcccaaaactatcaatagagcagcagtcttaatgctctcttggaagcctcttttggatctttttcaggcaacactggactatggaatgtattctcgagaagaagaactattaagagaaagaaaacgcattggaacagtcggaattgcttcttacgattatcaccaaggaagtggaacatttctgtttcaagccggtagtggaatttatcacgtaaaagatggagggccacaaggatttacgcaacaacctttaaggcccaatctagtggaaactagttgtcccaacatacggatggatccaaaattatgccctgctgatccagactggattgcttttatacatagcaacgatatttggatatctaacatcgtaaccagagaagaaaggagactcacttatgtgcacaatgagctagccaacatggaagaagatgccagatcagctggagtcgctacctttgttctccaagaagaatttgatagatattctggctattggtggtgtccaaaagctgaaacaactcccagtggtggtaaaattcttagaattctatatgaagaaaatgatgaatctgaggtggaaattattcatgttacatcccctatgttggaaacaaggagggcagattcattccgttatcctaaaacaggtacagcaaatcctaaagtcacttttaagatgtcagaaataatgattgatgctgaaggaaggatcatagatgtcatagataaggaactaattcaaccttttgagattctatttgaaggagttgaatatattgccagagctggatggactcctgagggaaaatatgcttggtccatcctactagatcgctcccagactcgcctacagatagtgttgatctcacctgaattatttatcccagtagaagatgatgttatggaaaggcagagactcattgagtcagtgcctgattctgtgacgccactaattatctatgaagaaacaacagacatctggataaatatccatgacatctttcatgtttttccccaaagtcacgaagaggaaattgagtttatttttgcctctgaatgcaaaacaggtttccgtcatttatacaaaattacatctattttaaaggaaagcaaatataaacgatccagtggtgggctgcctgctccaagtgatttcaagtgtcctatcaaagaggagatagcaattaccagtggtgaatgggaagttcttggccggcatggatctaatatccaagttgatgaagtcagaaggctggtatattttgaaggcaccaaagactcccctttagagcatcacctgtacgtagtcagttacgtaaatcctggagaggtgacaaggctgactgaccgtggctactcacattcttgctgcatcagtcagcactgtgacttctttataagtaagtatagtaaccagaagaatccacactgtgtgtccctttacaagctatcaagtcctgaagatgacccaacttgcaaaacaaaggaattttgggccaccattttggattcagcaggtcctcttcctgactatactcctccagaaattttctcttttgaaagtactactggatttacattgtatgggatgctctacaagcctcatgatctacagcctggaaagaaatatcctactgtgctgttcatatatggtggtcctcagggtcaaatagaaattgacgatcaggtggaaggactccaatatctagcttctcgatatgatttcattgacttagatcgtgtgggcatccacggctggtcctatggaggatacctctccctgatggcattaatgcagaggtcagatatcttcagggttgctattgctggggccccagtcactctgtggatcttctatgatacaggatacacggaacgttatatgggtcaccctgaccagaatgaacagggctattacttaggatctgtggccatgcaagcagaaaagttcccctctgaaccaaatcgtttactgctcttacatggtttcctggatgagaatgtccattttgcacataccagtatattactgagttttttagtgagggctggaaagccatatgatttacagatctatcctcaggagagacacagcataagagttcctgaatcgggagaacattatgaactgcatcttttgcactaccttcaagaaaaccttggatcacgtattgctgctctaaaagtgatataattttgacctgtgtagaactctctggtatacactggctatttaaccaaatgaggaggtttaatcaacagaaaacacagaattgatcatcacattttgatacctgccatgtaacatctactcctgaaaataaatgtggtgccatgcaggggtctacggtttgtggtagtaatctaataccttaaccccacatgctcaaaatcaaatgatacatattcctgagagacccagcaataccataagaattact

SEQ ID NO: 8449 - DNA, 3125 bp, Homo sapiens
ggatcgcaacgaaccggaagtgctaaagcctccgaggccaaggccgctgctactgccgccgctgcttcttagtgccgcgttcgccgcctgggttgtcaccggcgccgccgccgaggaagccactgcaaccaggaccggagtggaggcggcgcagcatgaagcggcgcaggcccgctccatagcgcacgtcgggacggtccgggcggggccggggggaaggctttgatggtgaggaaaggaaagattcctgtgagaagagcaggatgagcagagggattctatgcttgaagtcgagtcacttgaaaaagatctctttgaatgtggaagagatctgagcagatgaaaataaaatcaggaaaatgcaacatggcagcagcaatggaaacagaacagctgggtgttgagatatttgaaactgcggactgtgaggagaatattgaatcacaggatcggcctaaattggagcctttttatgttgagcggtattcctggagtcagcttaaaaagctgcttgccgataccagaaaatatcatggctacatgatggctaaggcaccacatgatttcatgtttgtgaagaggaatgatccagatggacctcattcagacagaatctattaccttgccatgtctggtgagaacagagaaaatacactgttttattctgaaattcccaaaactatcaatagagcagcagtcttaatgctctcttggaagcctcttttggatctttttcaggcaacactggactatggaatgtattctcgagaagaagaactattaagagaaagaaaacgcattggaacagtcggaattgcttcttacgattatcaccaaggaagtggaacatttctgtttcaagccggtagtggaatttatcacgtaaaagatggagggccacaaggatttacgcaacaacctttaaggcccaatctagtggaaactagttgtcccaacatacggatggatccaaaattatgccctgctgatccagactggattgcttttatacatagcaacgatatttggatatctaacatcgtaaccagagaagaaaggagactcacttatgtgcacaatgagctagccaacatggaagaagatgccagatcagctggagtcgctacctttgttctccaagaagaatttgatagatattctggctattggtggtgtccaaaagctgaaacaactcccagtggtggtaaaattcttagaattctatatgaagaaaatgatgaatctgaggtggaaattattcatgttacatcccctatgttggaaacaaggagggcagattcattccgttatcctaaaacaggtacagcaaatcctaaagtcacttttaagatgtcagaaataatgattgatgctgaaggaaggatcatagatgtcatagataaggaactaattcaaccttttgagattctatttgaaggagttgaatatattgccagagctggatggactcctgagggaaaatatgcttggtccatcctactagatcgctcccagactcgcctacagatagtgttgatctcacctgaattatttatcccagtagaagatgatgttatggaaaggcagagactcattgagtcagtgcctgattctgtgacgccactaattatctatgaagaaacaacagacatctggataaatatccatgacatctttcatgtttttccccaaagtcacgaagaggaaattgagtttatttttgcctctgaatgcaaaacaggtttccgtcatttatacaaaattacatctattttaaaggaaagcaaatataaacgatccagtggtgggctgcctgctccaagtgatttcaagtgtcctatcaaagaggagatagcaattaccagtggtgaatgggaagttcttggccggcatggatctaatatccaagttgatgaagtcagaaggctggtatattttgaaggcaccaaagactcccctttagagcatcacctgtacgtagtcagttacgtaaatcctggagaggtgacaaggctgactgaccgtggctactcacattcttgctgcatcagtcagcactgtgacttctttataagtaagtatagtaaccagaagaatccacactgtgtgtccctttacaagctatcaagtcctgaagatgacccaacttgcaaaacaaaggaattttgggccaccattttggattcagcaggtcctcttcctgactatactcctccagaaattttctcttttgaaagtactactggatttacattgtatgggatgctctacaagcctcatgatctacagcctggaaagaaatatcctactgtgctgttcatatatggtggtcctcaggtgcagttggtgaataatcggtttaaaggagtcaagtatttccgcttgaataccctagcctctctaggttatgtggttgtagtgatagacaacaggggatcctgtcaccgagggcttaaatttgaaggcgcctttaaatataaaatggttgctattgctggggccccagtcactctgtggatcttctatgatacaggatacacggaacgttatatgggtcaccctgaccagaatgaacagggctattacttaggatctgtggccatgcaagcagaaaagttcccctctgaaccaaatcgtttactgctcttacatggtttcctggatgagaatgtccattttgcacataccagtatattactgagttttttagtgagggctggaaagccatatgatttacagatctatcctcaggagagacacagcataagagttcctgaatcgggagaacattatgaactgcatcttttgcactaccttcaagaaaaccttggatcacgtattgctgctctaaaagtgatataattttgacctgtgtagaactctctggtatacactggctatttaaccaaatgaggaggtttaatcaacagaaaacacagaattgatcatcacattttgatacctgccatgtaacatctactcctgaaaataaatgtggtgccatgcaggggtctacggtttgtggtagtaatctaataccttaaccccacatgctcaaaatcaaatgatacatattcctgagagacccagcaataccataagaattactaaaaaaaaaaaaaaaa

SEQ ID NO: 8450 - DNA, 2727 bp, Homo sapiens
gaagtgctaaagcctccgaggccaaggccgctgctactgccgccgctgcttcttagtgccgcgttcgccgcctgggttgtcaccggcgccgccgccgaggaagccactgcaaccaggaccggagtggaggcggcgcagcatgaagcggcgcaggcccgctccatagcgcacgtcgggacggtccgggcggggccggggggaaggctttgatggtgaggaaaggaaagattcctgtgagaagagcaggatgagcagagggattctatgcttgaagtcgagtcacttgaaaaagatctctttgaatgtggaagagatctgagcagatgaaaataaaatcaggaaaatgcaacatggcagcagcaatggaaacagaacagctgggtgttgagatatttgaaactgcggactgtgaggagaatattgaatcacaggatcggcctaaattggagcctttttatgttgagcggtattcctggagtcagcttaaaaagctgcttgccgataccagaaaatatcatggctacatgatggctaaggcaccacatgatttcatgtttgtgaagaggaatgatccagatggacctcattcagacagaatctattaccttgccatgtctggtgagaacagagaaaatacactgttttattctgaaattcccaaaactatcaatagagcagcagtcttaatgctctcttggaagcctcttttggatctttttcaggcaacactggactatggaatgtattctcgagaagaagaactattaagagaaagaaaacgcattggaacagtcggaattgcttcttacgattatcaccaaggaagtggaacatttctgtttcaagccggtagtggaatttatcacgtaaaagatggagggccacaaggatttacgcaacaacctttaaggcccaatctagtggaaactagttgtcccaacatacggatggatccaaaattatgccctgctgatccagactggattgcttttatacatagcaacgatatttggatatctaacatcgtaaccagagaagaaaggagactcacttatgtgcacaatgagctagccaacatggaagaagatgccagatcagctggagtcgctacctttgttctccaagaagaatttgatagatattctggctattggtggtgtccaaaagctgaaacaactcccagtggtggtaaaattcttagaattctatatgaagaaaatgatgaatctgaggtggaaattattcatgttacatcccctatgttggaaacaaggagggcagattcattccgttatcctaaaacaggtacagcaaatcctaaagtcacttttaagatgtcagaaataatgattgatgctgaaggaaggatccaagttgatgaagtcagaaggctggtatattttgaaggcaccaaagactcccctttagagcatcacctgtacgtagtcagttacgtaaatcctggagaggtgacaaggctgactgaccgtggctactcacattcttgctgcatcagtcagcactgtgacttctttataagtaagtatagtaaccagaagaatccacactgtgtgtccctttacaagctatcaagtcctgaagatgacccaacttgcaaaacaaaggaattttgggccaccattttggattcagcaggtcctcttcctgactatactcctccagaaattttctcttttgaaagtactactggatttacattgtatgggatgctctacaagcctcatgatctacagcctggaaagaaatatcctactgtgctgttcatatatggtggtcctcaggtgcagttggtgaataatcggtttaaaggagtcaagtatttccgcttgaataccctagcctctctaggttatgtggttgtagtgatagacaacaggggatcctgtcaccgagggcttaaatttgaaggcgcctttaaatataaaatgggtcaaatagaaattgacgatcaggtggaaggactccaatatctagcttctcgatatgatttcattgacttagatcgtgtgggcatccacggctggtcctatggaggatacctctccctgatggcattaatgcagaggtcagatatcttcagggttgctattgctggggccccagtcactctgtggatcttctatgatacaggatacacggaacgttatatgggtcaccctgaccagaatgaacagggctattacttaggatctgtggccatgcaagcagaaaagttcccctctgaaccaaatcgtttactgctcttacatggtttcctggatgagaatgtccattttgcacataccagtatattactgagttttttagtgagggctggaaagccatatgatttacagatctatcctcaggagagacacagcataagagttcctgaatcgggagaacattatgaactgcatcttttgcactaccttcaagaaaaccttggatcacgtattgctgctctaaaagtgatataattttgacctgtgtagaactctctggtatacactggctatttaaccaaatgaggaggtttaatcaacagaaaacacagaattgatcatcacattttgatacctgccatgtaacatctactcctgaaaataaatgtggtgccatgcaggggtctacggtttgtggtagtaatctaataccttaaccccacatgctcaaaatcaaatgatacatattcctgagagacccagcaataccataagaattact

SEQ ID NO: 8451 - DNA, 8699 bp, Homo sapiens
agattccgagtcaaccaccgttcactgggcgccccttgagctctgggcgctggcctcctggcttccacgtccgttatcttaattgagtctcgctggggttgggaggccgggtattgtcagcgcttacagatgaggaaacggaagcccacagaggcgaagggattttccttaagtccgacttggcagatgggcttcggcctcagattttctggtttttcagctggtggtcttttttctctcctgcctcatgctaggtcgattccctccctgctcactgccctctcccattctgttccacccactcgcagcaggacactttcctttcctgccacacctgtcttctcacacacttttcttctaagacttggcattcctcccatctctcttctcaatattctctgctatgcctctcctcttgttcctcattcatagtttttcaaggtctttgccccctctgtgctattgaatctctcaactaggtgtggaccctaaagaatgagatagctaggcttcagtgaggctttaggtgtttaagtggacggctgtttggcccttgagttaaaaattaaggaatttcacttgagtggatccaaactcaagagtcctaaagctattttctgagtcaacatgctctatttctgagtgaggggcttagtgctatgaggtgtcttgacatcttagtccattgttgctgtgctggcataacctcgctgtttttcctgcacttgccacttagcttttcccaccccatcccttcatcacctacttgggctatgggagcccaaaattaaaacttatagagtaacagatgtaatagcagaccttcctttttttttttttcctaagccagaatttcaacaagtttaatgcttctttttccagaaaagttacctatttaaattattctcagagtaatgcagcaagaaaatggaatgcacttaagatgaatagaaaattgtttatctcgtgaaaagtcttaagttattaaattcaagttaattccctttctgcaaaaatggcctgtaactcttactggctatcctcctgagttaattctatctccatccagcttgatatgacattattatgtaaaagaggaacaggaataggcacataaaaataaattttattaatcatatgccgtttttgatgatttgcaatagtcactgagtaacttcacatctgtatgccttttgtaactttttaaagcctttccatggttttcctttgtctggacaccaaagtttgctatgttaggatattcttttgactatattgggctacacatctctgaaataaaataattcttgaattctgataacataaaacgcagatacaaaataatgtaggcattatatattgccccaaaaagtgatattttggtatcagttttaactactattttggggcttctctttttggccacatatggtccatcttaatgatcaaagtcttatcttatttcattatcctggtgagcaggctttgatggtgaggaaaggaaagattcctgtgagaagagcaggatgagcagagggattctatgcttgaagtcgagtcacttgaaaaagatctctttgaatgtggaagagatctgagcagatgaaaataaaatcaggaaaatgcaacatggcagcagcaatggaaacagaacagctgggtgttgagatatttgaaactgcggactgtgaggagaatattgaatcacaggatcggcctaaattggagcctttttatgttgagcggtattcctggagtcagcttaaaaagctgcttgccgataccagaaaatatcatggctacatgatggctaaggcaccacatgatttcatgtttgtgaagaggaatgatccagatggacctcattcagacagaatctattaccttgccatgtctggtgagaacagagaaaatacactgttttattctgaaattcccaaaactatcaatagagcagcagtcttaatgctctcttggaagcctcttttggatctttttcaggcaacactggactatggaatgtattctcgagaagaagaactattaagagaaagaaaacgcattggaacagtcggaattgcttcttacgattatcaccaaggaagtggaacatttctgtttcaagccggtagtggaatttatcacgtaaaagatggagggccacaaggatttacgcaacaacctttaaggcccaatctagtggaaactagttgtcccaacatacggatggatccaaaattatgccctgctgatccagactggattgcttttatacatagcaacgatatttggatatctaacatcgtaaccagagaagaaaggagactcacttatgtgcacaatgagctagccaacatggaagaagatgccagatcagctggagtcgctacctttgttctccaagaagaatttgatagatattctggctattggtggtgtccaaaagctgaaacaactcccagtggtggtaaaattcttagaattctatatgaagaaaatgatgaatctgaggtggaaattattcatgttacatcccctatgttggaaacaaggagggcagattcattccgttatcctaaaacaggtacagcaaatcctaaagtcacttttaagatgtcagaaataatgattgatgctgaaggaaggatcatagatgtcatagataaggaactaattcaaccttttgagattctatttgaaggagttgaatatattgccagagctggatggactcctgagggaaaatatgcttggtccatcctactagatcgctcccagactcgcctacagatagtgttgatctcacctgaattatttatcccagtagaagatgatgttatggaaaggcagagactcattgagtcagtgcctgattctgtgacgccactaattatctatgaagaaacaacagacatctggataaatatccatgacatctttcatgtttttccccaaagtcacgaagaggaaattgagtttatttttgcctctgaatgcaaaacaggtttccgtcatttatacaaaattacatctattttaaaggaaagcaaatataaacgatccagtggtgggctgcctgctccaagtgatttcaagtgtcctatcaaagaggagatagcaattaccagtggtgaatgggaagttcttggccggcatggatctaatatccaagttgatgaagtcagaaggctggtatattttgaaggcaccaaagactcccctttagagcatcacctgtacgtagtcagttacgtaaatcctggagaggtgacaaggctgactgaccgtggctactcacattcttgctgcatcagtcagcactgtgacttctttataagtaagtatagtaaccagaagaatccacactgtgtgtccctttacaagctatcaagtcctgaagatgacccaacttgcaaaacaaaggaattttgggccaccattttggattcagcaggtcctcttcctgactatactcctccagaaattttctcttttgaaagtactactggatttacattgtatgggatgctctacaagcctcatgatctacagcctggaaagaaatatcctactgtgctgttcatatatggtggtcctcaggtgcagttggtgaataatcggtttaaaggagtcaagtatttccgcttgaataccctagcctctctaggttatgtggttgtagtgatagacaacaggggatcctgtcaccgagggcttaaatttgaaggcgcctttaaatataaaatgggtcaaatagaaattgacgatcaggtggaaggactccaatatctagcttctcgatatgatttcattgacttagatcgtgtgggcatccacggctggtcctatggaggatacctctccctgatggcattaatgcagaggtcagatatcttcagggttgctattgctggggccccagtcactctgtggatcttctatgatacaggatacacggaacgttatatgggtcaccctgaccagaatgaacagggctattacttaggatctgtggccatgcaagcagaaaagttcccctctgaaccaaatcgtttactgctcttacatggtttcctggatgagaatgtccattttgcacataccagtatattactgagttttttagtgagggctggaaagccatatgatttacagatctatcctcaggagagacacagcataagagttcctgaatcgggagaacattatgaactgcatcttttgcactaccttcaagaaaaccttggatcacgtattgctgctctaaaagtgatataattttgacctgtgtagaactctctggtatacactggctatttaaccaaatgaggaggtttaatcaacagaaaacacagaattgatcatcacattttgatacctgccatgtaacatctactcctgaaaataaatgtggtgccatgcaggggtctacggtttgtggtagtaatctaataccttaaccccacatgctcaaaatcaaatgatacatattcctgagagacccagcaataccataagaattactaaaaaaaaaaaaaaaaaaaagacattagcaccatgtattcatactaccctattttcacttttaatagtattataaacttcatgaacttaattagtgtatttttacagtatacttttgagtttgttaaaatatgatgatattagtgattggtttggttcagttccagaatctttgactagttacagatttgatagcacttaaatgtaattgaatagcttatgcttcattgcttgggcatatccagcatgttatgaactaataactattaaacttgacttaaccagtcattcattaataatttttcaaggataacttagtggcctcctaaagacacttgttttggcactgaccagtttttagccaatttaatctgtatctagtataaataattctcatttttctttgatgatattaacagagtgggcttttccttttgcataaaggctagtaactgtatatgtagcatggatttaattagtcatgatattgataattacaggcagaaaatttttaatcaaatgattagagcttaaatatttgcaggcaagtttttttttttcctttaagaaaaggaaaaagtacacattcactagaattcttcagaaaatttagtggtgccagtttccatttggtatttccttattaaaatattctagaattttaaggagattgaagggaatcacagtggggtggggagacctgggtttggggaatgacagagagaagaggtggtgagggcctgattaaaaactaagcagaagtagttttaacaaaaatactcatgaaaatgtttggaaactgaaatttaaacaactgtaatattaaggaaaccagaatcaataaatcactgtcttgccagcacagctacagagtaacatgattcaggggaggaaaagttccttagagttacttttataattctttttttttttcctcttaggtttagaaatcttacaaatttaaactttatccttttaaaattatttgaacataatttagatattgtaagcttaaaatacaaatgtttatagataacctctttaccataaactaatccctggcaagccatggctctctttttttttttggtgtttaaagcctgtaaacagtttttctgaatgatcatgaacttttcttggtttagcactaggatttagctatgaagagagctcataggctttcaggtgctaattgagatctgccctgttagagtcttggggtgctagattggtcacattgacaccagtggcagggaaggcatctatgagtttgatgctttttatcacacacttcagtgtttagaaagttattaccaatacttttaaacaacactccaagaaaatttgctatatttctttctcatcactacagagagagtagatttccccatagagagcacagcctccattagtaaggttggtgactattggtaagaggtggacttcattgacaccaagtgggaggtagggaaagcccagaaatggcaggatgatatggtggttctgtcgttgggaaaggtattgggttttgctgtttgtatttatactgtataatagataccacgctttttcttattatctgtatatgtattgcttttcatgtttgatattttcccatgccaagatttgtttatatatattttcaatgttaaattaaattgatttgggtaactttcttccccaagaaagtattttcccccttaagtatatatctgactgtggagggtgttttgttttgttttgttttgttttgtttggactaactggcctcgaaggatctatccttataatatatgcaaagtagaaatggtatacagtagcttttaagcagctactccattgaaacctctcacccattaaggctgtttcttcaaagtggcatctcttattttaccgaaacaaacttagaaaacttcatgtactctggagttcacaggtgttttccttttgcatgttgccttctcctttcctcctatcacaaagaatgcttctattatcactcccagtcacttaaatgccattctgcttctttagcaggaaaaaatacctgaatgaattctcttacagaaagacagtttgactgaatttgctttttacaatcagtgtggaaaatatcatagtcaattgaggcaatcagtagaaatctcactaaaagtttgtaccccctgagtatgggtaacagcttaaacggcaagaatatataaaagtagcaacagtttagtgggagccaaaaagcactaggttaaatatcatactacgtttttaaagacttgataaatgtgtacacttgaacaaccatccagagggatagttacttgagcattacagagtagtggaactcaaaatctaagattcatctgggatacttctaaaagaaatgtagagttttgaatctcactcttaaaaatgtgtattcccaggctaggcatggtggctcacgcctgtaatcctagcactttgggaggccaaggcgggtgaatcacttgaagtcaggagatcaagaccagcttggtcgacatggtgaaaccccgtctctactaaaagtacaaaaaaattagctgggcatgatggcgtgtgcctataatcccacctactcgggaggctgaggcaggagaatcgcttgaacctgggaggcggaagttgcagtgagccgagatggcgccactgtagtccagtctgggcgacagagtgagattctgcctcaaaataaataaataaataaaaatttgtattccattgatttgggtagacaccaggaatgtgcatttctaacaagctttccaggcgatcctatagtaagtcatctgtggactactttaagaaactcttctatagagaatggagttggattaataataggtgattttttacactggactgattcacaagaacctaaacagtagtccatgaagctgctcatctgtggtaactatttggccccgtctcactctgaaagcagcaggagatgttgtttactttgtttctatcccctttgtctggagattaattttggaatgaaagtttttctctctatgccattcctggttcttttccaaagcctcatacaagaggattaggtcacaatgcatgcattaccttttaaaagaatgcgatattgataccgatgcttacttttttttttttactacttgttttattcctt[450 bp omitted]cttccttggtatagtggaggatttgaggattggaatatagagtagagtgcttgcttaagcctgggagcccatctttatagctatttgatgtaagaaaagagacatggccatttctaaactatataaggtgagtgtgtctattcccagcagatataaaggaaaaaggaaacttttttgattcccaccttcccagcctcacctagccatcttccagcctcaaatatagagatgttagtgcaaggtcctgggctctaggtgatcatttcataagtcctttacagataaagaaaaagtagtgtttgtatgtttgtttttaagtaaccccaaaacaaatttatattgtattcagcaaaattggaattcaggtgtttaattttagaacatgaagtgcctgctgttttaagcattgacttgtataaaaagaattgcatgtctccagtaagcttatgggttttctcatttttaggtatatggcttttaatcatgtaaagtgaaacattagttttcttgcattttattacaggttctttgttgcaataaagatgctgctgaaattaattga

SEQ ID NO: 8452 - DNA, 2822 bp, Homo sapiens
aaagcctccgaggccaaggccgctgctactgccgccgctgcttcttagtgccgcgttcgccgcctgggttgtcaccggcgccgccgccgaggaagccactgcaaccaggaccggagtggaggcggcgcagcatgaagcggcgcaggcccgctccatagcgcacgtcgggacggtccgggcggggccggggggaaggaaaatgcaacatggcagcagcaatggaaacagaacagctgggtgttgagatatttgaaactgcggactgtgaggagaatattgaatcacaggatcggcctaaattggagcctttttatgttgagcggtattcctggagtcagcttaaaaagctgcttgccgataccagaaaatatcatggctacatgatggctaaggcaccacatgatttcatgtttgtgaagaggaatgatccagatggacctcattcagacagaatctattaccttgccatgtctggtgagaacagagaaaatacactgttttattctgaaattcccaaaactatcaatagagcagcagtcttaatgctctcttggaagcctcttttggatctttttcaggcaacactggactatggaatgtattctcgagaagaagaactattaagagaaagaaaacgcattggaacagtcggaattgcttcttacgattatcaccaaggaagtggaacatttctgtttcaagccggtagtggaatttatcacgtaaaagatggagggccacaaggatttacgcaacaacctttaaggcccaatctagtggaaactagttgtcccaacatacggatggatccaaaattatgccctgctgatccagactggattgcttttatacatagcaacgatatttggatatctaacatcgtaaccagagaagaaaggagactcacttatgtgcacaatgagctagccaacatggaagaagatgccagatcagctggagtcgctacctttgttctccaagaagaatttgatagatattctggctattggtggtgtccaaaagctgaaacaactcccagtggtggtaaaattcttagaattctatatgaagaaaatgatgaatctgaggtggaaattattcatgttacatcccctatgttggaaacaaggagggcagattcattccgttatcctaaaacaggtacagcaaatcctaaagtcacttttaagatgtcagaaataatgattgatgctgaaggaaggatcatagatgtcatagataaggaactaattcaaccttttgagattctatttgaaggagttgaatatattgccagagctggatggactcctgagggaaaatatgcttggtccatcctactagatcgctcccagactcgcctacagatagtgttgatctcacctgaattatttatcccagtagaagatgatgttatggaaaggcagagactcattgagtcagtgcctgattctgtgacgccactaattatctatgaagaaacaacagacatctggataaatatccatgacatctttcatgtttttccccaaagtcacgaagaggaaattgagtttatttttgcctctgaatgcaaaacaggtttccgtcatttatacaaaattacatctattttaaaggaaagcaaatataaacgatccagtggtgggctgcctgctccaagtgatttcaagtgtcctatcaaagaggagatagcaattaccagtggtgaatgggaagttcttggccggcatggatctaatatccaagttgatgaagtcagaaggctggtatattttgaaggcaccaaagactcccctttagagcatcacctgtacgtagtcagttacgtaaatcctggagaggtgacaaggctgactgaccgtggctactcacattcttgctgcatcagtcagcactgtgacttctttataagtaagtatagtaaccagaagaatccacactgtgtgtccctttacaagctatcaagtcctgaagatgacccaacttgcaaaacaaaggaattttgggccaccattttggattcagcaggtcctcttcctgactatactcctccagaaattttctcttttgaaagtactactggatttacattgtatgggatgctctacaagcctcatgatctacagcctggaaagaaatatcctactgtgctgttcatatatggtggtcctcaggttgctattgctggggccccagtcactctgtggatcttctatgatacaggatacacggaacgttatatgggtcaccctgaccagaatgaacagggctattacttaggatctgtggccatgcaagcagaaaagttcccctctgaaccaaatcgtttactgctcttacatggtttcctggatgagaatgtccattttgcacataccagtatattactgagttttttagtgagggctggaaagccatatgatttacagatctatcctcaggagagacacagcataagagttcctgaatcgggagaacattatgaactgcatcttttgcactaccttcaagaaaaccttggatcacgtattgctgctctaaaagtgatataattttgacctgtgtagaactctctggtatacactggctatttaaccaaatgaggaggtttaatcaacagaaaacacagaattgatcatcacattttgatacctgccatgtaacatctactcctgaaaataaatgtggtgccatgcaggggtctacggtttgtggtagtaatctaataccttaaccccacatgctcaaaatcaaatgatacatattcctgagagacccagcaataccataagaattactaaaaaaaaaaaaaaaaaaaa

SEQ ID NO: 8453 - DNA, 2953 bp, Homo sapiens
tcctggtgagcaggctttgatggtgaggaaaggaaagattcctgtgagaagagcaggatgagcagagggattctatgcttgaagtcgagtcacttgaaaaagatctctttgaatgtggaagagatctgagcagatgaaaataaaatcaggaaaatgcaacatggcagcagcaatggaaacagaacagctgggtgttgagatatttgaaactgcggactgtgaggagaatattgaatcacaggatcggcctaaattggagcctttttatgttgagcggtattcctggagtcagcttaaaaagctgcttgccgataccagaaaatatcatggctacatgatggctaaggcaccacatgatttcatgtttgtgaagaggaatgatccagatggacctcattcagacagaatctattaccttgccatgtctggtgagaacagagaaaatacactgttttattctgaaattcccaaaactatcaatagagcagcagtcttaatgctctcttggaagcctcttttggatctttttcaggcaacactggactatggaatgtattctcgagaagaagaactattaagagaaagaaaacgcattggaacagtcggaattgcttcttacgattatcaccaaggaagtggaacatttctgtttcaagccggtagtggaatttatcacgtaaaagatggagggccacaaggatttacgcaacaacctttaaggcccaatctagtggaaactagttgtcccaacatacggatggatccaaaattatgccctgctgatccagactggattgcttttatacatagcaacgatatttggatatctaacatcgtaaccagagaagaaaggagactcacttatgtgcacaatgagctagccaacatggaagaagatgccagatcagctggagtcgctacctttgttctccaagaagaatttgatagatattctggctattggtggtgtccaaaagctgaaacaactcccagtggtggtaaaattcttagaattctatatgaagaaaatgatgaatctgaggtggaaattattcatgttacatcccctatgttggaaacaaggagggcagattcattccgttatcctaaaacaggtacagcaaatcctaaagtcacttttaagatgtcagaaataatgattgatgctgaaggaaggatcatagatgtcatagataaggaactaattcaaccttttgagattctatttgaaggagttgaatatattgccagagctggatggactcctgagggaaaatatgcttggtccatcctactagatcgctcccagactcgcctacagatagtgttgatctcacctgaattatttatcccagtagaagatgatgttatggaaaggcagagactcattgagtcagtgcctgattctgtgacgccactaattatctatgaagaaacaacagacatctggataaatatccatgacatctttcatgtttttccccaaagtcacgaagaggaaattgagtttatttttgcctctgaatgcaaaacaggtttccgtcatttatacaaaattacatctattttaaaggaaagcaaatataaacgatccagtggtgggctgcctgctccaagtgatttcaagtgtcctatcaaagaggagatagcaattaccagtggtgaatgggaagttcttggccggcatggatctaatatccaagttgatgaagtcagaaggctggtatattttgaaggcaccaaagactcccctttagagcatcacctgtacgtagtcagttacgtaaatcctggagaggtgacaaggctgactgaccgtggctactcacattcttgctgcatcagtcagcactgtgacttctttataagtaagtatagtaaccagaagaatccacactgtgtgtccctttacaagctatcaagtcctgaagatgacccaacttgcaaaacaaaggaattttgggccaccattttggattcagcaggtcctcttcctgactatactcctccagaaattttctcttttgaaagtactactggatttacattgtatgggatgctctacaagcctcatgatctacagcctggaaagaaatatcctactgtgctgttcatatatggtggtcctcaggtgcagttggtgaataatcggtttaaaggagtcaagtatttccgcttgaataccctagcctctctaggttatgtggttgtagtgatagacaacaggggatcctgtcaccgagggcttaaatttgaaggcgcctttaaatataaaatgggtcaaatagaaattgacgatcaggtggaaggactccaatatctagcttctcgatatgatttcattgacttagatcgtgtgggcatccacggctggtcctatggaggatacctctccctgatggcattaatgcagaggtcagatatcttcagggttgctattgctggggccccagtcactctgtggatcttctatgatacaggatacacggaacgttatatgggtcaccctgaccagaatgaacagggctattacttaggatctgtggccatgcaagcagaaaagttcccctctgaaccaaatcgtttactgctcttacatggtttcctggatgagaatgtccattttgcacataccagtatattactgagttttttagtgagggctggaaagccatatgatttacagatctatcctcaggagagacacagcataagagttcctgaatcgggagaacattatgaactgcatcttttgcactaccttcaagaaaaccttggatcacgtattgctgctctaaaagtgatataattttgacctgtgtagaactctctggtatacactggctatttaaccaaatgaggaggtttaatcaacagaaaacacagaattgatcatcacattttgatacctgccatgtaacatctactcctgaaaataaatgtggtgccatgc

SEQ ID NO: 8454 - DNA, 5817 bp, Homo sapiens
gactgatcatttggctcttgccggaaatcgttccgcccggtgaggtttcggcgtgagacccgaggagggcggggaagaggcgtgacggagattcctgaggtgtagtagcctgaggttcccttatgtggccctatagctgttactgaaggaagtagcctacgtccacgcctacaactgaagtctcttgacaaacacctcacccctgcctccgggatgaaagggggtaacctagacctgaatgggcttgaccatctcacaactgctcgcgtgacgaccgcattcgtggcaggtaagaagattgctgtatcaactcaagaaagcagtaacttcactgtctttgtattttgaattgcaacaacaactttgatatcaacaatgaagcaatgatatctaagaacaaaagagtatttgccaacagtcatcataatatcaagtgattgtataagcagaaacaagctgtcacagacctgtgcgtcagctaatatatggagaatgctttcttctgatactatttacttagaggcagttttaatataaatcatttcaattatatctacatcaaataaaataaaaatgagtgaagcccccagattcttcgttggaccagaagatacagaaataaatcctggaaattatcgacatttcttccaccatgcagatgaagacgatgaggaggaagatgattctccaccagaaaggcagattgtggttggaatatgttccatggcaaagaaatccaaatccaaaccaatgaaggaaattcttgaacggatctccttatttaaatatatcacagtagtagtatttgaagaggaggttattttgaatgaaccagtggaaaactggcctttatgtgattgtcttatttctttccattctaaaggatttccactggacaaagcggttgcctatgcaaaactcaggaatccatttgtaatcaatgacttgaatatgcagtatctcatacaagataggagagaagtatatagtattcttcaagctgaaggtattttacttcctcgttatgctattttgaaccgtgacccaaataatcccaaagaatgtaatctgattgaaggggaagatcatgtagaagtaaatggggaagtttttcaaaagccatttgtagaaaagccagtcagtgcagaagatcacaatgtttacatttattacccaacttctgctggtggtggaagtcaaagactctttagaaagattggcagtagaagtagtgtttattctccagaaagcaatgtacgaaaaacaggctcatatatatatgaagagtttatgcccacagatggtactgatgttaaggtttatacagtgggtccagattatgcccatgctgaagctcgaaaatctccagcacttgatggcaaggtggaacgagacagtgaaggaaaagaagtaagataccctgttattctcaatgcacgagagaaattaattgcttggaaagtctgccttgcttttaagcaaacagtttgtggctttgatttgttacgggccaatggacagtcctatgtctgtgatgtcaatggcttcagttttgtgaaaaattccatgaagtattatgatgactgtgcaaaaatacttggaaatattgtaatgcgagaacttgctccacaatttcatattccatggtcaatacccttagaagctgaagatatcccaattgtaccaactacatctggaactatgatggaacttagatgtgtcatagctgttatacgtcatggggatcgaacaccaaaacaaaaaatgaaaatggaagtgagacatcagaaattttttgatctttttgaaaagtgtgatggatataaatcagggaaattaaaactcaaaaaaccaaaacagttacaggaagtgctagatattgcacgacagcttcttatggagctagggcaaaataatgattctgaaattgaagaaaacaagccaaaacttgaacaacttaagactgtattagagatgtatggtcatttttctggaataaatcgtaaggttcagttgacctatctccctcatggttgtcctaaaacatctagtgaagaggaggacagccgaagagaagaaccatctttacttttggttctaaaatggggaggtgaattaactcctgcaggcagggtccaggctgaagaacttggaagagccttcaggtgtatgtatcctggaggtcaaggagattatgcaggatttcctggttgtggtttacttagattacatagcacctacagacatgacctcaaaatatatgcctctgatgaaggacgagtccagatgactgcagctgcttttgcaaaggggcttttagctttggaaggagagcttacacccattcttgttcaaatggtgaaaagtgcaaatatgaacggtcttttggatagtgatagtgactctctgagcagttgtcagcaacgtgtgaaggcaaggcttcatgaaatacttcagaaagacagagattttactgctgaagattatgaaaagcttactccatctggaagcatttctcttatcaaatcaatgcatttaattaaaaaccctgtgaagacctgtgataaagtttattccttaattcagagtttgacttctcaaatcagacatcgaatggaagatcctaaatcatcagatattcagctttaccatagtgaaacattggagcttatgctacgtagatggtccaagttagagaaagactttaaaacaaagaatggaagatatgatattagtaaaatccctgacatatatgactgtataaaatatgatgtccagcataatggttccttgaaattagaaaacacaatggaattatataggctttcgaaggcattagcagatattgttatccctcaggaatatggtataactaaagctgaaaaactggagattgccaaaggctactgtactcctctggttagaaaaattcgctcagaccttcagaggacacaagatgatgacactgtaaataaacttcatcctgtgtattctagaggtgttctgtctcctgaacgtcatgttcgtactagattatattttaccagtgaaagtcatgtacattctttgctgtctattcttcgctatggtgccttatgcaatgaatcaaaggatgaacagtggaaacgagctatggattatttaaacgttgtcaatgagctcaactacatgactcagattgttatcatgctttatgaggatcctaataaggatctttcctcagaagaacgctttcatgttgaattacactttagtccgggagccaaaggttgtgaagaagacaaaaatttgccatctggctatggatatagaccagcttccagagagaatgaaggcaggagaccttttaaaattgataatgatgatgaaccacatacttctaaaagagatgaagttgatcgagctgtgatattgtttaaaccaatggtatcagagccaattcatatacacaggaagtctccacttccaagatctaggaagacggctacaaatgatgaagagagccccctgagtgtgtctagcccagagggtactggtacctggctgcattataccagtggtgtgggtactgggcgtcgaagacgcagatcaggggaacaaatcacttcttcccctgtctcccccaaatcattggctttcacatccagtatttttggctcatggcaacaggttgtatctgaaaatgctaattacctgagaacaccaagaactcttgtggaacagaagcagaatcctactgtagggtctcactgtgcgggcctgtttagcacctcggtgctcgggggttcttcaagcgcacctaacctacaggattatgctcgtactcatcgtaaaaagctgacctcttctggctgcatagatggctttgaattgtattccatggtgccatctatttgtcctctagaaactcttcataatgccctatctttaaagcaagtggatgaatttcttgcttccattgcttctccatcatctgacgttccacggaagaccgctgaaatttcctctacagctttacgttccagtccaataatgagaaaaaaagtatctttaaatacgtatacacctgcaaagatcctcccaacaccaccagctaccttaaagagcactaaagcaagcagcaaaccagctacaagtggaccttctagtgcagttgttcctaatacctcatctcggaaaaagaatataactagcaaaacagaaacgcatgaacacaaaaaaaacactgggaaaaagaaatgaaatcttagcagaagctggaactttttatacttataaaaatagtatgttcttatgtttctccttatgcatttatgtgttcacttaaaaatgtttttaaatctaaggttttctttgtttatgttcaggtaaggaactgttgtcatgatctggaaatgtttaaaacaatgtttgttagcattctgtgagcagcaaaacttatagtgataaaaatcgattgttgttaatatgatgtttaccatgtgcacatagtaatgaaaaggaacataaaagcccagcaggctcgtaccaaagtcacagcagtaatgctatgtactgcagagtctgatgagctggcctttgtgcacacttttattttcatgggattgcatcttagctgttaaaacttctagattgaaatttgacagccagggttacatattggggacttttaaagtgtctttccaaagagatttcattaaccgtttagattagaatatctttcccaattgttacagtgacatatatgctgcaatatttaacaactggagtattagccacatgggttattttttcaatctgtgttttgaatttttttattgtgtgttatttaaaatattacatatgcagctgggagaactacacctttgtgcacatagatttatatattaatttgtagaaaatattttctttatatatttccttaccatacaaggtgccttgttcatcaggaaaacttttgttttgtattttgacaagaaaggcaccttcagagtttctttttaagtatagttgacaagtgtataaatgttacacttactttcagagttctttttagatctaaagaagtcagttcaaaaatggaaatcaacaatgttaggagaaatctgaattctgttaagttagtaagtattatgtatagcatctgtttttaaccatttccattcttatccctagtgtatcagttgatcacactaagaaagcttaaagattgagcatttgaaataaatgctctttataaatgattagatttttgaagggatattgaaatcattgcgctgtgatttcatctgtgatgtgaaaaatcaatttattatccttggtgctttcccccccaccaatgcacaaataattgtgaacagcttgaaatgacttaaactgtaatccaaatgggacaatctgataagaatttcatgcattggtagttaaataacttaaattgctaaagctttagcttgaaatttatgtttagaaaaactattgatttcccatggtatgaatataactattgtaattcttcaaatgagactcttctcaccttaaatagtcatatattaattaacttataggaaataagcatactatatgttagctgttttaaaaggtaccagatgtaagagtcataaatatatgcaattaaagaagttcatagatttcacatgaatgtaaatgtgttatatggagacatgtcttgtaaacagttgaatgtatgtaagttttctgtttgtgaaaatgtagttaatgtactcactgtggaggtcataaggaagctactttttttttaaagtggaacctaattaaaatatttccagaatcaaa

SEQ ID NO: 8455 - DNA, 5813 bp, Homo sapiens
gagggcggggaagaggcgtgacggagattcctgaggtgtagtagcctgaggttcccttatgtggccctatagctgttactgaaggaagtagcctacgtccacgcctacaactgaagtctcttgacaaacacctcacccctgcctccgggatgaaagggggtaacctagacctgaatgggcttgaccatctcacaactgctcgcgtgacgaccgcattcgtggcaggtaagaagattgctgtatcaactcaagaaagcagtaacttcactgtctttgtattttgaattgcaacaacaactttgatatcaacaatgaagcaatgatatctaagaacaaaagagtatttgccaacagtcatcataatatcaagtgattgtataagcagaaacaagctgtcacagacctgtgcgtcagctaatatatggagaatgctttcttctgatactatttacttagaggcagttttaatataaatcatttcaattatatctacatcaaataaaataaaaatgagtgaagcccccagattcttcgttggaccagaagatacagaaataaatcctggaaattatcgacatttcttccaccatgcagatgaagacgatgaggaggaagatgattctccaccagaaaggcagattgtggttggaatatgttccatggcaaagaaatccaaatccaaaccaatgaaggaaattcttgaacggatctccttatttaaatatatcacagtagtagtatttgaagaggaggttattttgaatgaaccagtggaaaactggcctttatgtgattgtcttatttctttccattctaaaggatttccactggacaaagcggttgcctatgcaaaactcaggaatccatttgtaatcaatgacttgaatatgcagtatctcatacaagataggagagaagtatatagtattcttcaagctgaaggtattttacttcctcgttatgctattttgaaccgtgacccaaataatcccaaagaatgtaatctgattgaaggggaagatcatgtagaagtaaatggggaagtttttcaaaagccatttgtagaaaagccagtcagtgcagaagatcacaatgtttacatttattacccaacttctgctggtggtggaagtcaaagactctttagaaagattggcagtagaagtagtgtttattctccagaaagcaatgtacgaaaaacaggctcatatatatatgaagagtttatgcccacagatggtactgatgttaaggtttatacagtgggtccagattatgcccatgctgaagctcgaaaatctccagcacttgatggcaaggtggaacgagacagtgaaggaaaagaagtaagataccctgttattctcaatgcacgagagaaattaattgcttggaaagtctgccttgcttttaagcaaacagtttgtggctttgatttgttacgggccaatggacagtcctatgtctgtgatgtcaatggcttcagttttgtgaaaaattccatgaagtattatgatgactgtgcaaaaatacttggaaatattgtaatgcgagaacttgctccacaatttcatattccatggtcaatacccttagaagctgaagatatcccaattgtaccaactacatctggaactatgatggaacttagatgtgtcatagctgttatacgtcatggggatcgaacaccaaaacaaaaaatgaaaatggaagtgagacatcagaaattttttgatctttttgaaaagtgtgatggatataaatcagggaaattaaaactcaaaaaaccaaaacagttacaggaagtgctagatattgcacgacagcttcttatggagctagggcaaaataatgattctgaaattgaagaaaacaagccaaaacttgaacaacttaagactgtattagagatgtatggtcatttttctggaataaatcgtaaggttcagttgacctatctccctcatggttgtcctaaaacatctagtgaagaggaggacagccgaagagaagaaccatctttacttttggttctaaaatggggaggtgaattaactcctgcaggcagggtccaggctgaagaacttggaagagccttcaggtgtatgtatcctggaggtcaaggagattatgcaggatttcctggttgtggtttacttagattacatagcacctacagacatgacctcaaaatatatgcctctgatgaaggacgagtccagatgactgcagctgcttttgcaaaggggcttttagctttggaaggagagcttacacccattcttgttcaaatggtgaaaagtgcaaatatgaacggtcttttggatagtgatagtgactctctgagcagttgtcagcaacgtgtgaaggcaaggcttcatgaaatacttcagaaagacagagattttactgctgaagattatgaaaagcttactccatctggaagcatttctcttatcaaatcaatgcatttaattaaaaaccctgtgaagacctgtgataaagtttattccttaattcagagtttgacttctcaaatcagacatcgaatggaagatcctaaatcatcagatattcagctttaccatagtgaaacattggagcttatgctacgtagatggtccaagttagagaaagactttaaaacaaagaatggaagatatgatattagtaaaatccctgacatatatgactgtataaaatatgatgtccagcataatggttccttgaaattagaaaacacaatggaattatataggctttcgaaggcattagcagatattgttatccctcaggaatatggtataactaaagctgaaaaactggagattgccaaaggctactgtactcctctggttagaaaaattcgctcagaccttcagaggacacaagatgatgacactgtaaataaacttcatcctgtgtattctagaggtgttctgtctcctgaacgtcatgttcgtactagattatattttaccagtgaaagtcatgtacattctttgctgtctattcttcgctatggtgccttatgcaatgaatcaaaggatgaacagtggaaacgagctatggattatttaaacgttgtcaatgagctcaactacatgactcagattgttatcatgctttatgaggatcctaataaggatctttcctcagaagaacgctttcatgttgaattacactttagtccgggagccaaaggttgtgaagaagacaaaaatttgccatctggctatggatatagaccagcttccagagagaatgaaggcaggagaccttttaaaattgataatgatgatgaaccacatacttctaaaagagatgaagttgatcgagctgtgatattgtttaaaccaatggtatcagagccaattcatatacacaggaagtctccacttccaagatctaggaagacggctacaaatgatgaagagagccccctgagtgtgtctagcccagagggtactggtacctggctgcattataccagtggtgtgggtactgggcgtcgaagacgcagatcaggggaacaaatcacttcttcccctgtctcccccaaatcattggctttcacatccagtatttttggctcatggcaacaggttgtatctgaaaatgctaattacctgagaacaccaagaactcttgtggaacagaagcagaatcctactgtagggtctcactgtgcgggcctgtttagcacctcggtgctcgggggttcttcaagcgcacctaacctacaggattatgctcgtactcatcgtaaaaagctgacctcttctggctgcatagatgacgccacacgcggttctgctgttaaaaggttttctatctcatttgctcgacacccaaccaatggctttgaattgtattccatggtgccatctatttgtcctctagaaactcttcataatgccctatctttaaagcaagtggatgaatttcttgcttccattgcttctccatcatctgacgttccacggaagaccgctgaaatttcctctacagctttacgttccagtccaataatgagaaaaaaagtatctttaaatacgtatacacctgcaaagatcctcccaacaccaccagctaccttaaagagcactaaagcaagcagcaaaccagctacaagtggaccttctagtgcagttgttcctaatacctcatctcggaaaaagaatataactagcaaaacagaaacgcatgaacacaaaaaaaacactgggaaaaagaaatgaaatcttagcagaagctggaactttttatacttataaaaatagtatgttcttatgtttctccttatgcatttatgtgttcacttaaaaatgtttttaaatctaaggttttctttgtttatgttcaggtaaggaactgttgtcatgatctggaaatgtttaaaacaatgtttgttagcattctgtgagcagcaaaacttatagtgataaaaatcgattgttgttaatatgatgtttaccatgtgcacatagtaatgaaaaggaacataaaagcccagcaggctcgtaccaaagtcacagcagtaatgctatgtactgcagagtctgatgagctggcctttgtgcacacttttattttcatgggattgcatcttagctgttaaaacttctagattgaaatttgacagccagggttacatattggggacttttaaagtgtctttccaaagagatttcattaaccgtttagattagaatatctttcccaattgttacagtgacatatatgctgcaatatttaacaactggagtattagccacatgggttattttttcaatctgtgttttgaatttttttattgtgtgttatttaaaatattacatatgcagctgggagaactacacctttgtgcacatagatttatatattaatttgtagaaaatattttctttatatatttccttaccatacaaggtgccttgttcatcaggaaaacttttgttttgtattttgacaagaaaggcaccttcagagtttctttttaagtatagttgacaagtgtataaatgttacacttactttcagagttctttttagatctaaagaagtcagttcaaaaatggaaatcaacaatgttaggagaaatctgaattctgttaagttagtaagtattatgtatagcatctgtttttaaccatttccattcttatccctagtgtatcagttgatcacactaagaaagcttaaagattgagcatttgaaataaatgctctttataaatgattagatttttgaagggatattgaaatcattgcgctgtgatttcatctgtgatgtgaaaaatcaatttattatccttggtgctttcccccccaccaatgcacaaataattgtgaacagcttgaaatgacttaaactgtaatccaaatgggacaatctgataagaatttcatgcattggtagttaaataacttaaattgctaaagctttagcttgaaatttatgtttagaaaaactattgatttcccatggtatgaatataactattgtaattcttcaaatgagactcttctcaccttaaatagtcatatattaattaacttataggaaataagcatactatatgttagctgttttaaaaggtaccagatgtaagagtcataaatatatgcaattaaagaagttcatagatttcacatgaatgtaaatgtgttatatggagacatgtcttgtaaacagttgaatgtatgtaagttttctgtttgtgaaaatgtagttaatgtactcactgtggaggtcataaggaagctactttttttttaaagtggaacctaattaaaatatttccagaatc

SEQ ID NO: 8456 - DNA, 5278 bp, Homo sapiens
aatcatttcaattatatctacatcaaataaaataaaaatgagtgaagcccccagattcttcgttggaccagaagatacagaaataaatcctggaaattatcgacatttcttccaccatgcagatgaagacgatgaggaggaagatgattctccaccagaaaggcagattgtggttggaatatgttccatggcaaagaaatccaaatccaaaccaatgaaggaaattcttgaacggatctccttatttaaatatatcacagtagtagtatttgaagaggaggttattttgaatgaaccagtggaaaactggcctttatgtgattgtcttatttctttccattctaaaggatttccactggacaaagcggttgcctatgcaaaactcaggaatccatttgtaatcaatgacttgaatatgcagtatctcatacaagataggagagaagtatatagtattcttcaagctgaaggtattttacttcctcgttatgctattttgaaccgtgacccaaataatcccaaagaatgtaatctgattgaaggggaagatcatgtagaagtaaatggggaagtttttcaaaagccatttgtagaaaagccagtcagtgcagaagatcacaatgtttacatttattacccaacttctgctggtggtggaagtcaaagactctttagaaagattggcagtagaagtagtgtttattctccagaaagcaatgtacgaaaaacaggctcatatatatatgaagagtttatgcccacagatggtactgatgttaaggtttatacagtgggtccagattatgcccatgctgaagctcgaaaatctccagcacttgatggcaaggtggaacgagacagtgaaggaaaagaagtaagataccctgttattctcaatgcacgagagaaattaattgcttggaaagtctgccttgcttttaagcaaacagtttgtggctttgatttgttacgggccaatggacagtcctatgtctgtgatgtcaatggcttcagttttgtgaaaaattccatgaagtattatgatgactgtgcaaaaatacttggaaatattgtaatgcgagaacttgctccacaatttcatattccatggtcaatacccttagaagctgaagatatcccaattgtaccaactacatctggaactatgatggaacttagatgtgtcatagctgttatacgtcatggggatcgaacaccaaaacaaaaaatgaaaatggaagtgagacatcagaaattttttgatctttttgaaaagtgtgatggatataaatcagggaaattaaaactcaaaaaaccaaaacagttacaggaagtgctagatattgcacgacagcttcttatggagctagggcaaaataatgattctgaaattgaagaaaacaagccaaaacttgaacaacttaagactgtattagagatgtatggtcatttttctggaataaatcgtaaggttcagttgacctatctccctcatggttgtcctaaaacatctagtgaagaggaggacagccgaagagaagaaccatctttacttttggttctaaaatggggaggtgaattaactcctgcaggcagggtccaggctgaagaacttggaagagccttcaggtgtatgtatcctggaggtcaaggagattatgcaggatttcctggttgtggtttacttagattacatagcacctacagacatgacctcaaaatatatgcctctgatgaaggacgagtccagatgactgcagctgcttttgcaaaggggcttttagctttggaaggagagcttacacccattcttgttcaaatggtgaaaagtgcaaatatgaacggtcttttggatagtgatagtgactctctgagcagttgtcagcaacgtgtgaaggcaaggcttcatgaaatacttcagaaagacagagattttactgctgaagattatgaaaagcttactccatctggaagcatttctcttatcaaatcaatgcatttaattaaaaaccctgtgaagacctgtgataaagtttattccttaattcagagtttgacttctcaaatcagacatcgaatggaagatcctaaatcatcagatattcagctttaccatagtgaaacattggagcttatgctacgtagatggtccaagttagagaaagactttaaaacaaagaatggaagatatgatattagtaaaatccctgacatatatgactgtataaaatatgatgtccagcataatggttccttgaaattagaaaacacaatggaattatataggctttcgaaggcattagcagatattgttatccctcaggaatatggtataactaaagctgaaaaactggagattgccaaaggctactgtactcctctggttagaaaaattcgctcagaccttcagaggacacaagatgatgacactgtaaataaacttcatcctgtgtattctagaggtgttctgtctcctgaacgtcatgttcgtactagattatattttaccagtgaaagtcatgtacattctttgctgtctattcttcgctatggtgccttatgcaatgaatcaaaggatgaacagtggaaacgagctatggattatttaaacgttgtcaatgagctcaactacatgactcagattgttatcatgctttatgaggatcctaataaggatctttcctcagaagaacgctttcatgttgaattacactttagtccgggagccaaaggttgtgaagaagacaaaaatttgccatctggctatggatatagaccagcttccagagagaatgaaggcaggagaccttttaaaattgataatgatgatgaaccacatacttctaaaagagatgaagttgatcgagctgtgatattgtttaaaccaatggtatcagagccaattcatatacacaggaagtctccacttccaagatctaggaagacggctacaaatgatgaagagagccccctgagtgtgtctagcccagagggtactggtacctggctgcattataccagtggtgtgggtactgggcgtcgaagacgcagatcaggggaacaaatcacttcttcccctgtctcccccaaatcattggctttcacatccagtatttttggctcatggcaacaggttgtatctgaaaatgctaattacctgagaacaccaagaactcttgtggaacagaagcagaatcctactgtagggtctcactgtgcgggcctgtttagcacctcggtgctcgggggttcttcaagcgcacctaacctacaggattatgctcgtactcatcgtaaaaagctgacctcttctggctgcatagatggctttgaattgtattccatggtgccatctatttgtcctctagaaactcttcataatgccctatctttaaagcaagtggatgaatttcttgcttccattgcttctccatcatctgacgttccacggaagaccgctgaaatttcctctacagctttacgttccagtccaataatgagaaaaaaagtatctttaaatacgtatacacctgcaaagatcctcccaacaccaccagctaccttaaagagcactaaagcaagcagcaaaccagctacaagtggaccttctagtgcagttgttcctaatacctcatctcggaaaaagaatataactagcaaaacagaaacgcatgaacacaaaaaaaacactgggaaaaagaaatgaaatcttagcagaagctggaactttttatacttataaaaatagtatgttcttatgtttctccttatgcatttatgtgttcacttaaaaatgtttttaaatctaaggttttctttgtttatgttcaggtaaggaactgttgtcatgatctggaaatgtttaaaacaatgtttgttagcattctgtgagcagcaaaacttatagtgataaaaatcgattgttgttaatatgatgtttaccatgtgcacatagtaatgaaaaggaacataaaagcccagcaggctcgtaccaaagtcacagcagtaatgctatgtactgcagagtctgatgagctggcctttgtgcacacttttattttcatgggattgcatcttagctgttaaaacttctagattgaaatttgacagccagggttacatattggggacttttaaagtgtctttccaaagagatttcattaaccgtttagattagaatatctttcccaattgttacagtgacatatatgctgcaatatttaacaactggagtattagccacatgggttattttttcaatctgtgttttgaatttttttattgtgtgttatttaaaatattacatatgcagctgggagaactacacctttgtgcacatagatttatatattaatttgtagaaaatattttctttatatatttccttaccatacaaggtgccttgttcatcaggaaaacttttgttttgtattttgacaagaaaggcaccttcagagtttctttttaagtatagttgacaagtgtataaatgttacacttactttcagagttctttttagatctaaagaagtcagttcaaaaatggaaatcaacaatgttaggagaaatctgaattctgttaagttagtaagtattatgtatagcatctgtttttaaccatttccattcttatccctagtgtatcagttgatcacactaagaaagcttaaagattgagcatttgaaataaatgctctttataaatgattagatttttgaagggatattgaaatcattgcgctgtgatttcatctgtgatgtgaaaaatcaatttattatccttggtgctttcccccccaccaatgcacaaataattgtgaacagcttgaaatgacttaaactgtaatccaaatgggacaatctgataagaatttcatgcattggtagttaaataacttaaattgctaaagctttagcttgaaatttatgtttagaaaaactattgatttcccatggtatgaatataactattgtaattcttcaaatgagactcttctcaccttaaatagtcatatattaattaacttataggaaataagcatactatatgttagctgttttaaaaggtaccagatgtaagagtcataaatatatgcaattaaagaagttcatagatttcacatgaatgtaaatgtgttatatggagacatgtcttgtaaacagttgaatgtatgtaagttttctgtttgtgaaaatgtagttaatgtactcactgtggaggtcataaggaagctactttttttttaaagtggaacctaattaaaatatttccagaatc

SEQ ID NO: 8457 - DNA, 5918 bp, Homo sapiens
gagggcggggaagaggcgtgacggagattcctgaggtgtagtagcctgaggttcccttatgtggccctatagctgttactgaaggaagtagcctacgtccacgcctacaactgaagtctcttgacaaacacctcacccctgcctccgggatgaaagggggtaacctagacctgaatgggcttgaccatctcacaactgctcgcgtgacgaccgcattcgtggcaggtaagaagattgctgtatcaactcaagaaagcagtaacttcactgtctttgtattttgaattgcaacaacaactttgatatcaacaatgaagcaatgatatctaagaacaaaagagtatttgccaacagtcatcataatatcaagtgattgtataagcagaaacaagctgtcacagacctgtgcgtcagctaatatatggagaatgctttcttctgatactatttacttagaggcagttttaatataaatcatttcaattatatctacatcaaataaaataaaaatgagtgaagcccccagattcttcgttggaccagaagatacagaaataaatcctggaaattatcgacatttcttccaccatgcagatgaagacgatgaggaggaagatgattctccaccagaaaggcagattgtggttggaatatgttccatggcaaagaaatccaaatccaaaccaatgaaggaaattcttgaacggatctccttatttaaatatatcacagtagtagtatttgaagaggaggttattttgaatgaaccagtggaaaactggcctttatgtgattgtcttatttctttccattctaaaggatttccactggacaaagcggttgcctatgcaaaactcaggaatccatttgtaatcaatgacttgaatatgcagtatctcatacaagataggagagaagtatatagtattcttcaagctgaaggtattttacttcctcgttatgctattttgaaccgtgacccaaataatcccaaagaatgtaatctgattgaaggggaagatcatgtagaagtaaatggggaagtttttcaaaagccatttgtagaaaagccagtcagtgcagaagatcacaatgtttacatttattacccaacttctgctggtggtggaagtcaaagactctttagaaagattggcagtagaagtagtgtttattctccagaaagcaatgtacgaaaaacaggctcatatatatatgaagagtttatgcccacagatggtactgatgttaaggtttatacagtgggtccagattatgcccatgctgaagctcgaaaatctccagcacttgatggcaaggtggaacgagacagtgaaggaaaagaagtaagataccctgttattctcaatgcacgagagaaattaattgcttggaaagtctgccttgcttttaagcaaacagtttgtggctttgatttgttacgggccaatggacagtcctatgtctgtgatgtcaatggcttcagttttgtgaaaaattccatgaagtattatgatgactgtgcaaaaatacttggaaatattgtaatgcgagaacttgctccacaatttcatattccatggtcaatacccttagaagctgaagatatcccaattgtaccaactacatctggaactatgatggaacttagatgtgtcatagctgttatacgtcatggggatcgaacaccaaaacaaaaaatgaaaatggaagtgagacatcagaaattttttgatctttttgaaaagtgtgatggatataaatcagggaaattaaaactcaaaaaaccaaaacagttacaggaagtgctagatattgcacgacagcttcttatggagctagggcaaaataatgattctgaaattgaagaaaacaagccaaaacttgaacaacttaagactgtattagagatgtatggtcatttttctggaataaatcgtaaggttcagttgacctatctccctcatggttgtcctaaaacatctagtgaagaggaggacagccgaagagaagaaccatctttacttttggttctaaaatggggaggtgaattaactcctgcaggcagggtccaggctgaagaacttggaagagccttcaggtgtatgtatcctggaggtcaaggagattatgcaggatttcctggttgtggtttacttagattacatagcacctacagacatgacctcaaaatatatgcctctgatgaaggacgagtccagatgactgcagctgcttttgcaaaggggcttttagctttggaaggagagcttacacccattcttgttcaaatggtgaaaagtgcaaatatgaacggtcttttggatagtgatagtgactctctgagcagttgtcagcaacgtgtgaaggcaaggcttcatgaaatacttcagaaagacagagattttactgctgaagattatgaaaagcttactccatctggaagcatttctcttatcaaatcaatgcatttaattaaaaaccctgtgaagacctgtgataaagtttattccttaattcagagtttgacttctcaaatcagacatcgaatggaagatcctaaatcatcagatattcagctttaccatagtgaaacattggagcttatgctacgtagatggtccaagttagagaaagactttaaaacaaagaatggaagatatgatattagtaaaatccctgacatatatgactgtataaaatatgatgtccagcataatggttccttgaaattagaaaacacaatggaattatataggctttcgaaggcattagcagatattgttatccctcaggaatatggtataactaaagctgaaaaactggagattgccaaaggctactgtactcctctggttagaaaaattcgctcagaccttcagaggacacaagatgatgacactgtaaataaacttcatcctgtgtattctagaggtgttctgtctcctgaacgtcatgttcgtactagattatattttaccagtgaaagtcatgtacattctttgctgtctattcttcgctatggtgccttatgcaatgaccatgattctcagaatgaagatggaggaatggtgaaggagatggaatcaaaggatgaacagtggaaacgagctatggattatttaaacgttgtcaatgagctcaactacatgactcagattgttatcatgctttatgaggatcctaataaggatctttcctcagaagaacgctttcatgttgaattacactttagtccgggagccaaaggttgtgaagaagacaaaaatttgccatctggctatggatatagaccagcttccagagagaatgaaggcaggagaccttttaaaattgataatgatgatgaaccacatacttctaaaagagatgaagttgatcgagctgtgatattgtttaaaccaatggtatcagagccaattcatatacacaggaagtctccacttccaagatctaggaagacggctacaaatgatgaagagagccccctgagtgtgtctagcccagagggtactggtacctggctgcattataccagtggtgtgggtactgggcgtcgaagacgcagatcaggggaacaaatcacttcttcccctgtctcccccaaatcattggctttcacatccagtatttttggctcatggcaacaggttgtatctgaaaatgctaattacctgagaacaccaagaactcttgtggaacagaagcagaatcctactgtagggtctcactgtgcgggcctgtttagcacctcggtgctcgggggttcttcaagcgcacctaacctacaggattatgctcgtactcatcgtaaaaagctgacctcttctggctgcatagatgacgccacacgcggttctgctgttaaaaggttttctatctcatttgctcgacacccaaccaatgaacacctacacctctataggtgctggtccgtttcctctgtggaatttctaggctccagtggctttgaattgtattccatggtgccatctatttgtcctctagaaactcttcataatgccctatctttaaagcaagtggatgaatttcttgcttccattgcttctccatcatctgacgttccacggaagaccgctgaaatttcctctacagctttacgttccagtccaataatgagaaaaaaagtatctttaaatacgtatacacctgcaaagatcctcccaacaccaccagctaccttaaagagcactaaagcaagcagcaaaccagctacaagtggaccttctagtgcagttgttcctaatacctcatctcggaaaaagaatataactagcaaaacagaaacgcatgaacacaaaaaaaacactgggaaaaagaaatgaaatcttagcagaagctggaactttttatacttataaaaatagtatgttcttatgtttctccttatgcatttatgtgttcacttaaaaatgtttttaaatctaaggttttctttgtttatgttcaggtaaggaactgttgtcatgatctggaaatgtttaaaacaatgtttgttagcattctgtgagcagcaaaacttatagtgataaaaatcgattgttgttaatatgatgtttaccatgtgcacatagtaatgaaaaggaacataaaagcccagcaggctcgtaccaaagtcacagcagtaatgctatgtactgcagagtctgatgagctggcctttgtgcacacttttattttcatgggattgcatcttagctgttaaaacttctagattgaaatttgacagccagggttacatattggggacttttaaagtgtctttccaaagagatttcattaaccgtttagattagaatatctttcccaattgttacagtgacatatatgctgcaatatttaacaactggagtattagccacatgggttattttttcaatctgtgttttgaatttttttattgtgtgttatttaaaatattacatatgcagctgggagaactacacctttgtgcacatagatttatatattaatttgtagaaaatattttctttatatatttccttaccatacaaggtgccttgttcatcaggaaaacttttgttttgtattttgacaagaaaggcaccttcagagtttctttttaagtatagttgacaagtgtataaatgttacacttactttcagagttctttttagatctaaagaagtcagttcaaaaatggaaatcaacaatgttaggagaaatctgaattctgttaagttagtaagtattatgtatagcatctgtttttaaccatttccattcttatccctagtgtatcagttgatcacactaagaaagcttaaagattgagcatttgaaataaatgctctttataaatgattagatttttgaagggatattgaaatcattgcgctgtgatttcatctgtgatgtgaaaaatcaatttattatccttggtgctttcccccccaccaatgcacaaataattgtgaacagcttgaaatgacttaaactgtaatccaaatgggacaatctgataagaatttcatgcattggtagttaaataacttaaattgctaaagctttagcttgaaatttatgtttagaaaaactattgatttcccatggtatgaatataactattgtaattcttcaaatgagactcttctcaccttaaatagtcatatattaattaacttataggaaataagcatactatatgttagctgttttaaaaggtaccagatgtaagagtcataaatatatgcaattaaagaagttcatagatttcacatgaatgtaaatgtgttatatggagacatgtcttgtaaacagttgaatgtatgtaagttttctgtttgtgaaaatgtagttaatgtactcactgtggaggtcataaggaagctactttttttttaaagtggaacctaattaaaatatttccagaatc

SEQ ID NO: 8458 - DNA, 505 bp, Homo sapiens
tttagagggcagtcctttggggaaccttggaaccacggtcagaaaggtaagaagattgctgtatcaactcaagaaagcagtaacttcactgtctttgtattttgaattgcaacaacaactttgatatcaacaatgaagcaatgatatctaagaacaaaagagtatttgccaacagtcatcataatatcaagtgattgtataagcagaaacaagctgtcacagacctgtgcgtcagctaatatatggagaatgctttcttctgatactatttacttagaggcagttttaatataaatcatttcaattatatctacatcaaataaaataaaaatgagtgaagcccccagattcttcgttggaccagaagatacagaaataaatcctggaaattatcgacatttcttccaccatgcagatgaagacgatgaggaggaagatgattctccaccagaaaggcagattgtggttggaatatgttccatggcaaagaaatccaaatccaaac

SEQ ID NO: 8459 - DNA, 7371 bp, Homo sapiens
ggaatggaaagggaagaacctccggggttaggcgtattctagattgacgccttttgctggaagagcgctgctggggttaggattctgcgcggcgaggcaagatgctcaagtccaagacgttcttaaaaaagacccgggcgggcggcgtgatgaagatcgtgcgcgagcactacctgcgagacgacatcggctgcggtgcgcccgggtgcgcagcgtgtggaggggcgcacgaggggccggccctggagccgcagccccaggacccggcgagcagcgtctgcccgcaaccgcactacttgctgcccgacactaatgtgttactgcaccagattgatgttcttgaggaccctgccatcaggaatgtaattgtgctacaaacagttcttcaagaagtgagaaatcgcagtgcccccgtatataaacgcatccgagatgtgactaataaccaagagaagcatttctatactttcactaatgagcaccatagagaaacctatgtagaacaagaacagggagaaaatgctaatgacaggaatgatagagcgattcgagtagcagcaaaatggtacaatgaacatttgaaaaaaatgtcagcagacaaccagctgcaagttatcttcataacaaatgacaggagaaacaaagagaaagccatagaagaaggaataccagctttcacttgtgaagaatatgtaaagagcctaactgctaaccccgaactcatagatcgtcttgcttgtttgtctgaagaagggaatgaaatagaaagtggaaaaataatattttcagagcatcttcccttaagtaagctacagcaaggcataaaatctggtacataccttcaaggaacatttagagctagcagggaaaattacttggaagctacagtatggattcatggcgacaatgaagaaaataaagagataatcttacagggacttaaacatttaaacagagctgttcacgaagatattgtggctgtggagcttctccccaagagtcagtgggtagcaccatcttctgtggttttacatgatgaaggtcaaaatgaagaagatgtggagaaagaagaagagacagaacgaatgcttaagactgctgtaagcgagaaaatgttgaagcctacaggtagagttgtaggaataataaaaaggaattggagaccatattgtggcatgctttccaagtctgacattaaggagtcaagaagacatctctttacacctgctgataagagaatccctcgaattcgcatagaaaccagacaggcttccacattagaaggacggagaattattgttgctattgatggttggcccagaaattccagatatccaaatggacactttgtgagaaatttaggtgatgttggagagaaagagactgaaacagaagttttgttacttgaacacgatgttccccatcagcctttttcacaggctgttcttagttttctgccaaagatgccctggagcattactgaaaaggacatgaaaaaccgagaagacctgaggcatctgtgtatttgtagtgtagacccaccaggatgtactgatatagacgatgctctacattgtcgagaactcgaaaatggaaatttggaggttggtgttcatattgctgatgtgagccattttattaggccaggaaatgccttggatcaagaatcagccagaagaggaacaactgtgtatctttgtgaaaagaggattgacatggttccagagttgcttagctctaacttgtgttccttaaaatgtgacgtggacaggctggcattttcatgtatttgggaaatgaatcacaatgctgaaatcttaaaaacgaagtttaccaaaagtgttattaattcaaaggcatctctgacgtatgctgaagctcagttgagaattgattcagcaaacatgaatgatgatattaccactagtctccgtggactgaataaactagccaaaattctgaagaaaagaaggattgaaaaaggggctttgactctatcctctcctgaagttcgattccacatggacagtgaaactcacgatcctatagatctgcagaccaaggaacttagggaaacaaattccatggttgaagaatttatgttacttgccaatatttctgttgcaaaaaaaattcatgaggaattttctgaacatgctctgcttcgaaaacatcctgctccacctccatcaaattatgaaattcttgttaaggcagccaggtcaaggaatttggaaattaagactgatacagccaagtctttggctgagtctttggatcaggccgaatctcctacttttccatatctaaacactctgttgagaatattagccactcgctgtatgatgcaagctgtgtacttctgttctggaatggataatgattttcatcactatggcttagcgtctccaatatacacacattttacttcacccattagaagatacgcagatgtcattgttcatcggcttttggctgtggctattggggctgactgtacttatccagagttgacagacaaacacaagcttgcagatatatgtaaaaatctaaatttccggcacaaaatggctcaatatgcccaacgtgcatcagtggcttttcatacccagttattcttcaaaagcaaaggaatagtaagtgaagaagcctatattttatttgtaagaaagaatgccattgtggtattaattccaaagtatggtttagaagggacagtcttttttgaagaaaaggacaaaccaaacccacagcttatttatgatgatgagataccctcacttaaaatagaagatacagtgttccatgtatttgataaagttaaagtgaaaatcatgttagactcatctaatcttcaacatcagaagatccgaatgtccctggtagaaccacagataccaggaataagcattcctactgatacttcaaacatggaccttaatggaccaaagaaaaagaagatgaagcttggaaaatagctatattcaacaaaaatcttcaaagactggtttcttttttaaaagaaaaaacttgaaagaacacttctaagcctaagtgtgtgatacagtttgttacttttaagtacattttaataatttcagacatctgcatttttattgaacagttgactgtatctgacccatcatactactatacttctgggttgaacagaattatttatgcagaataattcaattgaatatccatcacttaaatacagtgacaggacagcaacttcagggatctgtaaagatcatttaaatggagtgctcatctcattgaggagcagattaattttgcgtaagtactttgattatttaatatttgtaagaaaaaactttcattttcctacagaggaaaatagaacaattttagaagcaaggaacaatctcttttctaagtcttggaagctgtcagtgttgaggatgtaatctcctttgccatctttaattcacctaacttacactaggtgttctcttactgtctttaaaagcttcctgtattttattagtggtccttgaaaaactgtgaatgtttgggaattggtagaaaggcaaaaagtaggatattttgacctgactggaaagatggttgtgtttttattgccaggtaataagtgtgatcattgttgaacttcagctccagtgtctctccagaataagacattggcattcaaatgtctatatcttgttacttacaaaataaaaaacagattaattagtggcttttaaattgtagttatatcagtgtatatacacgaggggaactgtataaagacatactaaagggaacagattaaaataagtattattaataaaatttggtgtgccagactgactacttcccttgctaatcacagagattagtaatgattaaattaatatcttcaggaatattttgggatagggttgccttaaaacattttacttggcttattcaatttctaaagcacttacgttgtgccaggttccactcaagtaaattatctctgccttcaaggagcttgcagtatagtgagaaaagcctgccaagtaaatcagcaggtatactaaataggtagtcatttaggcactcaataaatgttgactaatttttccagtttcctattactgaggaaaacctccatacactgaggcagaaacttgtgtcagttggaggaaaatagacttgagtagtctttggtccaggtaaaatgggtcagtgacactgaaacagtagagtaggagtcaaaaaaccttttctgtgaagtgctagaacattttagactttgttggctatggtctgtattgcaactatagtacacaactctgccgttgatagtgtgtaaggagccatatacaatatgtaaacaaatcaacatgactgtgtttcaacaaggcctgatttgttaagtttcatatatagtcatatgtcacttaatgacagggatatgttctgagacatgtcacttggcaatttcatcattgtgtgaaaatcatgatgtagttacacaaacctagatggtataccctatggtatcctatatgggatagcctattgctcctaacctacaaacctgtatggcatattactgtactgattactgtaggcggttgtaacacagtgctaagtatttgtgtatctaaacatatctaaacatagaaaaggtacagtaaaaatatatatatagatatatataagatataaaatggtacacctatttaggacatttaccatgaacaagttggcaggactggaagctggctctgggtgagtcagtaagtggttagtgaatgtgaaggccatgatattactgtgcactactgtagacttttataaacactatatacttaggctacataaagtaatttcactatgatgttaccatggctgtgtccccaggcaataggaatttttcagctccattgtaatcttacgggatcatcatcgtatatttggccattgttgaccaaaagttatgcagcacatcattataattttgatgtgtcacaaaacattactcatttgatttcccccacccccgccaaccatttaaaaaagtttgccggctaggtgcggtggctcatgcctgtaatcctagcattttgggaggacgaggcgggtggatcactcgatgtcaggagtttgagaccagcctggccaacatggtaaaacgccgtctctactaaaaatacaaaaacttagctgggtgtaacggcggatgcctgtaatcccagctacttgggaggctgaggcaggagaatcgcttgaacctgggaggcggaagttgcagtgagccgagattgcaccactgcagttcagcctggatgatgagagtgagactccatcgcaaaaaaaaaaaaaaaaaaagaaaagaaaattagccaggtgtggtggcaagtgcctttaatcccacctcaggaggctgaggcaggagaatcgcttgaacctgggaggcagaggttgcagtgagccaagatcgcgccactgcactccagcctgggtgacagaacaagactgtctcaaaaaaaaaaaaagagaagaaaaactgcctacaggccatagttaacctgcaatagagaagaaagggaagtagggcagtgcatgactggccttaggttttttctttccaagtttattttcttgtgcttcagctactagaaaggtttaattcagggataagtcccaattgagtagttcaagatgatcagagactttgctattttcccctaagttctattccataatctaaaatgttctgtttctagtgccagttcttatgctaagcaggttacgtggaatatatcacttaactcaaaaagccctgttaagccaggactgttatctccatttaacagatgagaaaatggaggtttatggtctgttctcacactgctacgaagaaataccccaaactgggtaattattataaaggaaagaggtttaatggactcagttccgcattgctggtgaggcctcaggacacttacacaatcatggcagaaaaaggagaagcaggcacctttttcacagggcggcaggatgaaaatgactgccagcagtggaaatgccagacgcttataaaaccttcagatctcatgagaccggctcactatcacaggaacagcatggaggaaaccgcccccatgatccagttacctccacctggtcccacccttgacacgtggggattgctacaattcaaggttagatttgggtgaggacacagagccataccatatcagcccagatcaagtagtgacagagtagggatttgaatacaggttatagtcactattgtgttatttcttgacttttgtactattaaaaaactgtagccagtgaggcttctacccttagtacccagaactccttttaggtatagcaattgtttttaggtaaatttatattgagtttaacacctgtgtgattaaagacaactttccaatgtagtatctgtagccatgtcccctaatggctattagtgttcatggttagtgtgttgaagatgagccaggtacataacgcggcacattttctgcaggtcagcagtaaggtttcaaggtacagttatggaggaaagaagaaaatgacacattgataacacaggtctttattcccttttgaatgagacagtttttaaaagttgatttataaatacaaaaatacattctccaaagatagtatttccaaactgttatatacccatctactcccaacatggatataagttttttaaaaaaatagttgtatataacatacatatctgccccagtgttacttcacaggcctatgccctacgggaactccactctcccagccccactttttctcttggttctcccacattcttattctcccacatccctacccacgtttgagctggaaaggatgtccctaccctaggcatgaggtatattttattctgggcaccacacatttgccccatagataacaatacacgtgatgatgtcactagtactacctttctagtatttacatacttaaaagtagtaactagaacagttatcactggaactaagaattttccccacagaggtgaacagaccaagaactaaaatttcaggaaacctgtttaatttcttttgtatctttgaaaagttagttttatatctaagatttcttcacataggttataattcatctgtatgttcaagcttttatgtaaaaatatatagtgccttcagttttaacatagtttcacatgttctcagaactgctaaattcagtgctaccagtaaggcttaataagtagttcattgaccctgtaagataggagcactcagctctgtcacaatttgttgttaaacacatcactcaatgtaagtataaaaatatttattgataaaaaataaacttataattcagcaa

SEQ ID NO: 8460 - DNA, 3651 bp, Homo sapiens
gtgaggtggcgtccagaaggaagccccgcctaggccacgggcggaaatggctcctcgccttgctttgccgcccctccccactctcgcccaatccccgcggccgtcagagagccaaccaatgtttatctcggcattttcccgcgagaagtgttactaatatccgggaatggaaagggaagaacctccggggttaggcgtattctagattgacgccttttgctggaagagcgctgctggggttaggattctgcgcggcgaggcaagatgctcaagtccaagacgttcttaaaaaagacccgggcgggcggcgtgatgaagatcgtgcgcgagcactacctgcgagacgacatcggctgcggtgcgcccgggtgcgcagcgtgtggaggggcgcacgaggggccggccctggagccgcagccccaggacccggcgagcagcgtctgcccgcaaccgcactacttgctgcccgacactaatgtgttactgcaccagattgtaagtgcctggaggccggggacctgggcttctgtggcctccagcctgcgactcccaggcagcttattgatgttcttgaggaccctgccatcaggaatgtaattgtgctacaaacagttcttcaagaagtgagaaatcgcagtgcccccgtatataaacgcatccgagatgtgactaataaccaagagaagcatttctatactttcactaatgagcaccatagagaaacctatgtagaacaagaacagggagaaaatgctaatgacaggaatgatagagcgattcgagtagcagcaaaatggtacaatgaacatttgaaaaaaatgtcagcagacaaccagctgcaagttatcttcataacaaatgacaggagaaacaaagagaaagccatagaagaaggaataccagctttcacttgtgaagaatatgtaaagagcctaactgctaaccccgaactcatagatcgtcttgcttgtttgtctgaagaagggaatgaaatagaaagtggaaaaataatattttcagagcatcttcccttaagtaagctacagcaaggcataaaatctggtacataccttcaaggaacatttagagctagcagggaaaattacttggaagctacagtatggattcatggcgacaatgaagaaaataaagagataatcttacagggacttaaacatttaaacagagctgttcacgaagatattgtggctgtggagcttctccccaagagtcagtgggtagcaccatcttctgtggttttacatgatgaaggtcaaaatgaagaagatgtggagaaagaagaagagacagaacgaatgcttaagactgctgtaagcgagaaaatgttgaagcctacaggtagagttgtaggaataataaaaaggaattggagaccatattgtggcatgctttccaagtctgacattaaggagtcaagaagacatctctttacacctgctgataagagaatccctcgaattcgcatagaaaccagacaggcttccacattagaaggacggagaattattgttgctattgatggttggcccagaaattccagatatccaaatggacactttgtgagaaatttaggtgatgttggagagaaagagactgaaacagaagttttgttacttgaacacgatgttccccatcagcctttttcacaggctgttcttagttttctgccaaagatgccctggagcattactgaaaaggacatgaaaaaccgagaagacctgaggcatctgtgtatttgtagtgtagacccaccaggatgtactgatatagacgatgctctacattgtcgagaactcgaaaatggaaatttggaggttggtgttcatattgctgatgtgagccattttattaggccaggaaatgccttggatcaagaatcagccagaagaggaacaactgtgtatctttgtgaaaagaggattgacatggttccagagttgcttagctctaacttgtgttccttaaaatgtgacgtggacaggctggcattttcatgtatttgggaaatgaatcacaatgctgaaatcttaaaaacgaagtttaccaaaagtgttattaattcaaaggcatctctgacgtatgctgaagctcagttgagaattgattcagcaaacatgaatgatgatattaccactagtctccgtggactgaataaactagccaaaattctgaagaaaagaaggattgaaaaaggggctttgactctatcctctcctgaagttcgattccacatggacagtgaaactcacgatcctatagatctgcagaccaaggaacttagggaaacaaattccatggttgaagaatttatgttacttgccaatatttctgttgcaaaaaaaattcatgaggaattttctgaacatgctctgcttcgaaaacatcctgctccacctccatcaaattatgaaattcttgttaaggcagccaggtcaaggaatttggaaattaagactgatacagccaagtctttggctgagtctttggatcaggccgaatctcctacttttccatatctaaacactctgttgagaatattagccactcgctgtatgatgcaagctgtgtacttctgttctggaatggataatgattttcatcactatggcttagcgtctccaatatacacacattttacttcacccattagaagatacgcagatgtcattgttcatcggcttttggctgtggctattggggctgactgtacttatccagagttgacagacaaacacaagcttgcagatatatgtaaaaatctaaatttccggcacaaaatggctcaatatgcccaacgtgcatcagtggcttttcatacccagttattcttcaaaagcaaaggaatagtaagtgaagaagcctatattttatttgtaagaaagaatgccattgtggtattaattccaaagtatggtttagaagggacagtcttttttgaagaaaaggacaaaccaaacccacagcttatttatgatgatgagataccctcacttaaaatagaagatacagtgttccatgtatttgataaagttaaagtgaaaatcatgttagactcatctaatcttcaacatcagaagatccgaatgtccctggtagaaccacagataccaggaataagcattcctactgatacttcaaacatggaccttaatggaccaaagaaaaagaagatgaagcttggaaaatagctatattcaacaaaaatcttcaaagactggtttcttttttaaaagaaaaaacttgaaagaacacttctaagcctaagtgtgtgatacagtttgttacttttaagtacattttaataatttcagacatctgcatttttattgaacagttgactgtatctgacccatcatactactatacttctgggttgaacagaattatttatgcagaataattcaattgaatatccatcacttaaatacagtgacaggacagcaacttcagggatctgtaaagatcatttaaatggagtgctcatctcattgaggagcagattaattttgcgtaataagtgtgatcattgttgaacttcagctccagtgtctctccagaataagacattggcattcaaatgtctatatcttgttacttacaaaataaaaaacagattaattagtggctttt

SEQ ID NO: 8461 - DNA, 5232 bp, Homo sapiens
aagggaagaacctccggggttaggcgtattctagattgacgccttttgctggaagagcgctgctggggttaggattctgcgcggcgaggcaagatgctcaagtccaagacgttcttaaaaaagacccgggcgggcggcgtgatgaagatcgtgcgcgagcactacctgcgagacgacatcggctgcggtgcgcccgggtgcgcagcgtgtggaggggcgcacgaggggccggccctggagccgcagccccaggacccggcgagcagcgtctgcccgcaaccgcactacttgctgcccgacactaatgtgttactgcaccagattgtaagtgcctggaggccggggacctgggcttctgtggcctccagcctgcgactcccaggcagcttagaaacctatgtagaacaagaacagggagaaaatgctaatgacaggaatgatagagcgattcgagtagcagcaaaatggtacaatgaacatttgaaaaaaatgtcagcagacaaccagctgcaagttatcttcataacaaatgacaggagaaacaaagagaaagccatagaagaaggaataccagctttcacttgtgaagaatatgtaaagagcctaactgctaaccccgaactcatagatcgtcttgcttgtttgtctgaagaagggaatgaaatagaaagtggaaaaataatattttcagagcatcttcccttaagtaagctacagcaaggcataaaatctggtacataccttcaaggaacatttagagctagcagggaaaattacttggaagctacagtatggattcatggcgacaatgaagaaaataaagagataatcttacagggacttaaacatttaaacagagctgttcacgaagatattgtggctgtggagcttctccccaagagtcagtgggtagcaccatcttctgtggttttacatgatgaaggtcaaaatgaagaagatgtggagaaagaagaagagacagaacgaatgcttaagactgctgtaagcgagaaaatgttgaagcctacaggtagagttgtaggaataataaaaaggaattggagaccatattgtggcatgctttccaagtctgacattaaggagtcaagaagacatctctttacacctgctgataagagaatccctcgaattcgcatagaaaccagacaggcttccacattagaaggacggagaattattgttgctattgatggttggcccagaaattccagatatccaaatggacactttgtgagaaatttaggtgatgttggagagaaagagactgaaacagaagttttgttacttgaacacgatgttccccatcagcctttttcacaggctgttcttagttttctgccaaagatgccctggagcattactgaaaaggacatgaaaaaccgagaagacctgaggcatctgtgtatttgtagtgtagacccaccaggatgtactgatatagacgatgctctacattgtcgagaactcgaaaatggaaatttggaggttggtgttcatattgctgatgtgagccattttattaggccaggaaatgccttggatcaagaatcagccagaagaggaacaactgtgtatctttgtgaaaagaggattgacatggttccagagttgcttagctctaacttgtgttccttaaaatgtgacgtggacaggctggcattttcatgtatttgggaaatgaatcacaatgctgaaatcttaaaaacgaagtttaccaaaagtgttattaattcaaaggcatctctgacgtatgctgaagctcagttgagaattgattcagcaaacatgaatgatgatattaccactagtctccgtggactgaataaactagccaaaattctgaagaaaagaaggattgaaaaaggggctttgactctatcctctcctgaagttcgattccacatggacagtgaaactcacgatcctatagatctgcagaccaaggaacttagggaaacaaattccatggttgaagaatttatgttacttgccaatatttctgttgcaaaaaaaattcatgaggaattttctgaacatgctctgcttcgaaaacatcctgctccacctccatcaaattatgaaattcttgttaaggcagccaggtcaaggaatttggaaattaagactgatacagccaagtctttggctgagtctttggatcaggccgaatctcctacttttccatatctaaacactctgttgagaatattagccactcgctgtatgatgcaagctgtgtacttctgttctggaatggataatgattttcatcactatggcttagcgtctccaatatacacacattttacttcacccattagaagatacgcagatgtcattgttcatcggcttttggctgtggctattggggctgactgtacttatccagagttgacagacaaacacaagcttgcagatatatgtaaaaatctaaatttccggcacaaaatggctcaatatgcccaacgtgcatcagtggcttttcatacccagttattcttcaaaagcaaaggaatagtaagtgaagaagcctatattttatttgtaagaaagaatgccattgtggtattaattccaaagtatggtttagaagggacagtcttttttgaagaaaaggacaaaccaaacccacagcttatttatgatgatgagataccctcacttaaaatagaagatacagtgttccatgtatttgataaagttaaagtgaaaatcatgttagactcatctaatcttcaacatcagaagatccgaatgtccctggtagaaccacagataccaggaataagcattcctactgatacttcaaacatggaccttaatggaccaaagaaaaagaagatgaagcttggaaaatagctatattcaacaaaaatcttcaaagactggtttcttttttaaaagaaaaaacttgaaagaacacttctaagcctaagtgtgtgatacagtttgttacttttaagtacattttaataatttcagacatctgcatttttattgaacagttgactgtatctgacccatcatactactatacttctgggttgaacagaattatttatgcagaataattcaattgaatatccatcacttaaatacagtgacaggacagcaacttcagggatctgtaaagatcatttaaatggagtgctcatctcattgaggagcagattaattttgcgtaagtactttgattatttaatatttgtaagaaaaaactttcattttcctacagaggaaaatagaacaattttagaagcaaggaacaatctcttttctaagtcttggaagctgtcagtgttgaggatgtaatctcctttgccatctttaattcacctaacttacactaggtgttctcttactgtctttaaaagcttcctgtattttattagtggtccttgaaaaactgtgaatgtttgggaattggtagaaaggcaaaaagtaggatattttgacctgactggaaagatggttgtgtttttattgccaggtaataagtgtgatcattgttgaacttcagctccagtgtctctccagaataagacattggcattcaaatgtctatatcttgttacttacaaaataaaaaacagattaattagtggcttttaaattgtagttatatcagtgtatatacacgaggggaactgtataaagacatactaaagggaacagattaaaataagtattattaataaaatttggtgtgccagactgactacttcccttgctaatcacagagattagtaatgattaaattaatatcttcaggaatattttgggatagggttgccttaaaacattttacttggcttattcaatttctaaagcacttacgttgtgccaggttccactcaagtaaattatctctgccttcaaggagcttgcagtatagtgagaaaagcctgccaagtaaatcagcaggtatactaaataggtagtcatttaggcactcaataaatgttgactaatttttccagtttcctattactgaggaaaacctccatacactgaggcagaaacttgtgtcagttggaggaaaatagacttgagtagtctttggtccaggtaaaatgggtcagtgacactgaaacagtagagtaggagtcaaaaaaccttttctgtgaagtgctagaacattttagactttgttggctatggtctgtattgcaactatagtacacaactctgccgttgatagtgtgtaaggagccatatacaatatgtaaacaaatcaacatgactgtgtttcaacaaggcctgatttgttaagtttcatatatagtcatatgtcacttaatgacagggatatgttctgagacatgtcacttggcaatttcatcattgtgtgaaaatcatgatgtagttacacaaacctagatggtataccctatggtatcctatatgggatagcctattgctcctaacctacaaacctgtatggcatattactgtactgattactgtaggcggttgtaacacagtgctaagtatttgtgtatctaaacatatctaaacatagaaaaggtacagtaaaaatatatatatagatatatataagatataaaatggtacacctatttaggacatttaccatgaacaagttggcaggactggaagctggctctgggtgagtcagtaagtggttagtgaatgtgaaggccatgatattactgtgcactactgtagacttttataaacactatatacttaggctacataaagtaatttcactatgatgttaccatggctgtgtccccaggcaataggaatttttcagctccattgtaatcttacgggatcatcatcgtatatttggccattgttgaccaaaagttatgcagcacatcattataattttgatgtgtcacaaaacattactcatttgatttcccccacccccgccaaccatttaaaaaagtttgccggctaggtgcggtggctcatgcctgtaatcctagcattttgggaggacgaggcgggtggatcactcgatgtcaggagtttgagaccagcctggccaacatggtaaaacgccgtctctactaaaaatacaaaaacttagctgggtgtaacggcggatgcctgtaatcccagctacttgggaggctgaggcaggagaatcgcttgaacctgggaggcggaagttgcagtgagccgagattgcaccactgcagttcagcctggatgatgagagtgagactccatcgc

SEQ ID NO: 8462 - DNA, 3763 bp, Homo sapiens
attaattacccggtattagtattaatacggcggctccattcccacatggacctgggggggacaaacaaagtctcctaatcttggacagctgcgcccagcccttcttcacctgccgtccaggtatcatcctagtcttccctccgtctctgggatgggaaactcttgtctagtgatgtgactcattacgtgatcccagactggaaagttgttcaagattatcttgagatccttgagtttcctgagttgaagggaattattttcatgcagacagcttgtcaagctgtgcagcatcaaagaggcaggagacagtataacaaactgcgaaacctgctgaaggatgcgcgtcatgattgcattctctttgctaatgaattccagcaatgctgctatctgccacgggaaagaggagagtccatggagaagtggcagaccaggagcatatacaacgcagctgtttggtactatcatcactgccaggacaggatgccaattgttatggtgacagaagatgaagaggcaattcagcagtatggaagtgaaacagaaggagtattcgtgattactttcaagaattacctggacaatttctggcctgatttaaaagctgcccacgagctttgtgattctatccttcagtctcgacgggagagagagaatgagagtcaggagagccatgggaaggagtacccagaacatcttcccctggaagtgttagaagctgggattaaatctggacgctatatccagggaattctgaatgtcaacaaacacagagcccaaatagaagcttttgttcgacttcaaggagccagcagtaaagattcagatttagtcagtgacatcctaatccacgggatgaaggctcgaaaccgctcaattcatggagatgtggtagttgtggagctgcttcctaaaaatgaatggaaaggaagaaccgtagccctgtgtgagaatgactgtgacgacaaggcttcgggcgagtccccaagtgagcccatgcctacaggtcgagtggtgggcatacttcagaagaactggcgggattatgtggtgacatttccgtccaaagaagaggtccaatctcagggcaaaaatgctcagaaaatcctggttacaccttgggattacagaattcccaaaattcgaattagcactcagcaagcagaaaccctccaggacttcagggtggtcgtgcgcatcgattcctgggagtcaacatctgtgtatccaaatggacattttgtgcgtgttttaggaagaatcggagatctggaaggggaaattgcaaccatcctggtggaaaacagtatttcagttattcctttctcagaagctcagatgtgtgagatgccagtaaacacaccagaaagtccctggaaggtgagtcctgaagaggaacaaaaacgtaaagacttgaggaaaagccatctcgtattcagcattgaccccaaaggttgtgaagatgtggatgacacactctcagtcagaaccttaaataatggcaacctggaacttggggtccacatcgcagatgtaacacactttgtggcaccaaattcttacattgatattgaagctagaacaagggccaccacttattatctagcagatcgtcgctatgacatgctgccttccgtcctcagtgcagatttgtgttcccttctgggaggcgttgataggtatgctgtaagcatcatgtgggaactggataaagcctcttatgaaattaagaaagtgtggtatggcagaaccattattcgatcagcatacaaactgttctatgaagcagcccaagaactactggatggaaacttaagcgttgttgatgatattccagaattcaaagacttggatgagaagagcagacaagccaagctggaggagttggtgtgggcaattggaaagctgaccgacatagctcgccatgtcagagctaaacgagacggatgtggtgccctggaactggaaggggtagaggtttgcgtacagctagatgacaaaaagaacattcacgacctcatccccaagcagcccctggaagtccacgagacagtggctgaatgcatgatcctggccaaccactgggtcgccaaaaagatctgggagagcttccctcatcaggccttgctgcgccagcaccctcctccacaccaggagttcttttcagaactccgggaatgtgctaaagccaaaggcttcttcatagatacacggtccaataaaacactggctgattctctggataatgcgaacgacccccacgatcccattgtgaacaggctactgcgctccatggccacgcaggccatgtcgaatgctctgtacttctccaccggatcctgtgcggaggaggagttccatcattacggtcttgcattagataaatatacccactttacttctccaataagaagatattcagatattgtagtacaccgcttgttaatggcagccatttcaaaagataagaaaatggaaattaagggaaatctgttcagcaacaaagatcttgaggaattatgcagacatatcaacaacagaaaccaagcagcacagcattctcagaagcagtctactgagctcttccagtgcatgtacttcaaagacaaagaccctgccaccgaggagcgttgcatatctgacggagttatttattcaattagaacaaatggtgtgcttctatttataccaaggtttgggattaaaggtgctgcttatctaaaaaataaagatggtttagtcatctcatgtggcccagatagctgttctgaatggaaaccaggatcccttcaacgatttcaaaacaaaattacctctactacaacagatggggaatctgttacgttccatttgtttgaccatgtaaccgtaagaatatccatacaggcctcacgttgccattctgatacaatcagacttgaaataattagtaacaaaccatacaagataccaaatacagaacttattcatcagagttcccccttgctgaagagtgagttagtgaaagaagtaactaaatctgtggaagaagctcagcttgcccaagaagtcaaagtaaacatcattcaggaggaatatcaagaatatcgccaaacaaagggaaggagcctatacacacttctagaggagatacgggacctagctctcctggatgtttcaaacaattatggaatatgagaggctcttacttcactaagagctgtcatatgtgaatgttttacagtcttttcaaacttaacatttaatgtgtgtcactcagtgctctagtcgatcaggactgggtagctatttcgcatatatgtaaaatgttctcagccgggcacggtggctcacgcctgtaaccccagcactttgggaggctgaggcgggcggatcacgaggtcaggagattgagaccatcctggctaacacggtgaaacccagtctctactaaaaatacaaaaattagcccggcgtggtggcatgcgcctgtagtcccagctacttgggaggctgaagcaggagaattgcctgaacccaggaagaggaggttgcagtgagccgagatcgcaccactgcattccagcctgggcaacagagcgagactccatctcaaaaaaaaaaaaaaaaaaaaaaaaagttctctcattcattaaagttgcattaaataaagtataattaggtcactatggaaacagagttttcagtaatgagtggacagtaagtggtggctctgcagatggcccctttctaataagtttaataaacccgaaattactggtta

SEQ ID NO: 8463 - DNA, 3621 bp, Homo sapiens
gcggccgccgggagacacgccgccatgctgcagaagcgggagaaggtgctgctgctgaggaccttccagggccgcacgctgcggatcgtgcgcgagcactacctgcggccctgcgtgccctgccacagcccgctctgcccgcagcccgccgcctgcagccacgatgggaaactcttgtctagtgatgtgactcattacgtgatcccagactggaaagttgttcaagattatcttgagatccttgagtttcctgagttgaagggaattattttcatgcagacagcttgtcaagctgtgcagcatcaaagaggcaggagacagtataacaaactgcgaaacctgctgaaggatgcgcgtcatgattgcattctctttgctaatgaattccagcaatgctgctatctgccacgggaaagaggagagtccatggagaagtggcagaccaggagcatatacaacgcagctgtttggtactatcatcactgccaggacaggatgccaattgttatggtgacagaagatgaagaggcaattcagcagtatggaagtgaaacagaaggagtattcgtgattactttcaagaattacctggacaatttctggcctgatttaaaagctgcccacgagctttgtgattctatccttcagtctcgacgggagagagagaatgagagtcaggagagccatgggaaggagtacccagaacatcttcccctggaagtgttagaagctgggattaaatctggacgctatatccagggaattctgaatgtcaacaaacacagagcccaaatagaagcttttgttcgacttcaaggagccagcagtaaagattcagatttagtcagtgacatcctaatccacgggatgaaggctcgaaaccgctcaattcatggagatgtggtagttgtggagctgcttcctaaaaatgaatggaaaggaagaaccgtagccctgtgtgagaatgactgtgacgacaaggcttcgggcgagtccccaagtgagcccatgcctacaggtcgagtggtgggcatacttcagaagaactggcgggattatgtggtgacatttccgtccaaagaagaggtccaatctcagggcaaaaatgctcagaaaatcctggttacaccttgggattacagaattcccaaaattcgaattagcactcagcaagcagaaaccctccaggacttcagggtggtcgtgcgcatcgattcctgggagtcaacatctgtgtatccaaatggacattttgtgcgtgttttaggaagaatcggagatctggaaggggaaattgcaaccatcctggtggaaaacagtatttcagttattcctttctcagaagctcagatgtgtgagatgccagtaaacacaccagaaagtccctggaaggtgagtcctgaagaggaacaaaaacgtaaagacttgaggaaaagccatctcgtattcagcattgaccccaaaggttgtgaagatgtggatgacacactctcagtcagaaccttaaataatggcaacctggaacttggggtccacatcgcagatgtaacacactttgtggcaccaaattcttacattgatattgaagctagaacaagggccaccacttattatctagcagatcgtcgctatgacatgctgccttccgtcctcagtgcagatttgtgttcccttctgggaggcgttgataggtatgctgtaagcatcatgtgggaactggataaagcctcttatgaaattaagaaagtgtggtatggcagaaccattattcgatcagcatacaaactgttctatgaagcagcccaagaactactggatggaaacttaagcgttgttgatgatattccagaattcaaagacttggatgagaagagcagacaagccaagctggaggagttggtgtgggcaattggaaagctgaccgacatagctcgccatgtcagagctaaacgagacggatgtggtgccctggaactggaaggggtagaggtttgcgtacagctagatgacaaaaagaacattcacgacctcatccccaagcagcccctggaagtccacgagacagtggctgaatgcatgatcctggccaaccactgggtcgccaaaaagatctgggagagcttccctcatcaggccttgctgcgccagcaccctcctccacaccaggagttcttttcagaactccgggaatgtgctaaagccaaaggcttcttcatagatacacggtccaataaaacactggctgattctctggataatgcgaacgacccccacgatcccattgtgaacaggctactgcgctccatggccacgcaggccatgtcgaatgctctgtacttctccaccggatcctgtgcggaggaggagttccatcattacggtcttgcattagataaatatacccactttacttctccaataagaagatattcagatattgtagtacaccgcttgttaatggcagccatttcaaaagataagaaaatggaaattaagggaaatctgttcagcaacaaagatcttgaggaattatgcagacatatcaacaacagaaaccaagcagcacagcattctcagaagcagtctactgagctcttccagtgcatgtacttcaaagacaaagaccctgccaccgaggagcgttgcatatctgacggagttatttattcaattagaacaaatggtgtgcttctatttataccaaggtttgggattaaaggtgctgcttatctaaaaaataaagatggtttagtcatctcatgtggcccagatagctgttctgaatggaaaccaggatcccttcaacgatttcaaaacaaaattacctctactacaacagatggggaatctgttacgttccatttgtttgaccatgtaaccgtaagaatatccatacaggcctcacgttgccattctgatacaatcagacttgaaataattagtaacaaaccatacaagataccaaatacagaacttattcatcagagttcccccttgctgaagagtgagttagtgaaagaagtaactaaatctgtggaagaagctcagcttgcccaagaagtcaaagtaaacatcattcaggaggaatatcaagaatatcgccaaacaaagggaaggagcctatacacacttctagaggagatacgggacctagctctcctggatgtttcaaacaattatggaatatgagaggctcttacttcactaagagctgtcatatgtgaatgttttacagtcttttcaaacttaacatttaatgtgtgtcactcagtgctctagtcgatcaggactgggtagctatttcgcatatatgtaaaatgttctcagccgggcacggtggctcacgcctgtaaccccagcactttgggaggctgaggcgggcggatcacgaggtcaggagattgagaccatcctggctaacacggtgaaacccagtctctactaaaaatacaaaaattagcccggcgtggtggcatgcgcctgtagtcccagctacttgggaggctgaagcaggagaattgcctgaacccaggaagaggaggttgcagtgagccgagatcgcaccactgcattccagcctgggcaacagagcgagactccatctcaaaaaaaaaaaaaaaa

SEQ ID NO: 8464 - DNA, 1504 bp, Homo sapiens
gcgcccagcccttcttcacctgccgtccaggtatcatcctagtcttccctccgtctctgggatgggaaactcttgtctagtgatgtgactcattacgtgatcccagactggaaagttgttcaagattatcttgagatccttgagtttcctgagttgaagggaattattttcatgcagacagcttgtcaagctgtgcagcatcaaagaggcaggagcaatgctgctatctgccacgggaaagaggagagtccatggagaagtggcagaccaggagcatatacaacgcagctgtttggtactatcatcactgccaggacaggatgccaattgttatggtgacagaagatgaagaggcaattcagcagtatggaagtgaaacagaaggagtattcgtgattactttcaagaattacctggacaatttctggcctgatttaaaagctgcccacgagctttgtgattctatccttcagtctcgacgggagagagagaatgagagtcaggagagccatgggaaggagtacccagaacatcttcccctggaagtgttagaagctgggattaaatctggacgctatatccagggaattctgaatgtcaacaaacacagagcccaaatagaagcttttgttcgacttcaaggagccagcagtaaagattcagatttagtcagtgacatcctaatccacgggatgaaggctcgaaaccgctcaattcatggagatgtggtagttgtggagctgcttcctaaaaatgaatggaaaggaagaaccgtagccctgtgtgagaatgactgtgacgacaaggcttcgggcgagtccccaagtgagcccatgcctacaggacttcagggtggtcgtgcgcatcgattcctgggagtcaacatctgtgtatccaaatggacattttgtgcgtgttttaggaagaatcggagatctggaaggggaaattgcaaccatcctggtggaaaacagtatttcagttattcctttctcagaagctcagatgtgtgagatgccagtaaacacaccagaaagtccctggaaggtgagtcctgaagaggaacaaaaacgtaaagacttgaggaaaagccatctcgtattcagcattgaccccaaaggttgtgaagatgtggatgacacactctcagtcagaaccttaaataatggcaacctggaacttggggtccacatcgcagatgtaacacactttgtggcaccaaattcttacattgatattgaagctagaacaagggccaccacttattatctagcagatcgtcgctatgacatgctgccttccgtcctcagtgcagatttgtgttcccttctgggaggcgttgataggtatgctgtaagcatcatgtgggaactggataaagcctcttatgaaattaagaaagtgtggtatggcagaaccattattcgatcagcatacaaactgttctatgaagcagcccaagaactactggatggaaacttaagcgttgttgatgatattccag

SEQ ID NO: 8465 - DNA, 873 bp, Homo sapiens
cagggccgcacgctgcggatcgtgcgcgagcactacctgcggccctgcgtgccctgccacagcccgctctgcccgcagcccgccgcctgcagccacgatgggaaactcttgtctagtgatgtgactcattacgtgatcccagactggaaagttgttcaagattatcttgagatccttgagtttcctgagttgaagggaattattttcatgcagacagcttgtcaagctgtgcagcatcaaagaggcaggagcaagagatagcagtggatgagtacctgctttgttagagttatttttctcctccgtgtcacagacagtataacaaactgcgaaacctgctgaaggatgcgcgtcatgattgcattctctttgctaatgaattccagcaatgctgctatctgccacgggaaagaggagagtccatggagaagtggcagaccaggagcatatacaacgcagctgtttggtactatcatcactgccaggacaggatgccaattgttatggtgacagaagatgaagaggcaattcagcagtatggaagtgaaacagaaggagtattcgtgattactttcaagaattacctggacaatttctggcctgatttaaaagctgcccacgagctttgtgattctatccttcagtctcgacgggagagagagaatgagagtcaggagagccatgggaaggagtacccagaacatcttcccctggaagtgttagaagctgggattaaatctggacgctatatccagggaattctgaatgtcaacaaacacagagcccaaatagaagcttttgttcgacttcaaggagccagcagtaaagattcagatttagtcagtgacatcctaatccacgggatgaaggctc

SEQ ID NO: 8466 - DNA, 360 bp, Homo sapiens
ctaatcttggacagctgcgcccagcccttcttcacctgccgtccaggtatcatcctagtcttccctccgtctctgggatgggaaactcttgtctagtgatgtgactcattacgtgatcccagactggaaagttgttcaagattatcttgagatccttgagtttcctgagttgaagggaattattttcatgcagacagcttgtcaagctgtgcagcatcaaagaggcaggagacagtataacaaactgcgaaacctgctgaaggatgcgcgtcatgattgcattctctttgctaatgaattccagcaatgctgctatctgccacgggaaagaggagagtccatggagaagtggcagaccag

SEQ ID NO: 8467 - DNA, 792 bp, Homo sapiens
tcccgccgcaacctcgcgccgtggagaaatggggaggtcccgagctgggagcccccgggagctacaggccagctgctgccgctgcgaagctgacatcgcctgctttgcagccacaggtttcctgacctgcccgcactgttgccccagacttttcccccagtggagagccacttcaccgtagatttgtgaactctctgggcccgcactggagcggaaggtcacggggaagttggactggggactcctgggccccagtccttggtttctaggccacaagggtggccgatagaacgatgcacgttactggctctcttcccccatgggaggatgagaatgggctgggggtccttgtcagcgaatgtgtggaatcctccaaacattgtgattaagatgggaaactcttgtctagtgatgtgactcattacgtgatcccagactggaaagttgttcaagattatcttgagatccttgagtttcctgagttgaagggaattattttcatgcagacagcttgtcaagctgtgcagcatcaaagaggcaggagacagtataacaaactgcgaaacctgctgaaggatgcgcgtcatgattgcattctctttgctaatgaattccagcaatgctgctatctgccacgggaaagaggagagtccatggagaagtggcagaccaggagcatatacaacgcagctgtttggtactatcatcactgccaggacaggatgccaattgttatggtgacagaagatgaagaggcaattcagcagtatggaagtgaaacagaaggagtat

SEQ ID NO: 8468 - DNA, 504 bp, Homo sapiens
gacacggaggcgtaggccccgcggcctgcgcccgctcgccggcctcaccccccggctctctgccggtggggacccagcggcccggatgggaaactcttgtctagtgatgtgactcattacgtgatcccagactggaaagttgttcaagattatcttgagatccttgagtttcctgagttgaagggaattattttcatgcagacagcttgtcaagctgtgcagcatcaaagaggcaggagacagtataacaaactgcgaaacctgctgaaggatgcgcgtcatgattgcattctctttgctaatgaattccagcaatgctgctatctgccacgggaaagaggagagtccatggagaagtggcagaccaggagcatatacaacgcagctgtttggtactatcatcactgccaggacaggatgccaattgttatggtgacagaagatgaagaggcaattcagcagtatggaagtgaaacagaaggagtattcgtgattactttcaag

SEQ ID NO: 8469 - DNA, 3201 bp, Homo sapiens
atgcgggggttgtccatctctgtatccccagtgccagcactgcacctcgccccaagcagttgtccaataaatgagcagtgagtaaatgaaagaatgagcaaagccttgtaacaggaaaggggccggcggcgtctgccgtgcaagacctggcccagtggagcagagcctggaggttcaggagccgggtctggaaggctccttccggtggaagaggggcccggagccagccggcgcctggcacaaggcgtctcagaggccgcccactgggagccaaccgttgcagccagttgtccccgcgagcgaggccggagaaggcgcggcggcccctggcctggccatttcgcccttgtcgcagctgaaccgccgactacgagctcctgcaccgcgcacacaccccgcgcgcttcgctctcggcctcgcccggccaccgtcgctctctagaacgccgcgcccgtgacccggaagagcattctccttagcaactgcgggactgcggcggcgccggcctccggggagaaacgcgaatgacaacagagctgctcaaggcgggaactctgagctaagcagtggaggtttctctggatctggagagaagagtgaccttggagccaataatgagccatcctgactacagaatgaacctccggcccctggggacccccagaggtgtgtctgctgtggctggtccacatgacattggtgcttcgccaggtgacaaaaagtcaaagaacaggtccacacgagggaagaaaaagagcatatttgaaacttacatgtccaaggaggatgtttcagaaggcttgaagagaggaacactcatccagggtgtattgagaattaatccaaagaagtttcatgaagccttcattccttccccggatggtgatcgagacatttttattgatggggttgttgctcgtaatagagccttaaatggggatctggtggtcgtgaaactgcttcccgaggagcattggaaggtagttaaaccagagagcaatgacaaagaaacagaagctgcgtatgaatcagatatccccgaggagctctgtggacaccatctcccgcaacagtccctgaaaagctataatgacagtcctgatgtcattgtagaggctcagtttgatggcagcgactcagaagatggacatggcatcacacaaaatgtgctggttgatggtgttaagaaactctcagtttgtgtttctgagaaaggaagagaggatggtgatgcaccggttacaaaagatgagaccacctgcatttcacaagacacaagagctttatcggagaaatccctgcaaagatcagcaaaggtggtttacatcttggagaaaaaacattctcgagcagcaaccggcttcctcaaactcttggctgataagaacagcgaactgtttaggaaatacgccctgttttctccctcagaccaccgagtgcctagaatttatgtgcctctcaaggactgtccccaggactttgtggcacggcctaaagattatgccaacacactgttcatctgccgcattgtggactggaaggaggactgcaattttgccctggggcagctggctaagagtcttgggcaggctggtgaaattgagcctgaaacagaaggaatactaacagagtatggcgtggatttctctgatttctcttcagaagttctagaatgtcttcctcaaggcctgccatggacaattccaccagaggagttcagcaagagaagggatttaagaaaagactgtatcttcaccattgacccatcaaccgcccgagacctcgatgatgccctctcctgcaagccactcgctgacggcaacttcaaagtgggagttcacattgctgacgtgagttactttgttccggagggatctgatctggataaagtggctgccgagagggctacaagcgtctacttggttcaaaaggtggtccccatgcttcccaggctgctgtgtgaggagctgtgcagcctcaaccccatgtccgacaagctgaccttctctgtgatctggacactgactccagagggcaagatccttgatgaatggtttggccggaccatcatccgctcctgcaccaaacttagctacgagcatgcacagagcatgattgaaagcccaactgagaaaatccctgcgaaagagctgccccccatttccccagagcatagcagcgaggaggtacaccagcagaacgcagacaaggatggggctgcccatcttcaggcctctcacagcccctctgctgaagatgcagaagcacagccctccacagaggaacgcctgcctgagactcggggcatatgtgacagggatccagacacacgactgtttttccttcagcaacagagccgtgtattggaagcaaagccccaaaacacgataagagtagaggagcagacaacccagttgcagatttgaagaagcatgtggaattccttgtggcggagaaggaaagattatggaaagaaagtaaacaggtaaaggctgaaaaggccagacttctaaaaggtccagtagaaaaggagctggatgtgggtgctgattttgtggaaaagtcagagttacggagctcgcctctgcattcagaaactgctataccctcttcagccttgcagaggtttgcagcagatgccaggaaagccaagtacattccaatacccaatcttttccctcagattttccatctccagagcttccctttatggagctttctgaggatattctgaaaggatttatgagtaactaaaatggaaggccatagaagaagggagaagaggaaataatactaagtcatacagttaatccagcaacaaaaaatgaaaagggaaagccacaggcaagggtaatcctggaaatgcctcgtcatctggtgtactgtaggagaagacgcattgccaggatgtggggaacagtcgctgtgaagcgtgtcacatacctgattcactgacttgagctgatgatgccgacctggcagacactaaactcgtggagggtcagtttctcttgacaccaaccaaatggctgcctgaaagaattttttcaagcaacaattatttttcttatcttcagggttaaaatgtataaaagtatgttatgtataattaatctgttatgtcataagtgatcatgcaaaacctaaatattatggcagcctgaggggctgcttcgtatttgaaacatgctttgtctcagg

SEQ ID NO: 8470 - DNA, 3501 bp, Homo sapiens
tttcgcccttgtcgcagctgaaccgccgactacgagctcctgcaccgcgcacacaccccgcgcgcttcgctctcggcctcgcccggccaccgtcgctctctagaacgccgcgcccgtgacccggaagagcattctccttagcaactgcgggactgcggcggcgccggcctccggggagaaacgcgaatgacaacagagctgctcaaggcgggaactctgagctaagcagtggaggtttctctggatctggagagaagagtgaccttggagccaataatgagccatcctgactacagaatgaacctccggcccctggggacccccagaggtgtgtctgctgtggctggtccacatgacattggtgcttcgccaggtgacaaaaagtcaaagaacaggtccacacgagggaagaaaaagagcatatttgaaacttacatgtccaaggaggatgtttcagaaggcttgaagagaggaacactcatccagggtgtattgagaattaatccaaagaagtttcatgaagccttcattccttccccggatggtgatcgagacatttttattgatggggttgttgctcgtaatagagccttaaatggggatctggtggtcgtgaaactgcttcccgaggagcattggaaggtagttaaaccagagagcaatgacaaagaaacagaagctgcgtatgaatcagatatccccgaggagctctgtggacaccatctcccgcaacagtccctgaaaagctataatgacagtcctgatgtcattgtagaggctcagtttgatggcagcgactcagaagatggacatggcatcacacaaaatgtgctggttgatggtgttaagaaactctcagtttgtgtttctgagaaaggaagagaggatggtgatgcaccggttacaaaagatgagaccacctgcatttcacaagacacaagagctttatcggagaaatccctgcaaagatcagcaaaggtggtttacatcttggagaaaaaacattctcgagcagcaaccggcttcctcaaactcttggctgataagaacagcgaactgtttaggaaatacgccctgttttctccctcagaccaccgagtgcctagaatttatgtgcctctcaaggactgtccccaggactttgtggcacggcctaaagattatgccaacacactgttcatctgccgcattgtggactggaaggaggactgcaattttgccctggggcagctggctaagagtcttgggcaggctggtgaaattgagcctgaaacagaaggaatactaacagagtatggcgtggatttctctgatttctcttcagaagttctagaatgtcttcctcaaggcctgccatggacaattccaccagaggagttcagcaagagaagggatttaagaaaagactgtatcttcaccattgacccatcaaccgcccgagacctcgatgatgccctctcctgcaagccactcgctgacggcaacttcaaagtgggagttcacattgctgacgtgagttactttgttccggagggatctgatctggataaagtggctgccgagagggctacaagcgtctacttggttcaaaaggtggtccccatgcttcccaggctgctgtgtgaggagctgtgcagcctcaaccccatgtccgacaagctgaccttctctgtgatctggacactgactccagagggcaagatccttgatgaatggtttggccggaccatcatccgctcctgcaccaaacttagctacgagcatgcacagagcatgattgaaagcccaactgagaaaatccctgcgaaagagctgccccccatttccccagagcatagcagcgaggaggtacaccaggccgtcttgaatctccacggaattgccaagcagttacgccagcagcgctttgtggacggcgcacttcgtttggatcagctaaagcttgctttcactctggaccacgagaccggattgcctcaaggatgtcatatctatgagtaccgcgagagcaacaagctcgtggaggagttcatgctcttggccaacatggcagtggcccacaagatccaccgcgccttccccgagcaggccctgctgcgccggcaccccccgccccaaacaaggatgctcagtgacctggtggaattctgcgaccagatggggctgcccgtggacttcagctccgcaggagccctcaataaaagcctgacccaaacatttggagatgacaagtactcactggcccgcaaggaggtgctcaccaacatgtgctcccggcccatgcagatggcactgtacttctgctcggggctgctgcaggacccagcgcagttccggcactacgcgctcaatgtgcccctgtacacacacttcacctcgcccatccgccgctttgccgacgtcctggtgcaccgcctcctggctgccgcgttaggctatagggagcgactagacatggcgcccgataccctgcagaaacaggcggaccactgtaacgaccgccgcatggcgtccaagcgcgtgcaggagctcagtaccagtctcttctttgctgttctggtcaaggagagtggccccctggagtcagaagccatggtgatgggcatcctgaagcaagccttcgacgtgctggtgctgcgctacggcgtgcagaagcgcatctactgcaacgcactggccctgcggtcccaccacttccagaaggtgggcaagaagccggaactcacgctggtctgggagcctgaggacatggagcaggagccagcacagcaggtcatcaccatcttcagcctggtggaggtggtcctgcaggcagagtccacagccctcaagtacagcgccatcctgaagcggccaggcacccagggccacctgggccctgagaaggaggaggaggagtctgacggtgagcccgaggactcaagcaccagctgagctccaccagccgcctgccccgcctgccccgcctgcctgtcccgccacactggctttaggacctgttgacacggaggggggtttttaatttggtttttaacaactcaggggtttgtttttatttttatttaatttttgcagctcaacttttaaacaaactgcaggggagagggtggggctggaaggaaggctgaggcctggtcagcagtgaccccagcagagcaggccccagtcctcctgggaggctggccccccttttttctgggccctactgccctcctctgcccaggaaatgggggggtttcagcaactcagtgtcacagaataaaatcaagtgtggagtgccatctggtgtgtagggcgcctctgggaagcctgggcagcagaatgccccttgcacccagggcaagggacccagttcaggcttcacccctcgctgctgagccgatgtcaacacctggaactttcctgtcagttccaacacgattcagagctggctgcctggcagatgattgatactggagtctcattctgcctgattaaaaatggaattagtatgcaacactg

SEQ ID NO: 8471 - DNA, 1347 bp, Homo sapiens
tttcgcccttgtcgcagctgaaccgccgactacgagctcctgcaccgcgcacacaccccgcgcgcttcgctctcggcctcgcccggccaccgtcgctctctagaacgccgcgcccgtgacccggaagagcattctccttagcaactgcgggactgcggcggcgccggcctccggggagaaacgcgaatgacaacagagctgctcaaggcgggaactctgagctaagcagtggaggtttctctggatctggagagaagagtgaccttggagccaataatgagccatcctgactacagaatgaacctccggcccctggggacccccagaggtgtgtctgctgtggctggtccacatgacattggtgcttcgccaggtgacaaaaagtcaaagaacaggtccacacgagggaagaaaaagagcatatttgaaacttacatgtccaaggaggatgtttcagaaggcttgaagagaggaacactcatccagggtgtattgagaattaatccaaagaagtttcatgaagccttcattccttccccggatggtgatcgagacatttttattgatggggttgttgctcgtaatagagccttaaatggggatctggtggtcgtgaaactgcttcccgaggagcattggaaggtagttaaaccagagagcaatgacaaagaaacagaagctgcgtatgaatcagatatccccgaggagctctgtggacaccatctcccgcaacagtccctgaaaagctataatgacagtcctgatgtcattgtagaggctcagtttgatggcagcgactcagaagatggacatggcatcacacaaaatgtgctggttgatggtgttaagaaactctcagtttgtgtttctgagaaagacaatgaaattgaggctcagagaagttcctgggcttatccagtatcccacaggaagtcagaagagaggatggtgatgcaccggttacaaaagatgagaccacctgcatttcacaagacacaagagctttatcggagaaatccctgcaaagatcagcaaaggtggtttacatcttggagaaaaaacattctcgagcagcaaccggcttcctcaaactcttggctgataagaacagcgaactgtttaggaaatacgccctgttttctccctcagaccaccgagtgcctagaatttatgtgcctctcaaggactgtccccaggactttgtggcacggcctaaagattatgccaacacactgttcatctgccgcattgtggactggaaggaggactgcaattttgccctggggtagctggctaagagtcttgggcaggctggtgaaattgagcctgaaacagaaggaatactaa

SEQ ID NO: 8472 - DNA, 2658 bp, Homo sapiens
atgagccatcctgactacagaatgaacctccggcccctggggacccccagaggtgtgtctgctgtggctggtccacatgacattggtgcttcgccaggtgacaaaaagtcaaagaacaggtccacacgagggaagaaaaagagcatatttgaaacttacatgtccaaggaggatgtttcagaaggcttgaagagaggaacactcatccagggtgtattgagaattaatccaaagaagtttcatgaagccttcattccttccccggatggtgatcgagacatttttattgatggggttgttgctcgtaatagagccttaaatggggatctggtggtcgtgaaactgcttcccgaggagcattggaaggtagttaaaccagagagcaatgacaaagaaacagaagctgcgtatgaatcagatatccccgaggagctctgtggacaccatctcccgcaacagtccctgaaaagctataatgacagtcctgatgtcattgtagaggctcagtttgatggcagcgactcagaagatggacatggcatcacacaaaatgtgctggttgatggtgttaagaaactctcagtttgtgtttctgagaaaggaagagaggatggtgatgcaccggttacaaaagatgagaccacctgcatttcacaagacacaagagctttatcggagaaatccctgcaaagatcagcaaaggtggtttacatcttggagaaaaaacattctcgagcagcaaccggcttcctcaaactcttggctgataagaacagcgaactgtttaggaaatacgccctgttttctccctcagaccaccgagtgcctagaatttatgtgcctctcaaggactgtccccaggactttgtggcacggcctaaagattatgccaacacactgttcatctgccgcattgtggactggaaggaggactgcaattttgccctggggcagctggctaagagtcttgggcaggctggtgaaattgagcctgaaacagaaggaatactaacagagtatggcgtggatttctctgatttctcttcagaagttctagaatgtcttcctcaaggcctgccatggacaattccaccagaggagttcagcaagagaagggatttaagaaaagactgtatcttcaccattgacccatcaaccgcccgagacctcgatgatgccctctcctgcaagccactcgctgacggcaacttcaaagtgggagttcacattgctgacgtgagttactttgttccggagggatctgatctggataaagtggctgccgagagggctacaagcgtctacttggttcaaaaggtggtccccatgcttcccaggctgctgtgtgaggagctgtgcagcctcaaccccatgtccgacaagctgaccttctctgtgatctggacactgactccagagggcaagatccttgatgaatggtttggccggaccatcatccgctcctgcaccaaacttagctacgagcatgcacagagcatgattgaaagcccaactgagaaaatccctgcgaaagagctgccccccatttccccagagcatagcagcgaggaggtacaccaggccgtcttgaatctccacggaattgccaagcagttacgccagcagcgctttgtggacggcgcacttcgtttggatcagctaaagcttgctttcactctggaccacgagaccggattgcctcaaggatgtcatatctatgagtaccgcgagagcaacaagctcgtggaggagttcatgctcttggccaacatggcagtggcccacaagatccaccgcgccttccccgagcaggccctgctgcgccggcaccccccgccccaaacaaggatgctcagtgacctggtggaattctgcgaccagatggggctgcccgtggacttcagctccgcaggagccctcaataaaagcctgacccaaacatttggagatgacaagtactcactggcccgcaaggaggtgctcaccaacatgtgctcccggcccatgcagatggcactgtacttctgctcggggctgctgcaggacccagcgcagttccggcactacgcgctcaatgtgcccctgtacacacacttcacctcgcccatccgccgctttgccgacgtcctggtgcaccgcctcctggctgccgcgttaggctatagggagcgactagacatggcgcccgataccctgcagaaacaggcggaccactgtaacgaccgccgcatggcgtccaagcgcgtgcaggagctcagtaccagtctcttctttgctgttctggtcaaggagagtggccccctggagtcagaagccatggtgatgggcatcctgaagcaagccttcgacgtgctggtgctgcgctacggcgtgcagaagcgcatctactgcaacgcactggccctgcggtcccaccacttccagaaggtgggcaagaagccggaactcacgctggtctgggagcctgaggacatggagcaggagccagcacagcaggtcatcaccatcttcagcctggtggaggtggtcctgcaggcagagtccacagccctcaagtacagcgccatcctgaagcggccaggcacccagggccacctgggccctgagaaggaggaggaggagtctgacggtgagcccgaggactcaagcaccagctga

SEQ ID NO: 8473 - DNA, 2048 bp, Homo sapiens
agaacgccgcgcccgtgacccggaagagcattctccttagcaactgcgggactgcggcggcgccggcctccggggagaaacgcgaatgacaacagagctgctcaaggcgggaactctgagctaagcagtggaggtttctctggatctggagagaagagtgaccttggagccaataatgagccatcctgactacagaatgaacctccggcccctggggacccccagaggtgtgtctgctgtggctggtccacatgacattggtgcttcgccaggtgacaaaaagtcaaagaacaggtccacacgagggaagaaaaagagcatatttgaaacttacatgtccaaggaggatgtttcagaaggcttgaagagaggaacactcatccagggtgtattgagaattaatccaaagaagtttcatgaagccttcattccttccccggatggtgatcgagacatttttattgatggggttgttgctcgtaatagagccttaaatggggatctggtggtcgtgaaactgcttcccgaggagcattggaaggtagttaaaccagagagcaatgacaaagaaacagaagctgcgtatgaatcagatatccccgaggagctctgtggacaccatctcccgcaacagtccctgaaaagctataatgacagtcctgatgtcattgtagaggctcagtttgatggcagcgactcagaagatggacatggcatcacacaaaatgtgctggttgatggtgttaagaaactctcagtttgtgtttctgagaaaggaagagaggatggtgatgcaccggttacaaaagatgagaccacctgcatttcacaagacacaagagctttatcggagaaatccctgcaaagatcagcaaaggtcattgcctacagattttctccacgtgtccaaatggctttcacctgagctacttgttgaagatctcgtgtgattcagtcaggactgtatttggtcatttaatcagaaaagttagagcagagaatcataaaaagtgaattaaaaaaaaaaaactttaaacatataaatacgaatccatcttcctgcctttggataaggggtcaaggccttttctttgagtgtgggtatgttgattggagttctgtgttatctttcttgcttaaaccacacttgtaatgcagcatttatcactttgagttttggtggagtgagaatttagacagtggagaagcagtatgaatatagactctcttcagatttgtacagtttttgctccaatttttttgttgttaccatgcccatacctaatttaaaaataattttaatgtcttttttagtttttccaaagtattcaatttagttatagaaacaattgtttttatattcctatttcaccattttgcacaattcacttgtattctttaattatagaagctagtgtcattttcagatgtgggatgaaacagctgacttcttttttttttgttttgagacagagtttcactgttgttgcccaggctggagtgcaatggcacgatcttggctcactgcaacctctgcctccctggttcaagcgattcttctgcctcagcctcctgagtagctgggattacaggcgtgtaccaccatgcctggctaattttttgtatttttagtagaaatggggtttcgccaggctggtctcgaactcctgacctcgtgatctgcctgcctcagcctcccaaagtgctgggattacaggtgtgagccaacatgctcgactaaacacagctgacttctagctgtgcacatagctcatagtggcagaaatggtgaagggcaacgtataaagtggcataatggcatgaggctttatgtttcagaagcatccatcagtgtgtttcatatgggaatgcagtgtgcttactctaccaagcaagttgattaatagagtattgctcttgcatactgacatgaggaatttctaaattatactctatatatttgagtactaactgtgctccaggcagcatgctaagtgtgggagattagaatgaatggaaagcctggggatggatctggctcacagacc

SEQ ID NO: 8474 - DNA, 2298 bp, Homo sapiens
attctccttagcaactgcgggactgcggcggcgccggcctccggggagaaacgcgaatgacaacagagctgctcaaggcgggaactctgagctaagcagtggaggtttctctggatctggagagaagagtgaccttggagccaataatgagccatcctgactacagaatgaacctccggcccctggggacccccagaggtgtgtctgctgtggctggtccacatgacattggtgcttcgccaggtgacaaaaagtcaaagaacaggtccacacgagggaagaaaaagagcatatttgaaacttacatgtccaaggaggatgtttcagaaggcttgaagagaggaacactcatccagggtgtattgagaattaatccaaagaagtttcatgaagccttcattccttccccggatggtgatcgagacatttttattgatggggttgttgctcgtaatagagccttaaatggggatctggtggtcgtgaaactgcttcccgaggagcattggaaggtagttaaaccagagagcaatgacaaagaaacagaagctgcgtatgaatcagatatccccgaggagctctgtggacaccatctcccgcaacagtccctgaaaagctataatgacagtcctgatgtcattgtagaggctcagtttgatggcagcgactcagaagatggacatggcatcacacaaaatgtgctggttgatggtgttaagaaactctcagtttgtgtttctgagaaaggaagagaggatggtgatgcaccggttacaaaagatgagaccacctgcatttcacaagacacaagagctttatcggagaaatccctgcaaagatcagcaaaggtggtttacatcttggagaaaaaacattctcgagcagcaaccggcttcctcaaactcttggctgataagaacagcgaactgtttaggaaatacgccctgttttctccctcagaccaccgagtgcctagaatttatgtgcctctcaaggactgtccccaggactttgtggcacggcctaaagattatgccaacacactgttcatctgccgcattgtggactggaaggaggactgcaattttgccctggggcagctggctaagagtcttgggcaggctggtgaaattgagcctgaaacagaaggaatactaacagagtatggcgtggatttctctgatttctcttcagaagttctagaatgtcttcctcaaggcctgccatggacaattccaccagaggagttcagcaagagaagggatttaagaaaagactgtatcttcaccattgacccatcaaccgcccgagacctcgatgatgccctctcctgcaagccactcgctgacggcaacttcaaagtgggagttcacattgctgacgtgagttactttgttccggagggatctgatctggataaagtggctgccgagagggctacaagcgtctacttggttcaaaaggtggtccccatgcttcccaggctgctgtgtgaggagctgtgcagcctcaaccccatgtccgacaagctgaccttctctgtgatctggacactgactccagagggcaagatccttgatgaatggtttggccggaccatcatccgctcctgcaccaaacttagctacgagcatgcacagagcatgattgaaagcccaactgagaaaatccctgcgaaagagctgccccccatttccccagagcatagcagcgaggaggtacaccaggccgtcttgaatctccacggaattgccaagcagttacgccagcagcgctttgtggacggcgcacttcgtttggatcagctaaagcttgctttcactctggaccacgagaccggattgcctcaaggatgtcatatctatgagtaccgcgagagcaacaagctcgtggaggagttcatgctcttggccaacatggcagtggcccacaagatccaccgcgccttccccgagcaggccctgctgcgccggcaccccccgccccaaacaaggatgctcagtgacctggtggaattctgcgaccagatggggctgcccgtggacttcagctccgcaggagccctcaataaaagcctgacccaaacatttggagatgacaagtactcactggcccgcaaggaggtgctcaccaacatgtgctcccgcctgcctgtcccgccacactggctttaggacctgttgacacggaggggggtttttaatttggtttttaacaactcaggggtttgtttttatttttatttaatttttgcagctcaacttttaaacaaactgcaggggagagggtggggctgga

SEQ ID NO: 8475 - DNA, 570 bp, Homo sapiens
agagcattctccttagcaactgcgggactgcggcggcgccggcctccggggagaaacgagctgctcaaggcgggaactctgagctaagcagtggaggtttctctggatctggagagaagagtgaccttggagccaataatgagccatcctgactacagaatgaacctccggcccctggggacccccagaggtgtgtctgctgtggctggtccacatgacattggtgcttcgccaggtgacaaaaagtcaaagaacaggtccacacgagggaagaaaaagagcatatttgaaacttacatgtccaaggaggatgtttcagaaggcttgaagagaggaacactcatccagggtgtattgagaattaatccaaagaagtttcatgaagccttcattccttccccggatggtgatcgagacatttttattgatggggttgttgctcgtaatagagccttaaatggggatctggtggtcgtgaaactgcttcccgaggagcattggaaggtagttaaaccagagagcaatgacaaagaaacagaagctgcgtatgaatcagatatccccgaggag

SEQ ID NO: 8476 - DNA, 2133 bp, Homo sapiens
tttcgcccttgtcgcagctgaaccgccgactacgagctcctgcaccgcgcacacaccccgcgcgcttcgctctcggcctcgcccggccaccgtcgctctctagaacgccgcgcccgtgacccggaagagcattctccttagcaactgcgggactgcggcggcgccggcctccggggagaaacgcgaatgacaacagagctgctcaaggcgggaactctgagctaagcagtggaggtttctctggatctggagagaagagtgaccttggagccaataatgagccatcctgactacagaatgaacctccggcccctggggacccccagaggtgtgtctgctgtggctggtccacatgacattggtgcttcgccaggtgacaaaaagtcaaagaacaggtccacacgagggaagaaaaagagcatatttgaaacttacatgtccaaggaggatgtttcagaaggcttgaagagaggaacactcatccagggtgtattgagaattaatccaaagaagtttcatgaagccttcattccttccccggatggtgatcgagacatttttattgatggggttgttgctcgtaatagagccttaaatggggatctggtggtcgtgaaactgcttcccgaggagcattggaaggtagttaaaccagagagcaatgacaaagaaacagaagctgcgtatgaatcagatatccccgaggagctctgtggacaccatctcccgcaacagtccctgaaaagctataatgacagtcctgatgtcattgtagaggctcagtttgatggcagcgactcagaagatggacatggcatcacacaaaatgtgctggttgatggtgttaagaaactctcagtttgtgtttctgagaaaggaagagaggatggtgatgcaccggttacaaaagatgagaccacctgcatttcacaagacacaagagctttatcggagaaatccctgcaaagatcagcaaaggtggtttacatcttggagaaaaaacattctcgagcagcaaccggcttcctcaaactcttggctgataagaacagcgaactgtttaggaaatacgccctgttttctccctcagaccaccgagtgcctagaatttatgtgcctctcaaggactgtccccaggactttgtggcacggcctaaagattatgccaacacactgttcatctgccgcattgtggactggaaggaggactgcaattttgccctggggcagctggctaagagtcttgggcaggctggtgaaattgagcctgaaacagaaggaatactaacagagtatggcgtggatttctctgatttctcttcagaagttctagaatgtcttcctcaaggcctgccatggacaattccaccagaggagttcagcaagagaagggatttaagaaaagactgtatcttcaccattgacccatcaaccgcccgagacctcgatgatgccctctcctgcaagccactcgctgacggcaacttcaaagtgggagttcacattgctgacgtgagttactttgttccggagggatctgatctggataaagtggctgccgagagggctacaagcgtctacttggttcaaaaggtggtccccatgcttcccaggctgctgtgtgaggagctgtgcagcctcaaccccatgtccgacaagctgaccttctctgtgatctggacactgactccagagggcaagatccttgatgaatggtttggccggaccatcatccgctcctgcaccaaacttagctacgagcatgcacagagcatgattgaaagcccaactgagaaaatccctgcgaaagagctgccccccatttccccagagcatagcagcgaggaggtacaccaggccgtcttgaatctccacggaattgccaagcagttacgccagcagcgctttgtggacggcgcacttcgtttggatcagctaaagcttgctttcactctggaccacgagaccggattgcctcaaggatgtcatatctatgagtaccgcgagagcaacaagccctgctgcgccggcaccccccgccccaaacaaggatgctcagtgacctggtggaattctgcgaccagatggggctgcccgtggacttcagctccgcaggagccctcaatgaaagcc

SEQ ID NO: 8477 - DNA, 647 bp, Homo sapiens
gggatctgtgtgaagtggactaaggattaagtaggatgtcaactgagacagaacttcaagtagctgtgaaaaccagcgccaagaaagactccagaaagaaaggtcaggatcgcagtgaagccactttgataaagaggtttaaaggtgaaggggtccggtacaaagccaaattgatcgggattgatgaagtttccgcagctcggggagacaagttatgtcaagattccatgatgaaactcaagggcgttgttgctggcgctcgttccaaaggagaacacaaacagaaaatctttttaaccatctcctttggaggaatcaaaatctttgatgagaagacaggggcccttcagcatcatcatgctgttcatgaaatatcctacattgcaaaggacattacagatcaccgggcctttggatatgtttgtgggaaggaagggaatcacagatttgtggccataaaaacagcccaggcggctgaacctgttattctggacttgagagatctctttcaactcatttatgaattgaagcaaagagaagaattagaaaaaaaggcacaaaaggataagcagtgtgaacaagctgtgtaccaggttcccaccagccaaaagaaggaaggtgtttatgatgtgccaaaaagtcaacct

SEQ ID NO: 8478 - DNA, 1150 bp, Homo sapiens
cccagctcggcgctcgcccgggcttccccgggctgcagagcgcgcctgagtgccgccgcccgccgggcatggggagccgcttcctgggcggctgcggcagcggaggaggatgctctgggctaggcgagcactcaaaaagagtgaatgaaatgtgcagctcagagtgtcatttctgaagggaggagtctttctcttggagaagagtcctcaatgagcctggccgaggcccgggatctgtgtgaagtggactaaggattaagtaggatgtcaactgagacagaacttcaagtagctgtgaaaaccagcgccaagaaagactccagaaagaaaggtcaggatcgcagtgaagccactttgataaagaggtttaaaggtgaaggggtccggtacaaagccaaattgatcgggattgatgaagtttccgcagctcggggagacaagttatgtcaagattccatgatgaaactcaagggcgttgttgctggcgctcgttccaaaggagaacacaaacagaaaatctttttaaccatctcctttggaggaatcaaaatctttgatgagaagacaggggcccttcagcatcatcatgctgttcatgaaatatcctacattgcaaaggacattacagatcaccgggcctttggatatgtttgtgggaaggaagggaatcacagatttgtggccataaaaacagcccaggcggctgaacctgttattctggacttgagagatctctttcaactcatttatgaattgaagcaaagagaagaattagaaaaaaaggcacaaaaggataagcagtgtgaacaagctgtgtaccagacaatattggaagaggatgttgaagatcctgtgtaccaggtaatttctgaaactagtcggggttttagattcaagagtgactagacctgtgccagagccattttgtcagaaacctgaagaatccactgactgcaaaacctggagagagaccaagattatttctgagggtgagggctgccagcccctccaggagcaaatttccataaaaactaacagaagtttggccggcatcggtatcttgggatttggagatccgcttctcccttcttgcctctgcctcggcccccttcacagtctgtaaaagtttgatcccagagctgaatgtttt

SEQ ID NO: 8479 - DNA, 1802 bp, Homo sapiens
gggatctgtgtgaagtggactaaggattaagtaggatgtcaactgagacagaacttcaagtagctgtgaaaaccagcgccaagaaagactccagaaagaaaggtcaggatcgcagtgaagccactttgataaagaggtttaaaggtgaaggggtccggtacaaagccaaattgatcgggattgatgaagtttccgcagctcggggagacaagttatgtcaagattccatgatgaaactcaagggcgttgttgctggcgctcgttccaaaggagaacacaaacagaaaatctttttaaccatctcctttggaggaatcaaaatctttgatgagaagacaggggcccttcagcatcatcatgctgttcatgaaatatcctacattgcaaaggacattacagatcaccgggcctttggatatgtttgtgggaaggaagggaatcacagatttgtggccataaaaacagcccaggcggctgaacctgttattctggacttgagagatctctttcaactcatttatgaattgaagcaaagagaagaattagaaaaaaaggcacaaaaggataagcagtgtgaacaagctgtgtaccagacaatattggaagaggatgttgaagatcctgtgtaccagtacattgtgtttgaggctggacacgagccaatccgtgatcccgaaacggaagaaaacatttatcaggttcccaccagccaaaagaaggaaggtgtttatgatgtgccaaaaagtcaacctgtaagtaatggctattcgtttgaggattttgaagaacggtttgctgcagccaccccgaacagaaacctgcccacagactttgatgagatttttgaggcaacgaaggctgtgacccaattagaactttttggggacatgtccacaccccctgatataacctctccccccactcctgcaactccaggtgatgcctttatcccatcttcatctcagacccttccagcgagtgcagatgtgtttagttctgtacctttcggcactgctgctgtaccctcaggttacgttgcaatgggcgctgtcctcccgtccttctggggtcagcagcccctcgtccaacagcagatggtcatgggtgcccagccaccagtcgctcaggtgatgccgggggctcagcccatcgcatggggccagccgggtctctttcctgccactcagcagccctggccaactgtggccgggcagtttccgccagccgccttcatgcccacacaaactgttatgcctttgccagctgccatgttccaaggtcccctcaccccccttgccaccgtcccaggcacgagtgactccaccaggtcaagtccacagaccgacaagcccaggcagaaaatgggcaaagaaacgtttaaggatttccagatggcccagcctccgcccgtgccctcccgcaaacccgaccagccctccctcacctgtacctcagaggccttctccagttacttcaacaaagtcggggtggcacaggatacagacgactgtgatgactttgacatctcccagttgaatttgacccctgtgacttctaccacaccatcgaccaactcacctccaaccccagcccctagacagagctctccatccaaatcatctgcatcccatgccagtgatcctaccacagatgacatctttgaagagggctttgaaagtcccagcaaaagcgaagagcaagaagctcctgatggatcacaggcctcatccaacagtgatccatttggtgagcccagtggggagcccagtggtgataatataagtccacaggccggtagctag

SEQ ID NO: 8480 - DNA, 752 bp, Homo sapiens
gggatctgtgtgaagtggactaaggattaagtaggatgtcaactgagacagaacttcaagtagctgtgaaaaccagcgccaagaaagactccagaaagaaaggtcaggatcgcagtgaagccactttgataaagaggtttaaaggtgaaggggtccggtacaaagccaaattgatcgggattgatgaagtttccgcagctcggggagacaagttatgtcaagattccatgatgaaactcaagggcgttgttgctggcgctcgttccaaaggagaacacaaacagaaaatctttttaaccatctcctttggaggaatcaaaatctttgatgagaagacaggggttcccaccagccaaaagaaggaaggtgtttatgatgtgccaaaaagtcaacctgtaagtaatggctattcgtttgaggattttgaagaacggtttgctgcagccaccccgaacagaaacctgcccacagactttgatgagatttttgaggcaacgaaggctgtgacccaattagaactttttggggacatgtccacaccccctgatataacctctccccccactcctgcaactccaggtgatgcctttatcccatcttcatctcagacccttccagcgagtgcagatgtgtttagttctgtacctttcggcactgctgctgtaccctcaggttacgttgcaatgggcgctgtcctcccgtccttctggggtcagcagcccctcgtccaacagcagatggtcatgggtgcc

SEQ ID NO: 8481 - DNA, 2177 bp, Homo sapiens
cccagctcggcgctcgcccgggcttccccgggctgcagagcgcgcctgagtgccgccgcccgccgggcatggggagccgcttcctgggcggctgcggcagcggaggaggatgctctgggctaggcgagcactcaaaaagagtgaatgaaatgtgcagctcagagtgtcatttctgaagggaggagtctttctcttggagaagagtcctcaatgagcctggccgaggcccgggatctgtgtgaagtggactaaggattaagtaggatgtcaactgagacagaacttcaagtagctgtgaaaaccagcgccaagaaagactccagaaagaaaggtcaggatcgcagtgaagccactttgataaagaggtttaaaggtgaaggggtccggtacaaagccaaattgatcgggattgatgaagtttccgcagctcggggagacaagttatgtcaagattccatgatgaaactcaagggcgttgttgctggcgctcgttccaaaggagaacacaaacagaaaatctttttaaccatctcctttggaggaatcaaaatctttgatgagaagacaggggcccttcagcatcatcatgctgttcatgaaatatcctacattgcaaaggacattacagatcaccgggcctttggatatgtttgtgggaaggaagggaatcacagatttgtggccataaaaacagcccaggcggctgaacctgttattctggacttgagagatctctttcaactcatttatgaattgaagcaaagagaagaattagaaaaaaaggcacaaaaggataagcagtgtgaacaagctgtgtaccagacaatattggaagaggatgttgaagatcctgtgtaccagtacattgtgtttgaggctggacacgagccaatccgtgatcccgaaacggaagaaaacatttatcaggttcccaccagccaaaagaaggaaggtgtttatgatgtgccaaaaagtcaacctgtaagtgctgtgacccaattagaactttttggggacatgtccacaccccctgatataacctctccccccactcctgcaactccaggtgatgcctttatcccatcttcatctcagacccttccagcgagtgcagatgtgtttagttctgtacctttcggcactgctgctgtaccctcaggttacgttgcaatgggcgctgtcctcccgtccttctggggtcagcagcccctcgtccaacagcagatggtcatgggtgcccagccaccagtcgctcaggtgatgccgggggctcagcccatcgcatggggccagccgggtctctttcctgccactcagcagccctggccaactgtggccgggcagtttccgccagccgccttcatgcccacacaaactgttatgcctttgccagctgccatgttccaaggtcccctcaccccccttgccaccgtcccaggcacgagtgactccaccaggtcaagtccacagaccgacaagcccaggcagaaaatgggcaaagaaacgtttaaggatttccagatggcccagcctccgcccgtgccctcccgcaaacccgaccagccctccctcacctgtacctcagaggccttctccagttacttcaacaaagtcggggtggcacaggatacagacgactgtgatgactttgacatctcccagttgaatttgacccctgtgacttctaccacaccatcgaccaactcacctccaaccccagcccctagacagagctctccatccaaatcatctgcatcccatgccagtgatcctaccacagatgacatctttgaagagggctttgaaagtcccagcaaaagcgaagagcaagaagctcctgatggatcacaggcctcatccaacagtgatccatttggtgagcccagtggggagcccagtggtgataatataagtccacaggccggtagctagatagcgcaggtctgggagccagagcctctgtacgcgcagatcaacagacctaagaaatagcatcgatgcgagctcgtggtgggtgctcaagactggcatggacatcagcatcacgacaggctctcttgtattctttcacctcttcccacaagaaattcatgattgcccaatggaactcgctcagaagagggaactaagcatttttggcaaccaatggcagatatctatggcagcacacaaaaaaa

SEQ ID NO: 8482 - DNA, 2580 bp, Homo sapiens
ataaggtatgaaagatgtggcctgcagagagccggcactatctctactgctgctgctgctgctactgctgctgttgctaccgctgcctctgctgccaccgccactactgctgccagcggagccgctaggagtgagcatcccctctccgggatacccagctccgcggcgtctcccgcgcgccctggccccacacggacctgccagccccagggaacaaaagcggagcccgctcgccctctactgcagccggaggatgagtcgagagggctgagcggagagtgtggtcctcggcggctggagctatttccttggcttctctccatgacgattcctgactcgtggccccggcaatcttgggaagacatcatccagcttcttcagtccagaccctgggcaccccccttttgccaggatcgtccccacccagcctggacacattgactgaactgttttctaggacactgcactcagcaagacatggtggtgagccctgactctcagtcttcatgattgaagaactcttttgtacaacacaaagcactcaaaaagagtgaatgaaatgtgcagctcagagtgtcatttctgaagggaggagtctttctcttggagaagagtcctcaatgagcctggccgaggcccgggatctgtgtgaagtggactaaggattaagtaggatgtcaactgagacagaacttcaagtagctgtgaaaaccagcgccaagaaagactccagaaagaaaggtcaggatcgcagtgaagccactttgataaagaggtttaaaggtgaaggggtccggtacaaagccaaattgatcgggattgatgaagtttccgcagctcggggagacaagttatgtcaagattccatgatgaaactcaagggcgttgttgctggcgctcgttccaaaggagaacacaaacagaaaatctttttaaccatctcctttggaggaatcaaaatctttgatgagaagacaggggcccttcagcatcatcatgctgttcatgaaatatcctacattgcaaaggacattacagatcaccgggcctttggatatgtttgtgggaaggaagggaatcacagatttgtggccataaaaacagcccaggcggctgaacctgttattctggacttgagagatctctttcaactcatttatgaattgaagcaaagagaagaattagaaaaaaaggcacaaaaggataagcagtgtgaacaagctgtgtaccagacaatattggaagaggatgttgaagatcctgtgtaccagtacattgtgtttgaggctggacacgagccaatccgtgatcccgaaacggaagaaaacatttatcaggttcccaccagccaaaagaaggaaggtgtttatgatgtgccaaaaagtcaacctgtaagtgctgtgacccaattagaactttttggggacatgtccacaccccctgatataacctctccccccactcctgcaactccaggtgatgcctttatcccatcttcatctcagacccttccagcgagtgcagatgtgtttagttctgtacctttcggcactgctgctgtaccctcaggttacgttgcaatgggcgctgtcctcccgtccttctggggtcagcagcccctcgtccaacagcagatggtcatgggtgcccagccaccagtcgctcaggtgatgccgggggctcagcccatcgcatggggccagccgggtctctttcctgccactcagcagccctggccaactgtggccgggcagtttccgccagccgccttcatgcccacacaaactgttatgcctttgccagctgccatgttccaaggtcccctcaccccccttgccaccgtcccaggcacgagtgactccaccaggtcaagtccacagaccgacaagcccaggcagaaaatgggcaaagaaacgtttaaggatttccagatggcccagcctccgcccgtgccctcccgcaaacccgaccagccctccctcacctgtacctcagaggccttctccagttacttcaacaaagtcggggtggcacaggatacagacgactgtgatgactttgacatctcccagttgaatttgacccctgtgacttctaccacaccatcgaccaactcacctccaaccccagcccctagacagagctctccatccaaatcatctgcatcccatgccagtgatcctaccacagatgacatctttgaagagggctttgaaagtcccagcaaaagcgaagagcaagaagctcctgatggatcacaggcctcatccaacagtgatccatttggtgagcccagtggggagcccagtggtgataatataagtccacaggccggtagctagatagcgcaggtctgggagccagagcctctgtacgcgcagatcaacagacctaagaaatagcatcgatgcgagctcgtggtgggtgctcaagactggcatggacatcagcatcacgacaggctctcttgtattctttcacctcttcccacaagaaattcatgattgcccaatggaactcgctcagaagagggaactaagcatttttggcaaccaatggcagatatctatggcagcacac

SEQ ID NO: 8483 - DNA, 5673 bp, Homo sapiens
actatctctactgctgctgctgctgctactgctgctgttgctaccgctgcctctgctgccaccgccactactgctgccagcggagccgctaggagtgagcatcccctctccgggatacccagctccgcggcgtctcccgcgcgccctggccccacacggacctgccagccccagggaacaaaagcggagcccgctcgccctctactgcagccggaggatgagtcgagagggctgagcggagagtgtggtcctcggcggctggaggctatttccttggcttctctccatgacgattcctgactcgtggccccggcaatcttgggaagacatcatccagcttcttcagtccagaccctgggcaccccccttttgccaggatcgtccccacccagcctggacacattgactgaactgttttctaggacactgcactcagcaagacatggtggtgagccctgactctcagtcttcatgattgaagaactcttttgtacaacacaaagcactcaaaaagagtgaatgaaatgtgcagctcagagtgtcatttctgaagggaggagtctttctcttggagaagagtcctcaatgagcctggccgaggcccgggatctgtgtgaagtggactaaggattaagtaggatgtcaactgagacagaacttcaagtagctgtgaaaaccagcgccaagaaagactccagaaagaaaggtcaggatcgcagtgaagccactttgataaagaggtttaaaggtgaaggggtccggtacaaagccaaattgatcgggattgatgaagtttccgcagctcggggagacaagttatgtcaagattccatgatgaaactcaagggcgttgttgctggcgctcgttccaaaggagaacacaaacagaaaatctttttaaccatctcctttggaggaatcaaaatctttgatgagaagacaggggcccttcagcatcatcatgctgttcatgaaatatcctacattgcaaaggacattacagatcaccgggcctttggatatgtttgtgggaaggaagggaatcacagatttgtggccataaaaacagcccaggcggctgaacctgttattctggacttgagagatctctttcaactcatttatgaattgaagcaaagagaagaattagaaaaaaaggcacaaaaggataagcagtgtgaacaagctgtgtaccagacaatattggaagaggatgttgaagatcctgtgtaccagtacattgtgtttgaggctggacacgagccaatccgtgatcccgaaacggaagaaaacatttatcaggttcccaccagccaaaagaaggaaggtgtttatgatgtgccaaaaagtcaacctgtaagtgctgtgacccaattagaactttttggggacatgtccacaccccctgatataacctctccccccactcctgcaactccaggtgatgcctttatcccatcttcatctcagacccttccagcgagtgcagatgtgtttagttctgtacctttcggcactgctgctgtaccctcaggttacgttgcaatgggcgctgtcctcccgtccttctggggtcagcagcccctcgtccaacagcagatggtcatgggtgcccagccaccagtcgctcaggtgatgccgggggctcagcccatcgcatggggccagccgggtctctttcctgccactcagcagccctggccaactgtggccgggcagtttccgccagccgccttcatgcccacacaaactgttatgcctttgccagctgccatgttccaaggtcccctcaccccccttgccaccgtcccaggcacgagtgactccaccaggtcaagtccacagaccgacaagcccaggcagaaaatgggcaaagaaacgtttaaggatttccagatggcccagcctccgcccgtgccctcccgcaaacccgaccagccctccctcacctgtacctcagaggccttctccagttacttcaacaaagtcggggtggcacaggatacagacgactgtgatgactttgacatctcccagttgaatttgacccctgtgacttctaccacaccatcgaccaactcacctccaaccccagcccctagacagagctctccatccaaatcatctgcatcccatgccagtgatcctaccacagatgacatctttgaagagggctttgaaagtcccagcaaaagcgaagagcaagaagctcctgatggatcacaggcctcatccaacagtgatccatttggtgagcccagtggggagcccagtggtgataatataagtccacaggccggtagctagatagcgcaggtctgggagccagagcctctgtacgcgcagatcaacagacctaagaaatagcatcgatgcgagctcgtggtgggtgctcaagactggcatggacatcagcatcacgacaggctctcttgtattctttcacctcttcccacaagaaattcatgattgcccaatggaactcgctcagaagagggaactaagcatttttggcaaccaatggcagatatctatggcagcacacaaaaaaagtatagaaagatccacccaacattaaatcagaaatcaagcaaatgcttacccaacaaatatttgagccctcatagctgggtttaagatgactcagtgtgcaaaattattaattccctttttatttctctacctgttgaccactgttgagacaccaaatttggagtgacaggcatcagaggattacaacagggttggaactgacttctttaagcaaaagcaaagggtcttctgtgaccacaatatcgtcatccatatgccttttcacataggatgatgtgttttttgtcactccatggggcctggtctgccattttcccccctttcctttttttgtcatgtttgaaaattaataggtgtacaaatttttgtattgcttttgactttttttagatatgggtgaagaaatctaactggggagaaaaaaagcctcagtgaaatgaattaacttgaaattacaagacaaataagtggttgattattcattatgatcacgaatgttgccaaaacagtcctttagctattctgcatcctggtgaagaaagacagctttcagtacgaaccttcattctgtgagtaggaaaagacatcagatcccattgatgagaaagatgaaaaatgcatctgatttcttaagaagctctaaactctaagtacaataaaatgatattttttatttttccgatatcttgctgctgtgttgctatgcagacaagtgtcttctccacgtgccattttcaaagaaaagtcatttgccaaataattctggtacaattctggtaatgtggttttggatcttaaaaaccaactttctaatggaacaatggtggcataaatattcagaataacaaactgattctgtggtccaaatggttcatctctatctctttttgtacatcagaaaattcaaatgggatttttattttataacttgaaaaaaaaaccttaccattaaactctttaaatatttaagggaaatggctttaaggagttctaatgaaaaaaaattgtcttttttttgtaaatataaatgttaatgaaaatgatttttaataatgccattacactgtagagaaggtagcagattgagtgcaaggtgtgacaaacttgatggatggggctcactttccagacgttattctggagcatatggtaggaagctggagtgcagggacagctggcaggagcagttggccaatcagcagctagtgaacgggaagggagcacgtgactccatcatctagcctttccacgagagtccccaccctacgtgcaacacaagaaaaagacaattcacattctgaagaattcagattctgaaactctcccacctccccactcccacctacccccgatataaatcactggactgtttgtacgtgaaacagaagaggctaagcttcctttttttacacttatgagacaaaaagtgcagtgtttggttcgtatgtttagcacatgattttcataaagaatctatatatttttgccctacagagaattgttatacaggtcaagtgtgttttcctgatgttcctatgcagttacagtatgttgaaagtgttttaacactaagaagaaaactttaaagattcatgtgattaattggatttgaggataattattattatttggtttttagatttgaaaagtagaatttccattgagacaattgatttgaataggcctgcatttgattcttcatatcaatagaaactaaaatgatttgggagattcatttgaaaaatgattgtatacttgttcacaaagcgaaaagtgatacatgaaggtaatggttatcatttaaagcccacattttacactatcaggtcacaggagtctaatttttttttcagttagataaactgaccaaacgtctattcaagaatatatgtcaatatcatcctaatgtggaaggtccgaagaaccagaaaagtgagaagggccgtttacctccctctgtagctatcacctgttggtccacagagtttcttgagaaatgagcaaacattttatgattaggtaaccctttcacatgaacgggaagatgggaaaggtggaatgaccataagagttggcctgagaccagtttgttttctggggatttggtaagataggcagttcccatgggaaattgcttaaattgctttgttgcctatgatttgattctaaacaagtggtgctatcttctccctcaatatggctgtcttgagtttgtcttgcagtatcacaccattataccaattctttgggttgcttctgacacattcaaagtgaactctggctgatgttgctgtttcaggtataccatctggagttaatttcctagcagaaggtgaaagtccaggagaattgtcctctttcattgaacatgattgaaaatgtaactggctctgaacttcaagaagatagatgcccaagtgatgcattaaagtaagggaaataaagtcaagtttttcaactgccatccatattctcattggcagaattctgatttttttccaagcactgtttggtgagcctggaagcaccgtatcctgtcccaggagtacagtgaaatttccaagcaagagctgaggtgccaataccaaaagaccatggggagtctgcacggttctggttagatcaatagaaaatccatgtgtacaactgttaattcctcatcctccactagcactaaatttgtcactttaaattttgaaaccagggaaacaccacctgtcattctgtccccattctccatagctcttcaatctttacatgccgcaagacttttttgatagctcgtactcatcccagtgtctcctgaaaccccatcatgtaatgtactgggcaccttcttttaaacaaatgtttactctgtgggtttggttcatttcaatttctgcgttctgacacatatttttttaataaagatgagaaagagaaaatgactgttgcagtacctttctagacctactttaactttacctcagatgacagtttgttaacatatatggacacattatttttaactttatgtacaatgcattcaacagaacagcaaaatttttagaaattttccattaatttctgtaacacaccatgtaaaactgttacaaataaacatgtttgagaacaaca

SEQ ID NO: 8484 - DNA, 1769 bp, Homo sapiens
cgggatctgtgtgaagtggactaaggattaagtaggatgtcaactgagacagaacttcaagtagctgtgaaaaccagcgccaagaaagactccagaaagaaaggtcaggatcgcagtgaagccactttgataaagaggtttaaaggtgaaggggtccggtacaaagccaaattgatcgggattgatgaagtttccgcagctcggggagacaagttatgtcaagattccatgatgaaactcaagggcgttgttgctggcgctcgttccaaaggagaacacaaacagaaaatctttttaaccatctcctttggaggaatcaaaatctttgatgagaagacaggggcccttcagcatcatcatgctgttcatgaaatatcctacattgcaaaggacattacagatcaccgggcctttggatatgtttgtgggaaggaagggaatcacagatttgtggccataaaaacagcccaggcggctgaacctgttattctggacttgagagatctctttcaactcatttatgaattgaagcaaagagaagaattagaaaaaaaggcacaaaaggataagcagtgtgaacaagctgtgtaccaggttcccaccagccaaaagaaggaaggtgtttatgatgtgccaaaaagtcaacctgtaagtaatggctattcgtttgaggattttgaagaacggtttgctgcagccaccccggctgtgacccaattagaactttttggggacatgtccacaccccctgatataacctctccccccactcctgcaactccaggtgatgcctttatcccatcttcatctcagacccttccagcgagtgcagatgtgtttagttctgtacctttcggcactgctgctgtaccctcaggttacgttgcaatgggcgctgtcctcccgtccttctggggtcagcagcccctcgtccaacagcagatggtcatgggtgcccagccaccagtcgctcaggtgatgccgggggctcagcccatcgcatggggccagccgggtctctttcctgccactcagcagccctggccaactgtggccgggcagtttccgccagccgccttcatgcccacacaaactgttatgcctttgccagctgccatgttccaaggtcccctcaccccccttgccaccgtcccaggcacgagtgactccaccaggtcaagtccacagaccgacaagcccaggcagaaaatgggcaaagaaacgtttaaggatttccagatggcccagcctccgcccgtgccctcccgcaaacccgaccagccctccctcacctgtacctcagaggccttctccagttacttcaacaaagtcggggtggcacaggatacagacgactgtgatgactttgacatctcccagttgaatttgacccctgtgacttctaccacaccatcgaccaactcacctccaaccccagcccctagacagagctctccatccaaatcatctgcatcccatgccagtgatcctaccacagatgacatctttgaagagggctttgaaagtcccagcaaaagcgaagagcaagaagctcctgatggatcacaggcctcatccaacagtgatccatttggtgagcccagtggggagcccagtggtgataatataagtccacaggccggtagctagatagcgcaggtctgggagccagagcctctgtacgcgcagatcaacagacctaagaaatagcatcgatgcgagctcgtggtgggtgctcaagactggcatggacatcagcatcacgacag

SEQ ID NO: 8485 - DNA, 1817 bp, Homo sapiens
cgggatctgtgtgaagtggactaaggattaagtaggatgtcaactgagacagaacttcaagtagctgtgaaaaccagcgccaagaaagactccagaaagaaaggtcaggatcgcagtgaagccactttgataaagaggtttaaaggtgaaggggtccggtacaaagccaaattgatcgggattgatgaagtttccgcagctcggggagacaagttatgtcaagattccatgatgaaactcaagggcgttgttgctggcgctcgttccaaaggagaacacaaacagaaaatctttttaaccatctcctttggaggaatcaaaatctttgatgagaagacaggggcccttcagcatcatcatgctgttcatgaaatatcctacattgcaaaggacattacagatcaccgggcctttggatatgtttgtgggaaggaagggaatcacagatttgtggccataaaaacagcccaggcggctgaacctgttattctggacttgagagatctctttcaactcatttatgaattgaagcaaagagaagaattagaaaaaaaggcacaaaaggataagcagtgtgaacaagctgtgtaccaggttcccaccagccaaaagaaggaaggtgtttatgatgtgccaaaaagtcaacctgtaagtaatggctattcgtttgaggattttgaagaacggtttgctgcagccaccccgaacagaaacctgcccacagactttgatgagatttttgaggcaacgaaggctgtgacccaattagaactttttggggacatgtccacaccccctgatataacctctccccccactcctgcaactccaggtgatgcctttatcccatcttcatctcagacccttccagcgagtgcagatgtgtttagttctgtacctttcggcactgctgctgtaccctcaggttacgttgcaatgggcgctgtcctcccgtccttctggggtcagcagcccctcgtccaacagcagatggtcatgggtgcccagccaccagtcgctcaggtgatgccgggggctcagcccatcgcatggggccagccgggtctctttcctgccactcagcagccctggccaactgtggccgggcagtttccgccagccgccttcatgcccacacaaactgttatgcctttgccagctgccatgttccaaggtcccctcaccccccttgccaccgtcccaggcacgagtgactccaccaggtcaagtccacagaccgacaagcccaggcagaaaatgggcaaagaaacgtttaaggatttccagatggcccagcctccgcccgtgccctcccgcaaacccgaccagccctccctcacctgtacctcagaggccttctccagttacttcaacaaagtcggggtggcacaggatacagacgactgtgatgactttgacatctcccagttgaatttgacccctgtgacttctaccacaccatcgaccaactcacctccaaccccagcccctagacagagctctccatccaaatcatctgcatcccatgccagtgatcctaccacagatgacatctttgaagagggctttgaaagtcccagcaaaagcgaagagcaagaagctcctgatggatcacaggcctcatccaacagtgatccatttggtgagcccagtggggagcccagtggtgataatataagtccacaggccggtagctagatagcgcaggtctgggagccagagcctctgtacgcgcagatcaacagacctaagaaatagcatcgatgcgagctcgtggtgggtgctcaagactggcatggacatcagcatcacgacag

SEQ ID NO: 8486 - DNA, 1565 bp, Homo sapiens
cgggatctgtgtgaagtggactaaggattaagtaggatgtcaactgagacagaacttcaagtagctgtgaaaaccagcgccaagaaagactccagaaagaaaggtcaggatcgcagtgaagccactttgataaagaggtttaaaggtgaaggggtccggtacaaagccaaattgatcgggattgatgaagtttccgcagctcggggagacaagttatgtcaagattccatgatgaaactcaagggcgttgttgctggcgctcgttccaaaggagaacacaaacagaaaatctttttaaccatctcctttggaggaatcaaaatctttgatgagaagacaggggttcccaccagccaaaagaaggaaggtgtttatgatgtgccaaaaagtcaacctgtaagtaatggctattcgtttgaggattttgaagaacggtttgctgcagccaccccgaacagaaacctgcccacagactttgatgagatttttgaggcaacgaaggctgtgacccaattagaactttttggggacatgtccacaccccctgatataacctctccccccactcctgcaactccaggtgatgcctttatcccatcttcatctcagacccttccagcgagtgcagatgtgtttagttctgtacctttcggcactgctgctgtaccctcaggttacgttgcaatgggcgctgtcctcccgtccttctggggtcagcagcccctcgtccaacagcagatggtcatgggtgcccagccaccagtcgctcaggtgatgccgggggctcagcccatcgcatggggccagccgggtctctttcctgccactcagcagccctggccaactgtggccgggcagtttccgccagccgccttcatgcccacacaaactgttatgcctttgccagctgccatgttccaaggtcccctcaccccccttgccaccgtcccaggcacgagtgactccaccaggtcaagtccacagaccgacaagcccaggcagaaaatgggcaaagaaacgtttaaggatttccagatggcccagcctccgcccgtgccctcccgcaaacccgaccagccctccctcacctgtacctcagaggccttctccagttacttcaacaaagtcggggtggcacaggatacagacgactgtgatgactttgacatctcccagttgaatttgacccctgtgacttctaccacaccatcgaccaactcacctccaaccccagcccctagacagagctctccatccaaatcatctgcatcccatgccagtgatcctaccacagatgacatctttgaagagggctttgaaagtcccagcaaaagcgaagagcaagaagctcctgatggatcacaggcctcatccaacagtgatccatttggtgagcccagtggggagcccagtggtgataatataagtccacaggccggtagctagatagcgcaggtctgggagccagagcctctgtacgcgcagatcaacagacctaagaaatagcatcgatgcgagctcgtggtgggtgctcaagactggcatggacatcagcatcacgacag

SEQ ID NO: 8487 - DNA, 4534 bp, Homo sapiens
atttcccctcccgtcgctgggtccctgcgatcgcccccagctggtggggctcgcggagctcaggggagcggggtcctctgcgccgctgcagcgcgagttaataaacagttaagtttggaagactctgcagacacgttgagggggagttaccaagcccaggcagcaaaaacatcctggcacattcctggggagtcctcagctgccagcatctgattagaaccatatctctcgccgggagtggccgcgcggctccgaagctcccggccggcggctatttaagcgaggcccgccgcatccgctgcgctgtagcctggaggctccgggcgcggggaagtcatgctcgcttcacggaggcaatagctagccggtgtctgtgggaggttatgtttatttgagacttctccatcgggatcgcctggtgtcaccaagtgtccactggtactgaggtttgctgcctgccttcttgccatgtctaacgaagtagaaacaagtgcaaccaatggtcagcccgaccaacaggccgcaccaaaagcaccctcaaagaaggaaaaaaagaaaggccctgaaaagacagatgaatatctcttagcaaggttcaaaggcgatggtgtaaaatataaggccaagctgattggcattgatgatgtgccagatgcaagaggggataaaatgagccaagactctatgatgaaactaaagggaatggcggcagctggtcggtctcagggacaacacaaacaaaggatctgggtcaacatttccctttctgggataaaaataattgatgagaaaactggggtaatagagcatgaacatccagtaaataagatttctttcattgcccgtgatgtgacagacaaccgggcatttggttacgtgtgtggaggagaaggccagcatcagttttttgccataaaaaccgggcaacaggctgaaccattagttgttgatcttaaagacctttttcaagttatctataatgtaaagaaaaaggaagaagaaaagaaaaagatagaggaagccagcaaagcagttgagaatgggagtgaggccctaatgattctagatgaccaaactaacaaactgaaatcgggtgttgaccagatggatttgtttggggacatgtctacacctcctgacctaaatagtccaacagaaagcaaagatatcctgttagtggatctaaactctgaaatcgacaccaatcagaattctttaagagaaaatccattcttaacaaacggcatcacctcctgttctcttcctcgaccaacgcctcaggcatccttcttgcctgaaaatgccttttctgccaatctcaacttctttcccacccctaatcctgatcctttccgtgacgatcctttcacacagccagaccaatcgacaccttcttcgtttgattctctcaaatctccagatcagaagaaagagaattcgagtagctcgtctactccgctgagtaatgggcccctgaatggtgatgttgactactttggtcagcaatttgaccagatctctaaccggactggcaaacaggaagctcaggcaggcccatggcccttttcaagttcgcaaacccagccagcagtgagaactcaaaatggggtatctgaaagagaacagaacggcttctctgtcaaatcctccccgaacccttttgtgggaagccctcccaaaggactgtccatacagaatggcgtaaagcaggacttggaaagctctgtccagtcctcaccacatgactccatagccattatcccacctccacaaagtaccaaaccaggaagaggcagaaggactgctaagtcttcagccaatgacttgcttgcatcagacatctttgctcctcccgtctcagaaccttcaggccaggcgtcacccacaggacaacctacagccctgcagcccaaccctctggatctcttcaaaacaagtgctcctgccccagtggggcccctggtgggtctaggtggtgtaactgtcacactccctcaggcaggaccatggaacacagcatctttggtcttcaatcagtccccttcaatggctccgggagccatgatgggtggtcaaccttcaggttttagtcagcccgtcatttttggtacaagtccagctgtttcaggttggaaccagccttcaccctttgcagcctcaactccccctccagtgcctgttgtctggggcccttctgcatctgtggcacccaatgcttggtcaacaacaagccctttggggaatccttttcagagcaatatttttccagctcctgctgtgtccactcagcccccatccatgcactcctctctcctggtcactcctcctcagccacctcccagagctggccctcccaaggacatctccagtgatgccttcactgccttagacccacttggggataaagagatcaaggatgtgaaagaaatgtttaaggatttccaactgcggcagccacctgctgtgcccgcgcggaagggagagcagacttcttctgggactttgagtgcctttgccagttatttcaacagcaaggttggcattcctcaggagaatgcagaccatgatgactttgatgctaatcaactattgaacaagatcaatgaaccaccaaagccagctcccagacaagtttccctgccagttaccaaatctactgacaatgcatttgagaaccctttctttaaagattcttttggttcatcacaagcctctgtggcttcttctcaacctgtatcttctgagatgtatagggatccatttggaaatccttttgcctaaattctgaacttggtctgcagaccatccagaggaataaaaaggttggccttagtagtcaaaaacaaagctgatagccagacacgttctgatttctgcccttgttccagctttgacgtattatctgttgccttatttctcattgcctcttctacttgtaaaatgcttttcactttctgtctaggttaaagctaaactgaatctatggctttaaataaattaagatcctaaactctctagcttaagtgtaaatgaagtacagtagtttccctactgaaccctgcctcttgtgtccctggaaccttctagaacacctgccttctaccctctggttgggagatgcagccaccacatcccttcatatcatactgttttgaataaattttcaaatccttattgttcagagttgtttgggggttctgtttcagagcataaaacctaaaggttatagtagaacaaggcaccttcttaaaagaaatcttgcttcagaccatcagttacagagaatttctaaagtaaaattgaagcaactacaacttctccttagacactttggaatctaaccacttaaggacctttttaaagagatagcttctcttctttctgaagatcaatttctcccaaggccaagattgtccttttctcccatttcttgctagctattgcaaatgagggaagaacattattcatctctcctccccttttttttctgattcttttttcagtcagttttgctcctgggttcaagtagtattaccaccctttcacaagcaacagactctcacagggcaaaaaaaaaaaaaaatctaatgattcacagacagatctggagcctctcttcattctcagtaattgctagtcccaagaactagaattgcaaatgggcacaacctatatccttcctgtggaagaggaggccactctcttgagctgaagttccagaagagcagttaatgttcaagagaaattgaactcaactcagcaacaaaggactctattttgaagagcaacatatcacaaagctaaatgtgattgtgccaaacacattaggtgcttatttggggtcatgctaggcctttatcaagtaactggaaaacttttcttgcagccacaatctcaatgtcgttagtaggaagataagaggggagaaaaagctgtagaacaaatgtttggggttaccattgaaaatctaatgtctgcaatatttttctcctcacaacttggaaacgttcccagttcattttcagtcctgttgtgagcacagttctgaagggtttattattgtcaaaataagttttgttttgttttgtttatgttgggtttttaatgttgtctcttgacccttaatgctcaggttcttgtgggagttaatcagccacatccaatgttaccttgagggggaagaagagggtgatgctcagaagctaaacaagacaggggccacatgaccctctattgattagccccaagtagaaagtcctgtggttttatgtttaatggtaatagttgatcatatatggcataattttctatcagcttcctactcagtcactataaacacagacttgaaatagtactttaaatgtccaaatacctaaatgtgctaaactggaggtaactatttctaggtagttgaatttttgaaagtcatgatcagccacacaactgttttgtacatacttattttctcatgcacttttctgtatgcaaataaagctataaatttactcatttcaataaactggagtggcagaat

SEQ ID NO: 8488 - DNA, 3690 bp, Homo sapiens
agtcctcagctgccagcatctgattagaaccatatctctcgccgggagtggccgcgcggctccgaagctcccggccggcggctatttaagcgaggcccgccgcatccgctgcgctgtagcctggaggctccgggcgcggggaagtcatgctcgcttcacggaggcaatagctagccggtgtctgtgggaggttatgtttatttgagacttctccatcgggatcgcctggtgtcaccaagtgtccactggtactgaggtttgctgcctgccttcttgccatgtctaacgaagtagaaacaagtgcaaccaatggtcagcccgaccaacaggccgcaccaaaagcaccctcaaagaaggaaaaaaagaaaggccctgaaaagacagatgaatatctcttagcaaggttcaaaggcgatggtgtaaaatataaggccaagctgattggcattgatgatgtgccagatgcaagaggggataaaatgagccaagactctatgatgaaactaaagggaatggcggcagctggtcggtctcagggacaacacaaacaaaggatctgggtcaacatttccctttctgggataaaaataattgatgagaaaactggggtaatagagcatgaacatccagtaaataagatttctttcattgcccgtgatgtgacagacaaccgggcatttggttacgtgtgtggaggagaaggccagcatcagttttttgccataaaaaccgggcaacaggctgaaccattagttgttgatcttaaagacctttttcaagttatctataatgtaaagaaaaaggaagaagaaaagaaaaagatagaggaagccagcaaagcagttgagaatgggagtgaggccctaatgattctagatgaccaaactaacaaactgaaatcgggtgttgaccagatggatttgtttggggacatgtctacacctcctgacctaaatagtccaacatcttcagccaatgacttgcttgcatcagacatctttgctcctcccgtctcagaaccttcaggccaggcgtcacccacaggacaacctacagccctgcagcccaaccctctggatctcttcaaaacaagtgctcctgccccagtggggcccctggtgggtctaggtggtgtaactgtcacactccctcaggcaggaccatggaacacagcatctttggtcttcaatcagtccccttcaatggctccgggagccatgatgggtggtcaaccttcaggttttagtcagcccgtcatttttggtacaagtccagctgtttcaggttggaaccagccttcaccctttgcagcctcaactccccctccagtgcctgttgtctggggcccttctgcatctgtggcacccaatgcttggtcaacaacaagccctttggggaatccttttcagagcaatatttttccagctcctgctgtgtccactcagcccccatccatgcactcctctctcctggtcactcctcctcagccacctcccagagctggccctcccaaggacatctccagtgatgccttcactgccttagacccacttggggataaagagatcaaggatgtgaaagaaatgtttaaggatttccaactgcggcagccacctgctgtgcccgcgcggaagggagagcagacttcttctgggactttgagtgcctttgccagttatttcaacagcaaggttggcattcctcaggagaatgcagaccatgatgactttgatgctaatcaactattgaacaagatcaatgaaccaccaaagccagctcccagacaagtttccctgccagttaccaaatctactgacaatgcatttgagaaccctttctttaaagattcttttggttcatcacaagcctctgtggcttcttctcaacctgtatcttctgagatgtatagggatccatttggaaatccttttgcctaaattctgaacttggtctgcagaccatccagaggaataaaaaggttggccttagtagtcaaaaacaaagctgatagccagacacgttctgatttctgcccttgttccagctttgacgtattatctgttgccttatttctcattgcctcttctacttgtaaaatgcttttcactttctgtctaggttaaagctaaactgaatctatggctttaaataaattaagatcctaaactctctagcttaagtgtaaatgaagtacagtagtttccctactgaaccctgcctcttgtgtccctggaaccttctagaacacctgccttctaccctctggttgggagatgcagccaccacatcccttcatatcatactgttttgaataaattttcaaatccttattgttcagagttgtttgggggttctgtttcagagcataaaacctaaaggttatagtagaacaaggcaccttcttaaaagaaatcttgcttcagaccatcagttacagagaatttctaaagtaaaattgaagcaactacaacttctccttagacactttggaatctaaccacttaaggacctttttaaagagatagcttctcttctttctgaagatcaatttctcccaaggccaagattgtccttttctcccatttcttgctagctattgcaaatgagggaagaacattattcatctctcctccccttttttttctgattcttttttcagtcagttttgctcctgggttcaagtagtattaccaccctttcacaagcaacagactctcacagggcaaaaaaaaaaaaaaatctaatgattcacagacagatctggagcctctcttcattctcagtaattgctagtcccaagaactagaattgcaaatgggcacaacctatatccttcctgtggaagaggaggccactctcttgagctgaagttccagaagagcagttaatgttcaagagaaattgaactcaactcagcaacaaaggactctattttgaagagcaacatatcacaaagctaaatgtgattgtgccaaacacattaggtgcttatttggggtcatgctaggcctttatcaagtaactggaaaacttttcttgcagccacaatctcaatgtcgttagtaggaagataagaggggagaaaaagctgtagaacaaatgtttggggttaccattgaaaatctaatgtctgcaatatttttctcctcacaacttggaaacgttcccagttcattttcagtcctgttgtgagcacagttctgaagggtttattattgtcaaaataagttttgttttgttttgtttatgttgggtttttaatgttgtctcttgacccttaatgctcaggttcttgtgggagttaatcagccacatccaatgttaccttgagggggaagaagagggtgatgctcagaagctaaacaagacaggggccacatgaccctctattgattagccccaagtagaaagtcctgtggttttatgtttaatggtaatagttgatcatatatggcataattttctatcagcttcctactcagtcactataaacacagacttgaaatagtactttaaatgtccaaatacctaaatgtgctaaactggaggtaactatttctaggtagttgaatttttgaaagtcatgatcagccacacaactgttttgtacatacttattttctcatgcacttttctgtatgcaaataaagctataaatttactcatttcaataaactggagtggcagaat

SEQ ID NO: 8489 - DNA, 561 bp, Homo sapiens
gctgtagcctggaggctccgggcgcggggaagtcatgctcgcttcacggaggcaatagctagccgtttttgtttggaaggaagagagccgctctgtaaaccgagaagagcagaaacaagcttccagacacatggaaagacttaaaaattatggaggggcgacttcacgaatagtaaatgttgctattgctctataaagtgacttcatgaaaaaatttctggccttagtcaggcaaagcaggggcatgggggagaaggaggtgtctgtgggaggttatgtttatttgagacttctccatcgggatcgcctggtgtcaccaagtgtccactggtactgaggtttgctgcctgccttcttgccatgtctaacgaagtagaaacaagtgcaaccaatggtcagcccgaccaacaggccgcaccaaaagcaccctcaaagaaggaaaaaaagaaaggccctgaaaagacagatgaatatctcttagcaaggttcaaaggcgatggtgtaaaatataaggccaagctgattggcattgatgatgtgccagatgcaagaggggataaa

SEQ ID NO: 8490 - DNA, 551 bp, Homo sapiens
gcacacatgaaacatggcaatgttcagggcagcatgtgattgactgccaaagtgtctcgagcaggaagtaccaagggaggatggagatggtaataatcagggttgggtggagaatatctgaggaaactgcacttgatttgggccttgaagagtaattgactggatttagatttatctagaaaggtcgttcccagcagaagcaacaagaacaacaagcttggaggtgtctgtgggaggttatgtttatttgagacttctccatcgggatcgcctggtgtcaccaagtgtccactggtactgaggtttgctgcctgccttcttgccatgtctaacgaagtagaaacaagtgcaaccaatggtcagcccgaccaacaggccgcaccaaaagcaccctcaaagaaggaaaaaaagaaaggccctgaaaagacagatgaatatctcttagcaaggttcaaaggcgatggtgtaaaatataaggccaagctgattggcattgatgatgtgccagatgcaagaggggataaaatgagccaagactctatgatgaaact

SEQ ID NO: 8491 - DNA, 651 bp, Homo sapiens
ctcagctgccagcatctgattagaaccatatctctcgccgggagtggccgcgcggctccgaagctcccggccggcggctatttaagcgaggcccgccgcatccgctgcgctgtagcctggaggctccgggcgcggggaagtcatgctcgcttcacggaggcaatagctagccgtgcaacagaaataaaccaaatgtgtttgaacatatgtcagagggctgacataatcatatgaagaatgctataccagtttggctttgggacgaaatgtgaatctactagggcaacatacaactgccctctgagtcagaagatcagaagttgctgtggctacacataattctggggtacatgtggagaacatgcagttttgttacataggtatacatgtgccatggtggtttgctgcatccatcaacccatcacctacattaggtgtctgtgggaggttatgtttatttgagacttctccatcgggatcgcctggtgtcaccaagtgtccactggtactgaggtttgctgcctgccttcttgccatgtctaacgaagtagaaacaagtgcaaccaatggtcagcccgaccaacaggccgcaccaaaagcaccctcaaagaaggaaaaaaagaaaggccctgaaaagacagatgaatatct

SEQ ID NO: 8492 - DNA, 4534 bp, Homo sapiens
gtccttatttgcacccgccccccgcccgcgtcggtctggggcttttgacttctccccgaacacatttcccctcccgtcgctgggtccctgcgatcgcccccagctggtggggctcgcggagctcaggggagcggggtcctctgcgccgctgcagcgcgagttaataaacagttaagtttggaagactctgcagacacgttgagggggagttaccaagcccaggcagcaaaaacatcctggcacattcctggggagtcctcagctgccagcatctgattagaaccatatctctcgccgggagtggccgcgcggctccgaagctcccggccggcggctatttaagcgaggcccgccgcatccgctgcgctgtagcctggaggctccgggcgcggggaagtcatgctcgcttcacggaggcaatagctagccggtgtctgtgggaggttatgtttatttgagacttctccatcgggatcgcctggtgtcaccaagtgtccactggtactgaggtttgctgcctgccttcttgccatgtctaacgaagtagaaacaagtgcaaccaatggtcagcccgaccaacaggccgcaccaaaagcaccctcaaagaaggaaaaaaagaaaggccctgaaaagacagatgaatatctcttagcaaggttcaaaggcgatggtgtaaaatataaggccaagctgattggcattgatgatgtgccagatgcaagaggggataaaatgagccaagactctatgatgaaactaaagggaatggcggcagctggtcggtctcagggacaacacaaacaaaggatctgggtcaacatttccctttctgggataaaaataattgatgagaaaactggggtaatagagcatgaacatccagtaaataagatttctttcattgcccgtgatgtgacagacaaccgggcatttggttacgtgtgtggaggagaaggccagcatcagttttttgccataaaaaccgggcaacaggctgaaccattagttgttgatcttaaagacctttttcaagttatctataatgtaaagaaaaaggaagaagaaaagaaaaagatagaggaagccagcaaagcagttgagaatgggagtgaggccctaatgattctagatgaccaaactaacaaactgaaatcggaaagcaaagatatcctgttagtggatctaaactctgaaatcgacaccaatcagaattctttaagagaaaatccattcttaacaaacggcatcacctcctgttctcttcctcgaccaacgcctcaggcatccttcttgcctgaaaatgccttttctgccaatctcaacttctttcccacccctaatcctgatcctttccgtgacgatcctttcacacagccagaccaatcgacaccttcttcgtttgattctctcaaatctccagatcagaagaaagagaattcgagtagctcgtctactccgctgagtaatgggcccctgaatggtgatgttgactactttggtcagcaatttgaccagatctctaaccggactggcaaacaggaagctcaggcaggcccatggcccttttcaagttcgcaaacccagccagcagtgagaactcaaaatggggtatctgaaagagaacagaacggcttctctgtcaaatcctccccgaacccttttgtgggaagccctcccaaaggactgtccatacagaatggcgtaaagcaggacttggaaagctctgtccagtcctcaccacatgactccatagccattatcccacctccacaaagtaccaaaccaggaagaggcagaaggactgctaagtcttcagccaatgacttgcttgcatcagacatctttgctcctcccgtctcagaaccttcaggccaggcgtcacccacaggacaacctacagccctgcagcccaaccctctggatctcttcaaaacaagtgctcctgccccagtggggcccctggtgggtctaggtggtgtaactgtcacactccctcaggcaggaccatggaacacagcatctttggtcttcaatcagtccccttcaatggctccgggagccatgatgggtggtcaaccttcaggttttagtcagcccgtcatttttggtacaagtccagctgtttcaggttggaaccagccttcaccctttgcagcctcaactccccctccagtgcctgttgtctggggcccttctgcatctgtggcacccaatgcttggtcaacaacaagccctttggggaatccttttcagagcaatatttttccagctcctgctgtgtccactcagcccccatccatgcactcctctctcctggtcactcctcctcagccacctcccagagctggccctcccaaggacatctccagtgatgccttcactgccttagacccacttggggataaagagatcaaggatgtgaaagaaatgtttaaggatttccaactgcggcagccacctgctgtgcccgcgcggaagggagagcagacttcttctgggactttgagtgcctttgccagttatttcaacagcaaggttggcattcctcaggagaatgcagaccatgatgactttgatgctaatcaactattgaacaagatcaatgaaccaccaaagccagctcccagacaagtttccctgccagttaccaaatctactgacaatgcatttgagaaccctttctttaaagattcttttggttcatcacaagcctctgtggcttcttctcaacctgtatcttctgagatgtatagggatccatttggaaatccttttgcctaaattctgaacttggtctgcagaccatccagaggaataaaaaggttggccttagtagtcaaaaacaaagctgatagccagacacgttctgatttctgcccttgttccagctttgacgtattatctgttgccttatttctcattgcctcttctacttgtaaaatgcttttcactttctgtctaggttaaagctaaactgaatctatggctttaaataaattaagatcctaaactctctagcttaagtgtaaatgaagtacagtagtttccctactgaaccctgcctcttgtgtccctggaaccttctagaacacctgccttctaccctctggttgggagatgcagccaccacatcccttcatatcatactgttttgaataaattttcaaatccttattgttcagagttgtttgggggttctgtttcagagcataaaacctaaaggttatagtagaacaaggcaccttcttaaaagaaatcttgcttcagaccatcagttacagagaatttctaaagtaaaattgaagcaactacaacttctccttagacactttggaatctaaccacttaaggacctttttaaagagatagcttctcttctttctgaagatcaatttctcccaaggccaagattgtccttttctcccatttcttgctagctattgcaaatgagggaagaacattattcatctctcctccccttttttttctgattcttttttcagtcagttttgctcctgggttcaagtagtattaccaccctttcacaagcaacagactctcacagggcaaaaaaaaaaaaaaatctaatgattcacagacagatctggagcctctcttcattctcagtaattgctagtcccaagaactagaattgcaaatgggcacaacctatatccttcctgtggaagaggaggccactctcttgagctgaagttccagaagagcagttaatgttcaagagaaattgaactcaactcagcaacaaaggactctattttgaagagcaacatatcacaaagctaaatgtgattgtgccaaacacattaggtgcttatttggggtcatgctaggcctttatcaagtaactggaaaacttttcttgcagccacaatctcaatgtcgttagtaggaagataagaggggagaaaaagctgtagaacaaatgtttggggttaccattgaaaatctaatgtctgcaatatttttctcctcacaacttggaaacgttcccagttcattttcagtcctgttgtgagcacagttctgaagggtttattattgtcaaaataagttttgttttgttttgtttatgttgggtttttaatgttgtctcttgacccttaatgctcaggttcttgtgggagttaatcagccacatccaatgttaccttgagggggaagaagagggtgatgctcagaagctaaacaagacaggggccacatgaccctctattgattagccccaagtagaaagtcctgtggttttatgtttaatggtaatagttgatcatatatggcataattttctatcagcttcctactcagtcactataaacacagacttgaaatagtactttaaatgtccaaatacctaaatgtgctaaactggaggtaactatttctaggtagttgaatttttgaaagtcatgatcagccacacaactgttttgtacatacttattttctcatgcacttttctgtatgcaaataaagctataaatttactcatttcaataaactggagtggcagaat

SEQ ID NO: 8493 - DNA, 3096 bp, Homo sapiens
catcttgcatcagcctgtggatgtatgcctaccaccgggctccttcaccagcaaagtggaaaaagaagcgtttcacaacaaattcttctttttgggttggggaaacgcagtggattatagctctgttttcttctttccaaaactgtgcacccctggatgaaacctccatcaagggagacctgcaagttgcctggggttcagtgctctagaaagttccaaggtttgtggcttgaattattctaaagaagctgaaataattgaagagaagcagaggccagctgtttttgaggatcctgctccacagagaatgctctgcacccgttgatactccagttccaacaccatcttctgagatgatcctgattcccagaatgctcttggtgctgttcctgctgctgcctatcttgagttctgcaaaagctcaggttaatccagctatatgccgctatcctctgggcatgtcaggaggccagattccagatgaggacatcacagcttccagtcagtggtcagagtccacagctgccaaatatggaaggctggactcagaagaaggggatggagcctggtgccctgagattccagtggaacctgatgacctgaaggagtttctgcagattgacttgcacaccctccattttatcactctggtggggacccaggggcgccatgcaggaggtcatggcatcgagtttgcccccatgtacaagatcaattacagtcgggatggcactcgctggatctcttggcggaaccgtcatgggaaacaggtgctggatggaaatagtaacccctatgacattttcctaaaggacttggagccgcccattgtagccagatttgtccggttcattccagtcaccgaccactccatgaatgtgtgtatgagagtggagctttacggctgtgtctggctagatggcttggtgtcttacaatgctccagctgggcagcagtttgtactccctggaggttccatcatttatctgaatgattctgtctatgatggagctgttggatacagcatgacagaagggctaggccaattgaccgatggtgtgtctggcctggacgatttcacccagacccatgaataccacgtgtggcccggctatgactatgtgggctggcggaacgagagtgccaccaatggctacattgagatcatgtttgaatttgaccgcatcaggaatttcactaccatgaaggtccactgcaacaacatgtttgctaaaggtgtgaagatctttaaggaggtacagtgctacttccgctctgaagccagtgagtgggaacctaatgccatttccttcccccttgtcctggatgacgtcaaccccagtgctcggtttgtcacggtgcctctccaccaccgaatggccagtgccatcaagtgtcaataccattttgcagatacctggatgatgttcagtgagatcaccttccaatcagatgctgcaatgtacaacaactctgaagccctgcccacctctcctatggcacccacaacctatgatccaatgcttaaagttgatgacagcaacactcggatcctgattggctgcttggtggccatcatctttatcctcctggccatcattgtcatcatcctctggaggcagttctggcagaaaatgctggagaaggcttctcggaggatgctggatgatgaaatgacagtcagcctttccctgccaagtgattctagcatgttcaacaataaccgctcctcatcacctagtgaacaagggtccaactcgacttacgatcgcatctttccccttcgccctgactaccaggagccatccaggctgatacgaaaactcccagaatttgctccaggggaggaggagtcaggctgcagcggtgttgtgaagccagtccagcccagtggccctgagggggtgccccactatgcagaggctgacatagtgaacctccaaggagtgacaggaggcaacacatactcagtgcctgccgtcaccatggacctgctctcaggaaaagatgtggctgtggaggagttccccaggaaactcctaactttcaaagagaagctgggagaaggacagtttggggaggttcatctctgtgaagtggagggaatggaaaaattcaaagacaaagattttgccctagatgtcagtgccaaccagcctgtcctggtggctgtgaaaatgctccgagcagatgccaacaagaatgccaggaatgattttcttaaggagataaagatcatgtctcggctcaaggacccaaacatcatccatctattagctgtgtgtatcactgatgaccctctctgtatgatcactgaatacatggagaatggagatctcaatcagtttctttcccgccacgagccccctaattcttcctccagcgatgtacgcactgtcagttacaccaatctgaagtttatggctacccaaattgcctctggcatgaagtacctttcctctcttaattttgttcaccgagatctggccacacgaaactgtttagtgggtaagaactacacaatcaagatagctgactttggaatgagcaggaacctgtacagtggtgactattaccggatccagggccgggcagtgctccctatccgctggatgtcttgggagagtatcttgctgggcaagttcactacagcaagtgatgtgtgggcctttggggttactttgtgggagactttcaccttttgtcaagaacagccctattcccagctgtcagatgaacaggttattgagaatactggagagttcttccgagaccaagggaggcagacttacctccctcaaccagccatttgtcctgactctgtgtataagctgatgctcagctgctggagaagagatacgaagaaccgtccctcattccaagaaatccaccttctgctccttcaacaaggcgacgagtgatgctgtcagtgcctggccatgttcctacggctcaggtcctccctacaagacctaccactcacccatgcctatgccactccatctggacatttaatgaaactgagagacagaggcttgtttgctttgccctcttttcctggtcacccccactccctacccctgactcatatacact

SEQ ID NO: 8494 - DNA, 3207 bp, Homo sapiens
aaaggcatcttgcatcagcctgtggatgtatgcctaccaccgggctccttcaccagcaaagtggaaaaagaagcgtttcacaacaaattcttctttttgggttggggaaacgcagtggattatagctctgttttcttctttccaaaactgtgcacccctggatgaaacctccatcaagggagacctgcaagttgcctggggttcagtgctctagaaagttccaaggtttgtggcttgaattattctaaagaagctgaaataattgaagagaagcagaggccagctgtttttgaggatcctgctccacagagaatgctctgcacccgttgatatgcctcccaggacccagagggagactgtagcctcatttctgtggagacctttggctggactctcctggctctcccagagactccagttccaacaccatcttctgagatgatcctgattcccagaatgctcttggtgctgttcctgctgctgcctatcttgagttctgcaaaagctcaggttaatccagctatatgccgctatcctctgggcatgtcaggaggccagattccagatgaggacatcacagcttccagtcagtggtcagagtccacagctgccaaatatggaaggctggactcagaagaaggggatggagcctggtgccctgagattccagtggaacctgatgacctgaaggagtttctgcagattgacttgcacaccctccattttatcactctggtggggacccaggggcgccatgcaggaggtcatggcatcgagtttgcccccatgtacaagatcaattacagtcgggatggcactcgctggatctcttggcggaaccgtcatgggaaacaggtgctggatggaaatagtaacccctatgacattttcctaaaggacttggagccgcccattgtagccagatttgtccggttcattccagtcaccgaccactccatgaatgtgtgtatgagagtggagctttacggctgtgtctggctagatggcttggtgtcttacaatgctccagctgggcagcagtttgtactccctggaggttccatcatttatctgaatgattctgtctatgatggagctgttggatacagcatgacagaagggctaggccaattgaccgatggtgtgtctggcctggacgatttcacccagacccatgaataccacgtgtggcccggctatgactatgtgggctggcggaacgagagtgccaccaatggctacattgagatcatgtttgaatttgaccgcatcaggaatttcactaccatgaaggtccactgcaacaacatgtttgctaaaggtgtgaagatctttaaggaggtacagtgctacttccgctctgaagccagtgagtgggaacctaatgccatttccttcccccttgtcctggatgacgtcaaccccagtgctcggtttgtcacggtgcctctccaccaccgaatggccagtgccatcaagtgtcaataccattttgcagatacctggatgatgttcagtgagatcaccttccaatcagatgctgcaatgtacaacaactctgaagccctgcccacctctcctatggcacccacaacctatgatccaatgcttaaagttgatgacagcaacactcggatcctgattggctgcttggtggccatcatctttatcctcctggccatcattgtcatcatcctctggaggcagttctggcagaaaatgctggagaaggcttctcggaggatgctggatgatgaaatgacagtcagcctttccctgccaagtgattctagcatgttcaacaataaccgctcctcatcacctagtgaacaagggtccaactcgacttacgatcgcatctttccccttcgccctgactaccaggagccatccaggctgatacgaaaactcccagaatttgctccaggggaggaggagtcaggctgcagcggtgttgtgaagccagtccagcccagtggccctgagggggtgccccactatgcagaggctgacatagtgaacctccaaggagtgacaggaggcaacacatactcagtgcctgccgtcaccatggacctgctctcaggaaaagatgtggctgtggaggagttccccaggaaactcctaactttcaaagagaagctgggagaaggacagtttggggaggttcatctctgtgaagtggagggaatggaaaaattcaaagacaaagattttgccctagatgtcagtgccaaccagcctgtcctggtggctgtgaaaatgctccgagcagatgccaacaagaatgccaggaatgattttcttaaggagataaagatcatgtctcggctcaaggacccaaacatcatccatctattagctgtgtgtatcactgatgaccctctctgtatgatcactgaatacatggagaatggagatctcaatcagtttctttcccgccacgagccccctaattcttcctccagcgatgtacgcactgtcagttacaccaatctgaagtttatggctacccaaattgcctctggcatgaagtacctttcctctcttaattttgttcaccgagatctggccacacgaaactgtttagtgggtaagaactacacaatcaagatagctgactttggaatgagcaggaacctgtacagtggtgactattaccggatccagggccgggcagtgctccctatccgctggatgtcttgggagagtatcttgctgggcaagttcactacagcaagtgatgtgtgggcctttggggttactttgtgggagactttcaccttttgtcaagaacagccctattcccagctgtcagatgaacaggttattgagaatactggagagttcttccgagaccaagggaggcagacttacctccctcaaccagccatttgtcctgactctgtgtataagctgatgctcagctgctggagaagagatacgaagaaccgtccctcattccaagaaatccaccttctgctccttcaacaaggcgacgagtgatgctgtcagtgcctggccatgttcctacggctcaggtcctccctacaagacctaccactcacccatgcctatgccactccatctggacatttaatgaaactgagagacagaggcttgtttgctttgccctcttttcctggtcacccccactccctacccctgactcatatacacttttttttttttttacattaaagaact

SEQ ID NO: 8495 - DNA, 718 bp, Homo sapiens
gctccgcgtgtgtgccccaactgtcctggaagcttcaattggaaaactccaaactttaagttttgcttatagcttcagctcaacctccatcaagggagacctgcaagttgcctggggttcagtgctctagaaagttccaaggtttgtggcttgaattattctaaagaagctgaaataattgaagagaagcagaggccagctgtttttgaggatcctgctccacagagaatgctctgcacccgttgatactccagttccaacaccatcttctgagatgatcctgattcccagaatgctcttggtgctgttcctgctgctgcctatcttgagttctgcaaaagctcaggttaatccagctatatgccgctatcctctgggcatgtcaggaggccagattccagatgaggacatcacagcttccagtcagtggtcagagtccacagctgccaaatatggaaggctggactcagaagaaggggatggagcctggtgccctgagattccagtggaacctgatgacctgaaggagtttctgcagattgacttgcacaccctccattttatcactctggtggggacccaggggcgccatgcaggaggtcatggcatcgagtttgcccccatgtacaagatcaattacagtcgggatggcactcgctggatctcttggcggaaccgtcatgggaaacaggtgctggatggaaatagtaacccctat

SEQ ID NO: 8496 - DNA, 693 bp, Homo sapiens
catctttatcctcctggccatcattgtcatcatcctctggaggcagttctggcagaaaatgctggagaaggcttctcggaggatgctggatgatgaaatgacagtcagcctttccctgccaagtgattctagcatgttcaacaataaccgctcctcatcacctagtgaacaagggtccaactcgacttacgatcgcatctttccccttcgccctgactaccaggagccatccaggctgatacgaaaactcccagaatttgctccaggggaggaggagtcaggctgcagcggtgttgtgaagccagtccagcccagtggccctgagggggtgccccactatgcagaggctgacatagtgaacctccaaggagtgacaggaggcaacacatactcagtgcctgccgtcaccatggacctgctctcaggaaaagatgtggctgtggaggagttccccaggaaactcctaactttcaaagagaagctgggagaaggacagtttggggaggtgagttgattctttgattcccttatagctcgaagaaggtggttggataaaaatgatcagtagaacaaagagtcccttccagaggtggattcacaacagaatgtctcttccatttgtctctccttgcattgtcctctggatttcagtattgggtcaacctaatctttgtcaaatagctgtggagttcc

SEQ ID NO: 8497 - DNA, 656 bp, Homo sapiens
aaacagagaagagctggtgatagctccagagctcagagaaaggaggtctctttacaagaagtctggctctcaaagcctccatcaagggagacctgcaagttgcctggggttcagtgctctagaaagttccaaggtttgtggcttgaattattctaaagaagctgaaataattgaagagaagcagaggccagctgtttttgaggatcctgctccacagagaatgctctgcacccgttgatactccagttccaacaccatcttctgagatgatcctgattcccagaatgctcttggtgctgttcctgctgctgcctatcttgagttctgcaaaagctcaggttaatccagctatatgccgctatcctctgggcatgtcaggaggccagattccagatgaggacatcacagcttccagtcagtggtcagagtccacagctgccaaatatggaaggctggactcagaagaaggggatggagcctggtgccctgagattccagtggaacctgatgacctgaaggagtttctgcagattgacttgcacaccctccattttatcactctggtggggacccaggggcgccatgcaggaggtcatggcatcgagtttgcccccatgtacaagatcaattacagtcgggatggcactcgctggatc

SEQ ID NO: 8498 - DNA, 558 bp, Homo sapiens
cttaaagttgatgacagcaacactcggatcctgattggctgcttggtggccatcatctttatcctcctggccatcattgtcatcatcctctggaggcagttctggcagaaaatgctggagaaggcttctcggaggatgctggatgatgaaatgacagtcagcctttccctgccaagtgattctagcatgttcaacaataaccgctcctcatcacctagtgaacaagggtccaactcgacttacgatcgcatctttccccttcgccctgactaccaggagccatccaggctgatacgaaaactcccagaatttgctccaggggaggaggagtcaggtgaggatgatgtggtgggcagggtgtcaagggagaaacctcagcaagcatcaggtaggtatgacacgcctgctcccagttcattgcatctatttttagtctctgctaacctcctgagaagtccacattctctttctagatttggtctgccgctgctcctggcctaatttgagcaactctcctttgctactgaatataagatgtgtggagggacccacatacca

SEQ ID NO: 8499 - DNA, 1909 bp, Homo sapiens
aaaggcatcttgcatcagcctgtggatgtatgcctaccaccgggctccttcaccagcaaagtggaaaaagaagcgtttcacaacaaattcttctttttgggttggggaaacgcagtggattatagctctgttttcttctttccaaaactgtgcacccctggatgaaacctccatcaagggagacctgcaagttgcctggggttcagtgctctagaaagttccaaggtttgtggcttgaattattctaaagaagctgaaataattgaagagaagcagaggccagctgtttttgaggatcctgctccacagagaatgctctgcacccgttgatactccagttccaacaccatcttctgagatgatcctgattcccagaatgctcttggtgctgttcctgctgctgcctatcttgagttctgcaaaagctcaggttaatccagctatatgccgctatcctctgggcatgtcaggaggccagattccagatgaggacatcacagcttccagtcagtggtcagagtccacagctgccaaatatggaaggctggactcagaagaaggggatggagcctggtgccctgagattccagtggaacctgatgacctgaaggagtttctgcagattgacttgcacaccctccattttatcactctggtggggacccaggggcgccatgcaggaggtcatggcatcgagtttgcccccatgtacaagatcaattacagtcgggatggcactcgctggatctcttggcggaaccgtcatgggaaacaggtgctggatggaaatagtaacccctatgacattttcctaaaggacttggagccgcccattgtagccagatttgtccggttcattccagtcaccgaccactccatgaatgtgtgtatgagagtggagctttacggctgtgtctggctagatggcttggtgtcttacaatgctccagctgggcagcagtttgtactccctggaggttccatcatttatctgaatgattctgtctatgatggagctgttggatacagcatgacagaagggctaggccaattgaccgatggtgtgtctggcctggacgatttcacccagacccatgaataccacgtgtggcccggctatgactatgtgggctggcggaacgagagtgccaccaatggctacattgagatcatgtttgaatttgaccgcatcaggaatttcactaccatgaaggtccactgcaacaacatgtttgctaaaggtgtgacctctcttaattttgttcaccgagatctggccacacgaaactgtttagtgggtaagaactacacaatcaagatagctgactttggaatgagcaggaacctgtacagtggtgactattaccggatccagggccgggcagtgctccctatccgctggatgtcttgggagagtatcttgctgggcaagttcactacagcaagtgatgtgtgggcctttggggttactttgtgggagactttcaccttttgtcaagaacagccctattcccagctgtcagatgaacaggttattgagaatactggagagttcttccgagaccaagggaggcagacttacctccctcaaccagccatttgtcctgactctgtgtataagctgatgctcagctgctggagaagagatacgaagaaccgtccctcattccaagaaatccaccttctgctccttcaacaaggcgacgagtgatgctgtcagtgcctggccatgttcctacggctcaggtcctccctacaagacctaccactcacccatgcctatgccactccatctggacatttaatgaaactgagagacagaggcttgtttgctttgccctcttttcctggtcacccccactccctacccctgactcatatacacttttttttttttttacattaaaga

SEQ ID NO: 8500 - DNA, 2516 bp, Homo sapiens
agctggtagagaagtaagcctgcttggcaaccacctgcagggctgcagagatgaattacattttcggaaacaacacacttctatactctcgcggcagtcgaggaggcaatactagctctagccatggctcagcaggcccaaagcagaaacactgggcaaaaaagggctcgtcagatgaactgcaagctgagccagaaccttcacgctggcagcagatagttgcatttttcactcgaagacacagctttattgactgcatctcggtagccaccagctccacccaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaaggggagatccctgacgacatgggatcaaaaggcctgaagcatgtaacttctaatgccagcgatagtgaaagtagttacctaatcttgattacagatgagtatggctgctcaaaaggtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctt

SEQ ID NO: 8501 - DNA, 3053 bp, Homo sapiens
atcagctaacaaaagaacagcttttggttcctgcagacgctggtgaaaaaataatcatgagaaagaaatccaccttatgtcgtcttttttgtctgcaaaaataaactcagccatcatacagctaacaggtacagagggaagatacgagctctttcataggaagaaatcactgagaaaatgagcatcatttctcaaggtttttattttcactgatctacaagtgatgctgctgtaattgtagctgcagtttttaccgatcattcaccactcagcagctggtagagaagtaagcctgcttggcaaccacctgcagggctgcagagatgaattacattttcggaaacaacacacttctatactctcgcggcagtcgaggaggcaatactagctctagccatggctcagcaggcccaaagcagaaacactgggcaaaaaagggctcgtcagatgaactgcaagctgagccagaaccttcacgctggcagcagatagttgcatttttcactcgaagacacagctttattgactgcatctcggtagccaccagctccacccaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaaggggagatccctgacgacatgggatcaaaaggcctgaagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggagtctttcttgagtactgatttcatgttgaattgtatcccacacatcatggtctgcagcttctttttcacatgtagtgtctccttcaagttacatcgtgtgtattatttaatgtcactattggttagtggccatttttcagaactgaagatggaatggcctgaccagctattaagaacgtggggagacgcagaaattgtggtaaaattccttaatgtttaagggaaagtaactttaagagatttttggaaaagctttatatacattcttttcaaatttcagtacaaatgaaa

SEQ ID NO: 8502 - DNA, 5074 bp, Homo sapiens
ggggctgaggaggcgagggcagcggagtttcctgccctgagatagttgcagcccgctctgctgcaaccatttcaaattagagaagaaagcagttcagccggtggggctggcgggactctgaccggcccggtggcctcgccggcaacggccccgccccgctggcggcagcggcggcggcagcggctgcgcggggcctggaactggtcgggccggctggggttccgggggacaggtttgcagggtggggcccgagaggctggcgggcaggcagcagtggagccggaagggtaggcagccaggggagagagagaggagctatggagagggcccgcaagttctcgggctccggcttggccatgggcttgggctccgcctccgcttcggcctggaggagggcttcgcagaggtgggcctggccgctccgctccctgcggcccggaggggatgccagagagcctcgcaagatcatcctgcacaaaggctccacaggcctgggcttcaacatcgtaggaggagaggatggagaaggcatttttgtctccttcatcctggcaggaggcccagctgacctgagtggggagctgcgcaggggagaccggatcttatcggtgaatggagtgaatctgaggaatgcaactcatgagcaggctgcagctgctctgaaacgggccggccagtcagtcaccattgtggcccagtacagacctgaagaatacagtcgctttgaatcgaagatacatgacttacgagaacaaatgatgaacagcagcatgagctctgggtctgggtccctccgaacaagtgaaaagaggtccttgtatgtcagggccctgtttgattatgatcggactcgggacagctgcctgccaagccaggggctcagcttctcttatggtgacattctgcatgtcattaatgcctctgatgatgagtggtggcaggcaaggctggtgaccccacacggagaaagtgagcagatcggtgtgatccccagtaagaagagggtggaaaagaaagaaagagctcgattgaaaactgtgaagttccatgccaggacggggatgattgagtctaacaggtcgatcaaaacgaaacgtaaaaagagtttccgcctctctcgaaagtttccattttacaagagcaaagaaaacatggcccaggagagcagcatacaggaacagggagtgacatccaacaccagtgacagcgaaagcagttccaaaggacaagaggatgctattttgtcatatgagccagtgacacggcaagaaattcactatgcaaggcctgtgatcatcctgggcccaatgaaggaccgagtcaatgatgacctgatctccgaatttccacataaatttggatcctgtgtgccacatactacccggcctcgacgtgataatgaggtggatggacaagactaccactttgtggtgtcccgagaacaaatggagaaagatattcaggacaacaagttcatcgaggcgggccaatttaatgataacctctatgggaccagcatccagtcagtgcgggcagttgcagagaggggcaagcactgcatcttagatgtttccggcaatgctatcaagagactgcagcaagcacaactttaccccattgccattttcatcaagcccaagtccattgaagcccttatggaaatgaaccgaaggcagacatatgaacaagcaaataagatctatgacaaagccatgaaactggagcaggaatttggagagtactttacagccattgtacagggtgactcactggaagagatttataacaaaatcaaacaaatcattgaggaccagtctgggcactacatttgggtcccatcccctgaaaaactctgaagaatcccctccaaccattctcttgtgaacagaagaaatcaagtccctcttccctcctccctcttcattcctgtccccatggggagaacaaatgctactgttcttgtccccttttttagatatgtcaaaaaaaattaagttttctagtcctgttctttttttttttttaagtttttgtttgtttcagtttattttttgggatgatgccatctcattcatcatgtgactgtgcccattcctgcatggacctttcccaagcgctagcacaggtgcaaaatccatcagagccattgttttcataaaaaccaagcagaagtgaagagaaaagaggaggactgatggaaagacagactctggacagctgcacggcttgtgaagtgagctaaatgcaccacatgatgagatgctcctgggcatttctccctatctgtactgctgtcttgcagctctgaacggtgcaacgtaatggcgacagaaagtatcttatttatatatagatatatatatgtaatttatataaaatatatagaaattattatatatatatattatacactctcatataatatatatatattcacacacatttgggttagaaaatctatggagacttcatcaatggtactatgttattagagaaatgctttaattttcatattccaatcagatggcatcttctatcccagctggttgggaagggattgaagatggtagcaagtgctgcactaagggcactcgcatttggtcattctcttgagagctaggaggggtcagcctgaggccggagaggaagggcttttgcctggggtgagagggtgagagacttgacctgaaagcagctgctgcccctgaggtgcagccagagtcctgtgtgcggacagagagaatggctaatgatgctccgcgtggaattgcctattgttttatgccacctgatgtgtctgcatgagaggtttcctttttgttcctttttaagctgctgttaaaccaaaaccatgttgtgctactgtgtcagccttttcattattgcaaattttacttttactatttaagtgaatgcatagaatccaatttgccaaggttctaaaggcttatgaggtcctgaaggagccaggccttgtgatggagtaggtgacacaggcctggttgtcctgtcagcagaagggaaagcaggggctgggctgagaggaggacacggagggctctgctgaggttccttcctgggttccaccaacagggacagggagtcacttgccttccagttctgtgctgggatggcgggacagcacttggcttgcttggccagctgcgtcatgagtttgatttggtttttttttttttgcagctgcttcatatgctctgctccagcccctccccaacagctggtagcttatggtttcttcaagaggaaagtagactttatgctgtacatttgagctgtagagctaagattcgcttactggtgagctgtgaaaccttgttgctttttcccagagtctgatggcagtgactgtgatcaagggaatcttcaccgccacaagtgcaggcagcaggtgtggttcaggtccccccccaccccactgtgctcctttgaagccaacgtgcctccctcgcctccatactggagggacgacgcaggggagaacagagaagtgcttggccctaggattgaggcacttgtttcctagcccgctgggttagggctggtgcaagcgaggcaatgttgaggatgctttaagcactaccagccgaatccgggaactctgttaacagttgtccaaccagcagaatgaggctaactgtataaagcatgggacccaggatgaggataaggaaaggacagcggctttccctgggcagtacaatggcttgaaggcaaaaagggataaagtgacagccgactgtgactctggtgaggaggggtgagcagggaggttgattctctgatgttaactaagtggcaaagtctcaaccgtgctcagccctccccctcccagggaagagaaacaaagattcaaagtaagcatgatactagtgggtttaccagtgtttcttccaaggagacatatattttttaataaacgatagttgcaatgaactgtggctcagagaccttcttaaagtagttgagaagggagggcgtgggcaaagcagtgggaagaacatcccaaacttttgggggccagagggctctctccttagtgatgatcagctagccgagctgggccgtcctggggatcggtacagctccctggggtggtgacaggccctttgtgaaagttgtgtgcttggtcttccaccccagccccagacactgcttcaaatagcaccaaccagatgggagtccacatctgtggtggcaaaatgctgacattttcccaagaggtacacaaggtgggagaggcctgctgtagcagaggtgtgtgttagagaaagcaggggcctgatttagtagcagagaactgggtgagaaaaatggccagagaaagtgacctgccagctaccagtgtttccgaaaatgagggtgggatgggcccatttgcagagcaggacagcagtcatccccatagccctctgaggaggggagggatgcttagagcaggcagttctggcagttctgacgtggcaggtgccattgcaacttgtgcggaggagtcttaggaagtgctgtcataattcataaggtcaagagcaacatctggatgaatgagccacctgaaatgtgtgtgggctgagccacaggaagggtgagtcctcttgcttgtggtgctttatggtgtgcaggttgcttgctttcccacattctctcatttgcttgaaggcagcctaacaaaagggagtccccaaagagctccatgagagcttaagaaaattcatctcctgaggacaaagagaacaaagatctgtcctgtggtcacactgttgaggctctgtcttcacagctgatgttctcctagtggaggtacagctgaagaacattcagccccagcacgagaagatacagagcaacttggaaaccccaaagggagacacacccttaacactgccgtgctgtgctgtgccgtgtcctgaaggaggagagagccctatctcctcctggttttgttgctgacattgcagctgatcatgccttgactccttcatctctaacagaggaagaactgtattatcaaaccttatggtctacccatgaataaataaaatatttgttcaagcac

SEQ ID NO: 8503 - DNA, 10090 bp, Homo sapiens
gaggaagaagctggagacttggtccagccgggcatcagctttccggggccggcagaggaggatctagacccgcagtactcatggtcgcccacgcagcacttcaatgaggagcgctactcgcccgcgcccaggagcatgaagggcctttccggaagtcggacccagccgccgctgtgttccgggcacacgtgtggtctggcgcccccggaggactgcgagcacctgcaccacgggcccgacgcgcggccgccctacctgctgagccccgccgacagctgccccggggggcgccaccgctgctcgccgcgcagctcggtgcactcggagtgcgtgatgatgccggtggtgctgggcgaccacgtgtccagcagcaccttcccgcggatgcactacagctcgcactacgacacgcgcgacgactgcgctgtggcccacgcgggcgccaagatcaaccgcatcccggccaacctgctggaccagttcgagaagcagctgccgctgcaccgggacggcttccacacgctgcagtaccagaggacgtccgcggccgccgagcagcgcagcgagagccccgggcggatccgccacctggtacactccgtgcagaagctcttcaccaagtcgcactcgctggagggctcctccaaaagcaacgccaacggcaccaaggcggacggccgggcggacgaccaccaccacgcccaccacgccaagcacagcaagaggagcaagagcaaggagcgcaagccggagggcaagccccggcccggcatgagcagctggtggagctcggacgacaacctggacagcgacagcacctatcggacgcccagcgtgctcaaccggcaccacctgggccccgtggcccactgctaccccgacgcgctgcagagccccttcggggacctgtccctcaagacctccaagagcaacaacgacgtcaagtgctcggcctgtgaggggttggcgctgacgcccgacgccaagtacctgaagcgcagctcctggtctacgctgacggtcagccaggccaaggaggcctaccgcaagagctcgctgaacctggacaagccgctgctgcaccaggacgccaagcccgccctgaggccgtgccactacctccaggtacctcaggatgagtggggagggtaccccaccggtggcaaagatgaggagattccctgcaggagaatgagaagtgggagttacattaaagccatgggggacgaggagagcggagagtcagactccagccccaagacatcaccaaagtcggcaatcctaccagagccgctgctgaagtccatcggacagagaccgcttggagagcaccagacccagacctacctgcaagctgcaagcgatgtgcctgtgggacacagcctggaccccgctgcgaactacaactccccgaaattccgctcccggaaccagagctacatgagggccgtcagcaccctgagccaggccagctgcgtgagccaggtgagcgaggcggagatcaatgggcaattcgagtccgtgtgcgagtccgtcttcagtgaagttgaatctcaggccatggatgccctcgacctcccgggatgtttccgaacaaggagtcacagctaccttcgagccattcaagccggctactcccaagatgacgaatgtattcccatgatgacaccctctgacatcacctccaccatcaggtcaacagcagctgtctcatatacaaattacaagaaaacgcccccaccggtgccccctcggaccacctccaagcctctgatctcggtgacggcgcagagcagcaccgaatccacccaggacgcctaccaggacagccgcgcacagaggatgtccccgtggccccaggacagccgcggcctctacaactccacggacagcctggacagcaacaaggccatgaacctcgcgctggaaacggccgctgcccagcgccacctgccagagagccagagcagctctgtgcggaccagcgacaaggccatcctggtgtccaaggcggaggagctcctcaagagccgctgctcctccatcgggattcaggtggaaacggccacagattctgacacggagagccgcggtctgcgggaataccactctgtcggggtgcaagtggaagatgagaagcgacacggacgttttaaacgttctaacagcgtcacggccgccgtccaagctgacctggagctggaggggttcccaggccacatcaccacggaggacaaaggccttcagttcggctcatccttccagcggcactccgagcccagcacccccacccagtacagcgcggtgagaactgtacggacccaggggctcttcagctatagagaagactatcggacccaagtggacacctccaccctgccccctccagacccctggctggagcccgccatcgacacggtagagactgggaggatgtctccgtgccgcagggatggctcgtggtttttgaagctgctgcacgcagagacaaagaggatggaaggctggtgcaaagagatggagagagaggcggaggagaacgacctctcggaggaaattctcggtaaaatcaggagtgctgttgggagtgcccagcttctcatgtcccagaaattccagcagttttattggctttgccaacagaatatggaccccagcgccatgccgaggccgacgtcgcaggacctggccggctactgggacatgctgcagctctccattgaggacgtcagcatgaagttcgacgagctgcagcggctgcggctcaacgactggaagatgatggagtccccggaaagaaaggaagaaagaaaggtcccgcctccaataccaaagaagcctcccaaggggaagtttcccatcacaagagaaaaatccctggacctgcccgacagacaacgccaggaagcccggaggcgcctcatggccgccaagcgagcggcgtccttccggcagaattccgcctccgagcgcgcggacagcatcgagatctacatccccgaggcccagacccggctctgagggcggaggccggcgccttcccctcgtcgcttccgctttcccggacgcttgtgcagcgcggcgccgccctggtggtttctgtctcctcctcccgctgaacacgtcctcgctcccgcgctccccgcgccccggacacagcgggacgcggccggcggcctcagagtccacggagctcgcggcgaggacgacttctgcttttgttgttgttgttgttgttcacgggtggcctggctcacacttggctctgagggacaggtgtggcgagacctgatttctcctgcgtgttctcagaggacggcgagaaatgcctctggagctggaacccagcttacattttgttatttctatttttataaattgtgtgataattagaggtaagaataacaagtaactataaacgggtgcatcccaccactccctggaggcattagacacccaagtggaaggtgctacaacctgaagcgcaggaaagaaaggcccattcccctcgcacagccgagcttttactccctgagcacgggccgctccgctcccctgctcctgtctgtctcggacagaaaacacgaggctccttgtgtcaagcttcctgtgatggaaagcgacctctccaaccaccacactccccgccgtacagttctccagaatcccaggcgatgacaagtctgaacccacgaaaatacccagcgcagcatctacacattcaaaagataagctgagtgttcccaccaggaagtcacgcgcagagaggagagtcttacggagggctgggagcttaaaaggaaaacaatgtccttacttgtaaacagttattgtattttttatttctttctaacttaaaatacgacacccagtattttctttaagtttcaccatttacgctacatgtgatttttttaatgtatgtatatatatatattctcaaattgctctatcagctgacttttcagggtatccttaaaaaaaaacacacacgaaaaacaaaagtttgcttgtttaaaatgacagttgtgatgtaaaaagtttaagaaatatgaatgtgagtggtaagtatatctcagtttaaatggtaaagaagaaatgtagtttacatttgtatttttccagaattcttttgtcctatgcagtattgctaaagtcgagaatatattccttgcctgtgttagacatgaagggaaaaagaggtcacatattgtgatttccagctgtagcattcaaaaaaaaaattggtgttcatgactctgtggtcggtgccagaggaaaataggaacgactctaattaataggctttctgtgtatataattaaatttagctgctgcaaccattgttctgacacgacttctgtttcacagttcagaccggtcttcaaaggaaaagcctgtccgatttttccatgggttccagtttcagagttctcattattactcaaagtaaaagcggactgcgatttaagatgtttccaccccaatacctggtcttccttcccggcttaaggagtaccatgtacttagccacaggcagaatagctttcgatgaccccatagcactttgtttcttcgccttgatttgcactttacaatgtccccagcccctctgcagcccgtggctggcagggcgttcgatgtgcggttggcccccagcgcgccctccagagctgcggtgtctccctgcctcattccccacatcccactgagcatgggaccattgggagcagagctgatattaaagcatgtttagcttcgaagttttacttttttaaagctgagtagttaagaattccctgtaaaaacaaaaccctgtaaattgagcctcatgtctggtatatattttaccaaacagccttaaaatatatttggaagcaaaaatcagtacgaatgtatctccttgaaaaatgcaaaaaaaaaaaaatccctgaaatattcttctataaatgaatcctatttccccagagtgttcaaggcatttttctacctaaatgaatacctaaatcttgagtagtgtacggtaatgacgcttcttcctatatccactcttattatgttaaaacaaatgtatttgcgagtattggcattttagactttaaaaatgctgtatgatttcagatgaactctgctgtttagaagtaaccacagaaaagcaaagtcagtgtacactctgagtgaaaggaaatgtaatgtggataaaggcccgccacctcctcacattggtctatctactggcagctgatacgtttaactcatttccttgagcttatacaaaacatagaaaagcaaactgttaaagtagtcaataattatttgtctcagatcccagattctatgatccctgcttaaaagaaaatgttcactgcatgtaggttgatttcttatgttttgtagactcattgttatttttcaatccccaaaagtcttggcctaaaccatccctaggggagcagattaacctaccactacattgcacagggttggtgactcgacgtggtgaatgtgcacacgccctgcctggtccgccatgttccaaagaagatgatttaatggtagaacggatacctgctgctagacctgatggaatgttacctgtccgtgttacataatcaagtgcaatatactcagttctcatgcaggtgacattctaccatgaaacgcagaagataagccatgtttctgtattgtacatgtaaagaaaaataaaactgtttatgatacttgtgttagtcactcgagctagcttatttcagccacttctagcagatcatgccatggagctcacgacgtgtgaccatttcgtcatatttaaaatataacttcaagaaaagagtaaacatccattggagaacacggctgaaaattattgtgctgttctaggaacatcatcctagagagtgtgatgttcactataaccccatacctacattccctaatgatacagccaatgacaggtgaaacccagacactctccttagagccgacaggttgatcctgctgtgttgaaggctgtggttaataaaacacaagtatgataaacaggacctagcgtttagcccgggaaaggagaatgctgcttgtcacctagagtgctttccttgtgatgcgtctctcgcatcttcacgtgttgttgtgtttgaagtaaaactagttgttatcgatgacaatttttaccatagttttctcagcaaatttatatcaccatcttagaatggtatataaaaaaattgaactgtttatgataccaaaaaaattacagttttgtttaaaaggaaatgttgatgttttcaactccaaatcaattctaaaaacttcaagcacttaatggaaaggtaaatggtcagataaaaatataattacctgtaaggttatctggttttaaaagaaaaaaaaaaagcctacaaactcagtgacctactacgcagagggaatttttccctgctgcttcttatgaaagtggccaggtttattattagaagacacagtggcagagcacacatgtgcacaggttctgattatttctcttggagcatatgtccttgtcttgatttttgccttttcgatgccatattaagcagccaccgtttccacccctttcattagaaggccctgcatccgtaaattcgcgcatctctgtttttgttagatccttgtaagcatcgctacccgagtccaggatggaatttcacaggaaagtgaagggatactgcaggcctgtgtttgcagcgcctgtggtaactgtggaatgagctctgttagggacagttgtctggtttgtgccaaaccttcgaggggcgagtagggagtgggggaggtgggtccaagtctccctcaggaaggccttttctatcggcagcaattccatcaagccaagcctcctgtggtcctgagcatgaaggggccaggggacctcctgggagatgcagcttttgtttccgctgcgtttcatcagtcagccttgcttggaattctggcaggttccccggggtgtttcagtggacaggaggcccccgtgccgtggctgagtcagcctgggtaccccagtcaccagcagggccacccttgatgacagggccccccacgaacctgggaaaggcagcgggaaatgtgtgagagggtgtgcgctggtacggacataaaagcattgtccaaaacagcgctggttcggggagggcccctggatactgcctttggcccacactgaaaactgaaattgccccacctgtgagcacagaaacacgcttctccaacacgggccgaaataactaaactccacatggttcctgcctgctcatttcccagccctcttcttctcaagcctgaacttcatttttttttttagctgcaaatttaacaggctaatttaaaactgcagttttcagacgacagcccctgggaatgttccagggttctcttgttttgatctgcatgtctgtttacacttctctgtaggcgtgggttgaatacaagtttccaaaactttaaaatagaaaaccacgagcttaagaggtgaaaaagatgacccctttctgattaggatctgtaactctgtgggctgggtcaatgcagtgtgcttcattcagggccatgtggcagccatgacacacaccacataaggtcagctcagagcccatggcttccctgcaggagccccatcttgtcgctattagttgggagttgcaatacattgttggccataaacaaagtgctaaaggaaagggtttgcttctacacattcggctgaatgtcccccagtgcagggtggcagcagaatgttctggaaatgaaggagatattgctaggaatctctaggctgttaggcaacctggcttttattcatcctcagccggcaactcatctcaagtttatgtctcagtttttttcctctagaaaggggattacagttcctgtccctgtcttcctccaggacacactgtgaggattaatgacatattggctctaaagtcctttgagctcctgggaacaggtggtgaaagtgtgcgttactgctaaggattagtccctggcctcttctagaatgccgccctcccagctctgcagggcacgctgccagaatccaggctggtcgtaaacatctcagagataatcagggaccaccagaggcagaggccatgagactgtctttggaaaggtttggaaatgcagaaataactacaagggccattctccttagcttctggctttcaactgtttctagatgcttccaagaacaagaacccagcaccaaccagaattaggccacgttttcaccattacttaagctcaatcgcctcttagatgaaatgaggagataaactaaacattaaaatgatgaaggaaaaaaaattatttggaagccgaaaaccgcatgggtggggaaacatcaggaacgaaatcagacacactgactcaaaccacgcaagggtttgagaagcccacccctctaattccaggcgtttgtaatttttctacttcgcacttgagagaaggcagaggtggtccgtgggaaagctccgggaaacagccgtctttcatccttgccacattgaaaaatgtccacaattttatgaattgctgtcctaaccctggcgtttttatccagtgttaaaataaattatttcaagtttcaatgtaaacacttaacagatgacttctttgcagaagaaatgttcgttacctactatcaaactactttttaacagattttgtatatacacacacaagttgacagaggtttacctccctactttcttagattttatgtaactcttttcattggtgcttattcagaacctgaaagccttgggcatccaagctttcacctactcaatggaggagaggtgataatgaatgaaaagattgacaccaggtttcttggacaaatttaagttcaaatttatctctttcaagtagaccatggtctccctagagagtgtgttggcttgtgtctgccagtacgacaaaggacgctcccagcttgatcgtggtaccttatggaagccactcacgcattctctgatttacccccaaaacactaccatgccccagccccactcatttaaataatacaatcatatcactttcaaagggctcagcacgaatgttcccctcactccactttttaactcgtttgctgaactcgacaaggcttccccttacgagcagtgagacctaggctactttcgaacgcttccttccgaacggtaagccacttcgctctcgggcaggacaggtcctccctgcagagagagacaactcatcccccgaccttccatactacagaccaaaatacccaggtgtggcctaaggactatattaaatgcctcctatagaaattcaaggaatgttagaaccaggaaactagctgtttaaagttttaaagaagtatataaatatatatataaatataaatatgaaatcatatcgagtgtgaggatgagcagagtgccaaatattcagcatctgtacaaagtcattcactggaattcaactattttatgtcattctctttctcacgcttttatggttcttttgataaattctatttagtagcatgcaggatacctaatctgaatgtgcaatatgctattcatcaccacgacaatttcttacttcctcttaataacttaccagaatgttggtcattcctttaaggcagttaaggattgctttatttgtgttcttttttcccatgactttttttcactctcagctgactgtaagaaactgtgcaccgtttccgccataaccgtcctgtgacgatgcctccatttgacttctgtatcgctgatgttcacctcctgtaaatagtttggcaattaaattttttgagaaaagtaatgtttacttttttattggagtgaattctcgtgttattttaatctcagaaaaattatatagaccaaagagttttatccgaaaaaaaattacactcttcctccattatatatttcattgttgaaatatcctcaatttctctatattttaagaagtaatggacatttattaaggttacagatttaatatgtatgcaaaatggtatagattaaatgagtttttaattaataaatcctacagtatttagtta

SEQ ID NO: 8504 - DNA, 10132 bp, Homo sapiens
aggaagaagctggagacttggtccagccgggcatcagctttccggggccggcagaggaggatctagacccgcagtactcatggtcgcccacgcagcacttcaatgaggagcgctactcgcccgcgcccaggagcatgaagggcctttccggaagtcggacccagccgccgctgtgttccgggcacacgtgtggtctggcgcccccggaggactgcgagcacctgcaccacgggcccgacgcgcggccgccctacctgctgagccccgccgacagctgccccggggggcgccaccgctgctcgccgcgcagctcggtgcactcggagtgcgtgatgatgccggtggtgctgggcgaccacgtgtccagcagcaccttcccgcggatgcactacagctcgcactacgacacgcgcgacgactgcgctgtggcccacgcgggcgccaagatcaaccgcatcccggccaacctgctggaccagttcgagaagcagctgccgctgcaccgggacggcttccacacgctgcagtaccagaggacgtccgcggccgccgagcagcgcagcgagagccccgggcggatccgccacctggtacactccgtgcagaagctcttcaccaagtcgcactcgctggagggctcctccaaaagcaacgccaacggcaccaaggcggacggccgggcggacgaccaccaccacgcccaccacgccaagcacagcaagaggagcaagagcaaggagcgcaagccggagggcaagccccggcccggcatgagcagctggtggagctcggacgacaacctggacagcgacagcacctatcggacgcccagcgtgctcaaccggcaccacctgggccccgtggcccactgctaccccgacgcgctgcagagccccttcggggacctgtccctcaagacctccaagagcaacaacgacgtcaagtgctcggcctgtgaggggttggcgctgacgcccgacgccaagtacctgaagcgcagctcctggtctacgctgacggtcagccaggccaaggaggcctaccgcaagagctcgctgaacctggacaagccgctgctgcaccaggacgccaagcccgccctgaggccgtgccactacctccaggtacctcaggatgagtggggagggtaccccaccggtggcaaagatgaggagattccctgcaggagaatgagaagtgggagttacattaaagccatgggggacgaggagagcggagagtcagactccagccccaagacatcaccaaagtcggcaatcctaccagagccgctgctgaagtccatcggacagagaccgcttggagagcaccagacccagacctacctgcaagctgcaagcgatgtgcctgtgggacacagcctggaccccgctgcgaactacaactccccgaaattccgctcccggaaccagagctacatgagggccgtcagcaccctgagccaggccagctgcgtgagccaggtgagcgaggcggagatcaatgggcaattcgagtccgtgtgcgagtccgtcttcagtgaagttgaatctcaggccatggatgccctcgacctcccgggatgtttccgaacaaggagtcacagctaccttcgagccattcaagccggctactcccaagatgacgaatgtattcccatgatgacaccctctgacatcacctccaccatcaggtcaacagcagctgtctcatatacaaattacaagaaaacgcccccaccggtgccccctcggaccacctccaagcctctgatctcggtgacggcgcagagcagcaccgaatccacccaggacgcctaccaggacagccgcgcacagaggatgtccccgtggccccaggacagccgcggcctctacaactccacggacagcctggacagcaacaaggccatgaacctcgcgctggaaacggccgctgcccagcgccacctgccagagagccagagcagctctgtgcggaccagcgacaaggccatcctggtgtccaaggcggaggagctcctcaagagccgctgctcctccatcgggattcaggattctgaattcccagagcatcagccatacccaaggtcagatgtggaaacggccacagattctgacacggagagccgcggtctgcgggaataccactctgtcggggtgcaagtggaagatgagaagcgacacggacgttttaaacgttctaacagcgtcacggccgccgtccaagctgacctggagctggaggggttcccaggccacatcaccacggaggacaaaggccttcagttcggctcatccttccagcggcactccgagcccagcacccccacccagtacagcgcggtgagaactgtacggacccaggggctcttcagctatagagaagactatcggacccaagtggacacctccaccctgccccctccagacccctggctggagcccgccatcgacacggtagagactgggaggatgtctccgtgccgcagggatggctcgtggtttttgaagctgctgcacgcagagacaaagaggatggaaggctggtgcaaagagatggagagagaggcggaggagaacgacctctcggaggaaattctcggtaaaatcaggagtgctgttgggagtgcccagcttctcatgtcccagaaattccagcagttttattggctttgccaacagaatatggaccccagcgccatgccgaggccgacgtcgcaggacctggccggctactgggacatgctgcagctctccattgaggacgtcagcatgaagttcgacgagctgcagcggctgcggctcaacgactggaagatgatggagtccccggaaagaaaggaagaaagaaaggtcccgcctccaataccaaagaagcctcccaaggggaagtttcccatcacaagagaaaaatccctggacctgcccgacagacaacgccaggaagcccggaggcgcctcatggccgccaagcgagcggcgtccttccggcagaattccgcctccgagcgcgcggacagcatcgagatctacatccccgaggcccagacccggctctgagggcggaggccggcgccttcccctcgtcgcttccgctttcccggacgcttgtgcagcgcggcgccgccctggtggtttctgtctcctcctcccgctgaacacgtcctcgctcccgcgctccccgcgccccggacacagcgggacgcggccggcggcctcagagtccacggagctcgcggcgaggacgacttctgcttttgttgttgttgttgttgttcacgggtggcctggctcacacttggctctgagggacaggtgtggcgagacctgatttctcctgcgtgttctcagaggacggcgagaaatgcctctggagctggaacccagcttacattttgttatttctatttttataaattgtgtgataattagaggtaagaataacaagtaactataaacgggtgcatcccaccactccctggaggcattagacacccaagtggaaggtgctacaacctgaagcgcaggaaagaaaggcccattcccctcgcacagccgagcttttactccctgagcacgggccgctccgctcccctgctcctgtctgtctcggacagaaaacacgaggctccttgtgtcaagcttcctgtgatggaaagcgacctctccaaccaccacactccccgccgtacagttctccagaatcccaggcgatgacaagtctgaacccacgaaaatacccagcgcagcatctacacattcaaaagataagctgagtgttcccaccaggaagtcacgcgcagagaggagagtcttacggagggctgggagcttaaaaggaaaacaatgtccttacttgtaaacagttattgtattttttatttctttctaacttaaaatacgacacccagtattttctttaagtttcaccatttacgctacatgtgatttttttaatgtatgtatatatatatattctcaaattgctctatcagctgacttttcagggtatccttaaaaaaaaacacacacgaaaaacaaaagtttgcttgtttaaaatgacagttgtgatgtaaaaagtttaagaaatatgaatgtgagtggtaagtatatctcagtttaaatggtaaagaagaaatgtagtttacatttgtatttttccagaattcttttgtcctatgcagtattgctaaagtcgagaatatattccttgcctgtgttagacatgaagggaaaaagaggtcacatattgtgatttccagctgtagcattcaaaaaaaaaattggtgttcatgactctgtggtcggtgccagaggaaaataggaacgactctaattaataggctttctgtgtatataattaaatttagctgctgcaaccattgttctgacacgacttctgtttcacagttcagaccggtcttcaaaggaaaagcctgtccgatttttccatgggttccagtttcagagttctcattattactcaaagtaaaagcggactgcgatttaagatgtttccaccccaatacctggtcttccttcccggcttaaggagtaccatgtacttagccacaggcagaatagctttcgatgaccccatagcactttgtttcttcgccttgatttgcactttacaatgtccccagcccctctgcagcccgtggctggcagggcgttcgatgtgcggttggcccccagcgcgccctccagagctgcggtgtctccctgcctcattccccacatcccactgagcatgggaccattgggagcagagctgatattaaagcatgtttagcttcgaagttttacttttttaaagctgagtagttaagaattccctgtaaaaacaaaaccctgtaaattgagcctcatgtctggtatatattttaccaaacagccttaaaatatatttggaagcaaaaatcagtacgaatgtatctccttgaaaaatgcaaaaaaaaaaaaatccctgaaatattcttctataaatgaatcctatttccccagagtgttcaaggcatttttctacctaaatgaatacctaaatcttgagtagtgtacggtaatgacgcttcttcctatatccactcttattatgttaaaacaaatgtatttgcgagtattggcattttagactttaaaaatgctgtatgatttcagatgaactctgctgtttagaagtaaccacagaaaagcaaagtcagtgtacactctgagtgaaaggaaatgtaatgtggataaaggcccgccacctcctcacattggtctatctactggcagctgatacgtttaactcatttccttgagcttatacaaaacatagaaaagcaaactgttaaagtagtcaataattatttgtctcagatcccagattctatgatccctgcttaaaagaaaatgttcactgcatgtaggttgatttcttatgttttgtagactcattgttatttttcaatccccaaaagtcttggcctaaaccatccctaggggagcagattaacctaccactacattgcacagggttggtgactcgacgtggtgaatgtgcacacgccctgcctggtccgccatgttccaaagaagatgatttaatggtagaacggatacctgctgctagacctgatggaatgttacctgtccgtgttacataatcaagtgcaatatactcagttctcatgcaggtgacattctaccatgaaacgcagaagataagccatgtttctgtattgtacatgtaaagaaaaataaaactgtttatgatacttgtgttagtcactcgagctagcttatttcagccacttctagcagatcatgccatggagctcacgacgtgtgaccatttcgtcatatttaaaatataacttcaagaaaagagtaaacatccattggagaacacggctgaaaattattgtgctgttctaggaacatcatcctagagagtgtgatgttcactataaccccatacctacattccctaatgatacagccaatgacaggtgaaacccagacactctccttagagccgacaggttgatcctgctgtgttgaaggctgtggttaataaaacacaagtatgataaacaggacctagcgtttagcccgggaaaggagaatgctgcttgtcacctagagtgctttccttgtgatgcgtctctcgcatcttcacgtgttgttgtgtttgaagtaaaactagttgttatcgatgacaatttttaccatagttttctcagcaaatttatatcaccatcttagaatggtatataaaaaaattgaactgtttatgataccaaaaaaattacagttttgtttaaaaggaaatgttgatgttttcaactccaaatcaattctaaaaacttcaagcacttaatggaaaggtaaatggtcagataaaaatataattacctgtaaggttatctggttttaaaagaaaaaaaaaaagcctacaaactcagtgacctactacgcagagggaatttttccctgctgcttcttatgaaagtggccaggtttattattagaagacacagtggcagagcacacatgtgcacaggttctgattatttctcttggagcatatgtccttgtcttgatttttgccttttcgatgccatattaagcagccaccgtttccacccctttcattagaaggccctgcatccgtaaattcgcgcatctctgtttttgttagatccttgtaagcatcgctacccgagtccaggatggaatttcacaggaaagtgaagggatactgcaggcctgtgtttgcagcgcctgtggtaactgtggaatgagctctgttagggacagttgtctggtttgtgccaaaccttcgaggggcgagtagggagtgggggaggtgggtccaagtctccctcaggaaggccttttctatcggcagcaattccatcaagccaagcctcctgtggtcctgagcatgaaggggccaggggacctcctgggagatgcagcttttgtttccgctgcgtttcatcagtcagccttgcttggaattctggcaggttccccggggtgtttcagtggacaggaggcccccgtgccgtggctgagtcagcctgggtaccccagtcaccagcagggccacccttgatgacagggccccccacgaacctgggaaaggcagcgggaaatgtgtgagagggtgtgcgctggtacggacataaaagcattgtccaaaacagcgctggttcggggagggcccctggatactgcctttggcccacactgaaaactgaaattgccccacctgtgagcacagaaacacgcttctccaacacgggccgaaataactaaactccacatggttcctgcctgctcatttcccagccctcttcttctcaagcctgaacttcatttttttttttagctgcaaatttaacaggctaatttaaaactgcagttttcagacgacagcccctgggaatgttccagggttctcttgttttgatctgcatgtctgtttacacttctctgtaggcgtgggttgaatacaagtttccaaaactttaaaatagaaaaccacgagcttaagaggtgaaaaagatgacccctttctgattaggatctgtaactctgtgggctgggtcaatgcagtgtgcttcattcagggccatgtggcagccatgacacacaccacataaggtcagctcagagcccatggcttccctgcaggagccccatcttgtcgctattagttgggagttgcaatacattgttggccataaacaaagtgctaaaggaaagggtttgcttctacacattcggctgaatgtcccccagtgcagggtggcagcagaatgttctggaaatgaaggagatattgctaggaatctctaggctgttaggcaacctggcttttattcatcctcagccggcaactcatctcaagtttatgtctcagtttttttcctctagaaaggggattacagttcctgtccctgtcttcctccaggacacactgtgaggattaatgacatattggctctaaagtcctttgagctcctgggaacaggtggtgaaagtgtgcgttactgctaaggattagtccctggcctcttctagaatgccgccctcccagctctgcagggcacgctgccagaatccaggctggtcgtaaacatctcagagataatcagggaccaccagaggcagaggccatgagactgtctttggaaaggtttggaaatgcagaaataactacaagggccattctccttagcttctggctttcaactgtttctagatgcttccaagaacaagaacccagcaccaaccagaattaggccacgttttcaccattacttaagctcaatcgcctcttagatgaaatgaggagataaactaaacattaaaatgatgaaggaaaaaaaattatttggaagccgaaaaccgcatgggtggggaaacatcaggaacgaaatcagacacactgactcaaaccacgcaagggtttgagaagcccacccctctaattccaggcgtttgtaatttttctacttcgcacttgagagaaggcagaggtggtccgtgggaaagctccgggaaacagccgtctttcatccttgccacattgaaaaatgtccacaattttatgaattgctgtcctaaccctggcgtttttatccagtgttaaaataaattatttcaagtttcaatgtaaacacttaacagatgacttctttgcagaagaaatgttcgttacctactatcaaactactttttaacagattttgtatatacacacacaagttgacagaggtttacctccctactttcttagattttatgtaactcttttcattggtgcttattcagaacctgaaagccttgggcatccaagctttcacctactcaatggaggagaggtgataatgaatgaaaagattgacaccaggtttcttggacaaatttaagttcaaatttatctctttcaagtagaccatggtctccctagagagtgtgttggcttgtgtctgccagtacgacaaaggacgctcccagcttgatcgtggtaccttatggaagccactcacgcattctctgatttacccccaaaacactaccatgccccagccccactcatttaaataatacaatcatatcactttcaaagggctcagcacgaatgttcccctcactccactttttaactcgtttgctgaactcgacaaggcttccccttacgagcagtgagacctaggctactttcgaacgcttccttccgaacggtaagccacttcgctctcgggcaggacaggtcctccctgcagagagagacaactcatcccccgaccttccatactacagaccaaaatacccaggtgtggcctaaggactatattaaatgcctcctatagaaattcaaggaatgttagaaccaggaaactagctgtttaaagttttaaagaagtatataaatatatatataaatataaatatgaaatcatatcgagtgtgaggatgagcagagtgccaaatattcagcatctgtacaaagtcattcactggaattcaactattttatgtcattctctttctcacgcttttatggttcttttgataaattctatttagtagcatgcaggatacctaatctgaatgtgcaatatgctattcatcaccacgacaatttcttacttcctcttaataacttaccagaatgttggtcattcctttaaggcagttaaggattgctttatttgtgttcttttttcccatgactttttttcactctcagctgactgtaagaaactgtgcaccgtttccgccataaccgtcctgtgacgatgcctccatttgacttctgtatcgctgatgttcacctcctgtaaatagtttggcaattaaattttttgagaaaagtaatgtttacttttttattggagtgaattctcgtgttattttaatctcagaaaaattatatagaccaaagagttttatccgaaaaaaaattacactcttcctccattatatatttcattgttgaaatatcctcaatttctctatattttaagaagtaatggacatttattaaggttacagatttaatatgtatgcaaaatggtatagattaaatgagtttttaattaataaatcctacagtatttagttaa

SEQ ID NO: 8505 - DNA, 3515 bp, Homo sapiens
cgcccacgcagcacttcaatgaggagcgctactcgcccgcgcccaggagcatgaagggcctttccggaagtcggacccagccgccgctgtgttccgggcacacgtgtggtctggcgcccccggaggactgcgagcacctgcaccacgggcccgacgcgcggccgccctacctgctgagccccgccgacagctgccccggggggcgccaccgctgctcgccgcgcagctcggtgcactcggagtgcgtgatgatgccggtggtgctgggcgaccacgtgtccagcagcaccttcccgcggatgcactacagctcgcactacgacacgcgcgacgactgcgctgtggcccacgcgggcgccaagatcaaccgcatcccggccaacctgctggaccagttcgagaagcagctgccgctgcaccgggacggcttccacacgctgcagtaccagaggacgtccgcggccgccgagcagcgcagcgagagccccgggcggatccgccacctggtacactccgtgcagaagctcttcaccaagtcgcactcgctggagggctcctccaaaagcaacgccaacggcaccaaggcggacggccgggcggacgaccaccaccacgcccaccacgccaagcacagcaagaggagcaagagcaaggagcgcaagccggagggcaagccccggcccggcatgagcagctggtggagctcggacgacaacctggacagcgacagcacctatcggacgcccagcgtgctcaaccggcaccacctgggccccgtggcccactgctaccccgacgcgctgcagagccccttcggggacctgtccctcaagacctccaagagcaacaacgacgtcaagtgctcggcctgtgaggggttggcgctgacgcccgacgccaagtacctgaagcgcagctcctggtctacgctgacggtcagccaggccaaggaggcctaccgcaagagctcgctgaacctggacaagccgctgctgcaccaggacgccaagcccgccctgaggccgtgccactacctccaggtacctcaggatgagtggggagggtaccccaccggtggcaaagatgaggagattccctgcaggagaatgagaagtgggagttacattaaagccatgggggacgaggagagcggagagtcagactccagccccaagacatcaccaaagtcggcaatcctaccagagccgctgctgaagtccatcggacagagaccgcttggagagcaccagacccagacctacctgcaagctgcaagcgatgtgcctgtgggacacagcctggaccccgctgcgaactacaactccccgaaattccgctcccggaaccagagctacatgagggccgtcagcaccctgagccaggccagctgcgtgagccaggtgagcgaggcggagatcaatgggcaattcgagtccgtgtgcgagtccgtcttcagtgaagttgaatctcaggccatggatgccctcgacctcccgggatgtttccgaacaaggagtcacagctaccttcgagccattcaagccggctactcccaagatgacgaatgtattcccatgatgacaccctctgacatcacctccaccatcaggtcaacagcagctgtctcatatacaaattacaagaaaacgcccccaccggtgccccctcggaccacctccaagcctctgatctcggtgacggcgcagagcagcaccgaatccacccaggacgcctaccaggacagccgcgcacagaggatgtccccgtggccccaggacagccgcggcctctacaactccacggacagcctggacagcaacaaggccatgaacctcgcgctggaaacggccgctgcccagcgccacctgccagagagccagagcagctctgtgcggaccagcgacaaggccatcctggtgtccaaggcggaggagctcctcaagagccgctgctcctccatcgggattcaggtggaaacggccacagattctgacacggagagccgcggtctgcgggaataccactctgtcggggtgcaagtggaagatgagaagcgacacggacgttttaaacgttctaacagcgtcacggccgccgtccaagctgacctggagctggaggggttcccaggccacatcaccacggaggacaaaggccttcagttcggctcatccttccagcggcactccgagcccagcacccccacccagtacagcgcggtgagaactgtacggacccaggggctcttcagctatagagaagactatcggacccaagtggacacctccaccctgccccctccagacccctggctggagcccgccatcgacacggtagagactgggaggatgtctccgtgccgcagggatggctcgtggtttttgaagctgctgcacgcagagacaaagaggatggaaggctggtgcaaagagatggagagagaggcggaggagaacgacctctcggaggaaattctcggtaaaatcaggagtgctgttgggagtgcccagcttctcatgtcccagaaattccagcagttttattggctttgccaacagaatatggaccccagcgccatgccgaggccgacgtcgcaggacctggccggctactgggacatgctgcagctctccattgaggacgtcagcatgaagttcgacgagctgcagcggctgcggctcaacgactggaagatgatggagtccccggaaagaaaggaagaaagaaaggtcccgcctccaataccaaagaagcctcccaaggggaagtttcccatcacaagagaaaaatccctggacctgcccgacagacaacgccaggaagcccggaggcgcctcatggccgccaagcgagcggcgtccttccggcagaattccgcctccgagcgcgcggacagcatcgagatctacatccccgaggcccagacccggctctgagggcggaggccggcgccttcccctcgtcgcttccgctttcccggacgcttgtgcagcgcggcgccgccctggtggtttctgtctcctcctcccgctgaacacgtcctcgctcccgcgctccccgcgccccggacacagcgggacgcggccggcggcctcagagtccacggagctcgcggcgaggacgacttctgcttttgttgttgttgttgttgttcacgggtggcctggctcacacttggctctgagggacaggtgtggcgagacctgatttctcctgcgtgttctcagaggacggcgagaaatgcctctggagctggaacccagcttacattttgttatttctatttttataaattgtgtgataattagaggtaagaataacaagtaactataaacgggtgcatcccaccactccctggaggcattagacacccaagtggaaggtgctacaacctgaagcgcaggaaagaaaggcccattcccctcgcacagccgagcttttactccctgagcacgggccgctccgctcccctgctcctgtctgtctcggacagaaaacacgaggctccttgtgtc

SEQ ID NO: 8506 - DNA, 4815 bp, Homo sapiens
gttggaaacggcactgctgagtgaggttgaggggtgtctcggtatgtgcgccttggatctggtgtaggcgaggtcacgcctctcttcagacagcccgagccttcccggcctggcgcgtttagttcggaactgcgggacgcgccggtgggctagggcaaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaaggttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaaggggagatccctgacgacatgggatcaaaaggcctgaagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggagtctttcttgagtactgatttcatgttgaattgtatcccacacatcatggtctgcagcttctttttcacatgtagtgtctccttcaagttacatcgtgtgtattatttaatgtcactattggttagtggccatttttcagaactgaagatggaatggcctgaccagctattaagaacgtggggagacgcagaaattgtggtaaaattccttaatgtttaagggaaagtaactttaagagatttttggaaaagctttatatacattcttttcaaatttcagtacaaatgaaaaagtggttttaatcagtgatttagtagactttgagcaactgtgcacgcttcagtttaatagcatggtttggccagtgtattactctcaagtccttttctcaatcaacttctatcatcaaagcaattgtttcattatagataaataaggacattttttaatttaaaaattcatgtctgagttgactttcataagggatttcattttttcctcaacattcttaaagccttttagtatttgacggttcttttttcccaggacatttgctaggaataacaacgtttcaatgtttttaatctacttgagcaacactatcgtgtcttacaaaagttgttcatatgtaaatgatcatcacatttcgtgaattgaggccatgttcaggtgctaaggaagttcgccttttacacagaagattgagaaaatttcctagatataaatacagataaatcagacgttacagtggtgacgtagtaaccatcatggcaatggaaaggagtccaattcatagcctaaaacttcaaatgtattcttaggagtcagattttactgaatattttacccacaatagctgcctattttgttataataaaatatatataaatatatatataaaactttctttaaactgtaactatgggaattattttctttacatagttgcgcacacacacaaacatatatatatatttaaaatatattttgtttcttttgccacctactcctaactttttgtttggtttttaaattaaatattaattgaatagacttatcttccttaatcatgtgaactgaaaatgggggcatggtggtcatgaggaggaaacatttagggaaattagattataagtaaaagtgtgggcatattctcctcttttctacaaaggttttcaaatggttcctgaggttttttgttgttgtccgtgttgttactgttgttcttgtcatcaggtttgattttggtccttgccctttccttctagttctccttttattaataggaaggcaggcaaaagccccatttatgtgtgtgttttcccctcagacagctttcatccactgctctgcactagaattgcacaaatcttcatggtgagcaattttaagaaatgttagtgaaaggtagaaattatttcacaaatcagtttctctggtccttcatattaataataatatttggcttcccattgctctttggagttgtttattaaatatgtgtttttgacaacctcctcattagtttcttaaatgagtactggtttgtaaagaattatcaacattatccattccatttatgaagaagaggagaacagctaataaactgtattgtaaaatccatatgttaagtgtgtcttgaattttgaaagaaaaaatatattttgcaagctaacattttcttgaaacaatttgaggcatcatgtaacttataaccgaatccaagagccgttaggcagcagagtgtgttaccacattgaaatacacagtgctgctgttagactaaatgtcgtaggttgttaaccacatagaaacacactagtatgaagaaaactgttgtaaaatctcaagagcttcagaaactgccttacaagaccgcagcataagctattttgaagtatttaccaaatagtcacatgttgtaaaatatcaagtggttataaaaggatgccatttatatattaaaatttacataacattgttttctgga

SEQ ID NO: 8507 - DNA, 5034 bp, Homo sapiens
gttggaaacggcactgctgagtgaggttgaggggtgtctcggtatgtgcgccttggatctggtgtaggcgaggtcacgcctctcttcagacagcccgagccttcccggcctggcgcgtttagttcggaactgcgggacgcgccggtgggctagggcaaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaagccaacagaagctgttcttccctctcctcccactgtccctgtgatccctgtcctgccagtccctgctgagaatactgtcatcctacccaccataccacaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaagggcagtcattcaatgacaagcgtaaaaagaacctcttttcccgaaaattccccttctacaagaacaaggaccagagtgagcaggaaacaagtgatgctgaccagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggagtctttcttgagtactgatttcatgttgaattgtatcccacacatcatggtctgcagcttctttttcacatgtagtgtctccttcaagttacatcgtgtgtattatttaatgtcactattggttagtggccatttttcagaactgaagatggaatggcctgaccagctattaagaacgtggggagacgcagaaattgtggtaaaattccttaatgtttaagggaaagtaactttaagagatttttggaaaagctttatatacattcttttcaaatttcagtacaaatgaaaaagtggttttaatcagtgatttagtagactttgagcaactgtgcacgcttcagtttaatagcatggtttggccagtgtattactctcaagtccttttctcaatcaacttctatcatcaaagcaattgtttcattatagataaataaggacattttttaatttaaaaattcatgtctgagttgactttcataagggatttcattttttcctcaacattcttaaagccttttagtatttgacggttcttttttcccaggacatttgctaggaataacaacgtttcaatgtttttaatctacttgagcaacactatcgtgtcttacaaaagttgttcatatgtaaatgatcatcacatttcgtgaattgaggccatgttcaggtgctaaggaagttcgccttttacacagaagattgagaaaatttcctagatataaatacagataaatcagacgttacagtggtgacgtagtaaccatcatggcaatggaaaggagtccaattcatagcctaaaacttcaaatgtattcttaggagtcagattttactgaatattttacccacaatagctgcctattttgttataataaaatatatataaatatatatataaaactttctttaaactgtaactatgggaattattttctttacatagttgcgcacacacacaaacatatatatatatttaaaatatattttgtttcttttgccacctactcctaactttttgtttggtttttaaattaaatattaattgaatagacttatcttccttaatcatgtgaactgaaaatgggggcatggtggtcatgaggaggaaacatttagggaaattagattataagtaaaagtgtgggcatattctcctcttttctacaaaggttttcaaatggttcctgaggttttttgttgttgtccgtgttgttactgttgttcttgtcatcaggtttgattttggtccttgccctttccttctagttctccttttattaataggaaggcaggcaaaagccccatttatgtgtgtgttttcccctcagacagctttcatccactgctctgcactagaattgcacaaatcttcatggtgagcaattttaagaaatgttagtgaaaggtagaaattatttcacaaatcagtttctctggtccttcatattaataataatatttggcttcccattgctctttggagttgtttattaaatatgtgtttttgacaacctcctcattagtttcttaaatgagtactggtttgtaaagaattatcaacattatccattccatttatgaagaagaggagaacagctaataaactgtattgtaaaatccatatgttaagtgtgtcttgaattttgaaagaaaaaatatattttgcaagctaacattttcttgaaacaatttgaggcatcatgtaacttataaccgaatccaagagccgttaggcagcagagtgtgttaccacattgaaatacacagtgctgctgttagactaaatgtcgtaggttgttaaccacatagaaacacactagtatgaagaaaactgttgtaaaatctcaagagcttcagaaactgccttacaagaccgcagcataagctattttgaagtatttaccaaatagtcacatgttgtaaaatatcaagtggttataaaaggatgccatttatatattaaaatttacataacattgttttctgga

SEQ ID NO: 8508 - DNA, 4935 bp, Homo sapiens
gttggaaacggcactgctgagtgaggttgaggggtgtctcggtatgtgcgccttggatctggtgtaggcgaggtcacgcctctcttcagacagcccgagccttcccggcctggcgcgtttagttcggaactgcgggacgcgccggtgggctagggcaaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaagggcagtcattcaatgacaagcgtaaaaagaacctcttttcccgaaaattccccttctacaagaacaaggaccagagtgagcaggaaacaagtgatgctgaccagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggagtctttcttgagtactgatttcatgttgaattgtatcccacacatcatggtctgcagcttctttttcacatgtagtgtctccttcaagttacatcgtgtgtattatttaatgtcactattggttagtggccatttttcagaactgaagatggaatggcctgaccagctattaagaacgtggggagacgcagaaattgtggtaaaattccttaatgtttaagggaaagtaactttaagagatttttggaaaagctttatatacattcttttcaaatttcagtacaaatgaaaaagtggttttaatcagtgatttagtagactttgagcaactgtgcacgcttcagtttaatagcatggtttggccagtgtattactctcaagtccttttctcaatcaacttctatcatcaaagcaattgtttcattatagataaataaggacattttttaatttaaaaattcatgtctgagttgactttcataagggatttcattttttcctcaacattcttaaagccttttagtatttgacggttcttttttcccaggacatttgctaggaataacaacgtttcaatgtttttaatctacttgagcaacactatcgtgtcttacaaaagttgttcatatgtaaatgatcatcacatttcgtgaattgaggccatgttcaggtgctaaggaagttcgccttttacacagaagattgagaaaatttcctagatataaatacagataaatcagacgttacagtggtgacgtagtaaccatcatggcaatggaaaggagtccaattcatagcctaaaacttcaaatgtattcttaggagtcagattttactgaatattttacccacaatagctgcctattttgttataataaaatatatataaatatatatataaaactttctttaaactgtaactatgggaattattttctttacatagttgcgcacacacacaaacatatatatatatttaaaatatattttgtttcttttgccacctactcctaactttttgtttggtttttaaattaaatattaattgaatagacttatcttccttaatcatgtgaactgaaaatgggggcatggtggtcatgaggaggaaacatttagggaaattagattataagtaaaagtgtgggcatattctcctcttttctacaaaggttttcaaatggttcctgaggttttttgttgttgtccgtgttgttactgttgttcttgtcatcaggtttgattttggtccttgccctttccttctagttctccttttattaataggaaggcaggcaaaagccccatttatgtgtgtgttttcccctcagacagctttcatccactgctctgcactagaattgcacaaatcttcatggtgagcaattttaagaaatgttagtgaaaggtagaaattatttcacaaatcagtttctctggtccttcatattaataataatatttggcttcccattgctctttggagttgtttattaaatatgtgtttttgacaacctcctcattagtttcttaaatgagtactggtttgtaaagaattatcaacattatccattccatttatgaagaagaggagaacagctaataaactgtattgtaaaatccatatgttaagtgtgtcttgaattttgaaagaaaaaatatattttgcaagctaacattttcttgaaacaatttgaggcatcatgtaacttataaccgaatccaagagccgttaggcagcagagtgtgttaccacattgaaatacacagtgctgctgttagactaaatgtcgtaggttgttaaccacatagaaacacactagtatgaagaaaactgttgtaaaatctcaagagcttcagaaactgccttacaagaccgcagcataagctattttgaagtatttaccaaatagtcacatgttgtaaaatatcaagtggttataaaaggatgccatttatatattaaaatttacataacattgttttctgga

SEQ ID NO: 8509 - DNA, 5007 bp, Homo sapiens
gttggaaacggcactgctgagtgaggttgaggggtgtctcggtatgtgcgccttggatctggtgtaggcgaggtcacgcctctcttcagacagcccgagccttcccggcctggcgcgtttagttcggaactgcgggacgcgccggtgggctagggcaaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaagccaacagaagctgttcttccctctcctcccactgtccctgtgatccctgtcctgccagtccctgctgagaatactgtcatcctacccaccataccacaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaaggggagatccctgacgacatgggatcaaaaggcctgaagcatgtaacttctaatgccagcgatagtgaaagtagttacctaatcttgattacagatgagtatggctgctcaaaaggtcgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggagtctttcttgagtactgatttcatgttgaattgtatcccacacatcatggtctgcagcttctttttcacatgtagtgtctccttcaagttacatcgtgtgtattatttaatgtcactattggttagtggccatttttcagaactgaagatggaatggcctgaccagctattaagaacgtggggagacgcagaaattgtggtaaaattccttaatgtttaagggaaagtaactttaagagatttttggaaaagctttatatacattcttttcaaatttcagtacaaatgaaaaagtggttttaatcagtgatttagtagactttgagcaactgtgcacgcttcagtttaatagcatggtttggccagtgtattactctcaagtccttttctcaatcaacttctatcatcaaagcaattgtttcattatagataaataaggacattttttaatttaaaaattcatgtctgagttgactttcataagggatttcattttttcctcaacattcttaaagccttttagtatttgacggttcttttttcccaggacatttgctaggaataacaacgtttcaatgtttttaatctacttgagcaacactatcgtgtcttacaaaagttgttcatatgtaaatgatcatcacatttcgtgaattgaggccatgttcaggtgctaaggaagttcgccttttacacagaagattgagaaaatttcctagatataaatacagataaatcagacgttacagtggtgacgtagtaaccatcatggcaatggaaaggagtccaattcatagcctaaaacttcaaatgtattcttaggagtcagattttactgaatattttacccacaatagctgcctattttgttataataaaatatatataaatatatatataaaactttctttaaactgtaactatgggaattattttctttacatagttgcgcacacacacaaacatatatatatatttaaaatatattttgtttcttttgccacctactcctaactttttgtttggtttttaaattaaatattaattgaatagacttatcttccttaatcatgtgaactgaaaatgggggcatggtggtcatgaggaggaaacatttagggaaattagattataagtaaaagtgtgggcatattctcctcttttctacaaaggttttcaaatggttcctgaggttttttgttgttgtccgtgttgttactgttgttcttgtcatcaggtttgattttggtccttgccctttccttctagttctccttttattaataggaaggcaggcaaaagccccatttatgtgtgtgttttcccctcagacagctttcatccactgctctgcactagaattgcacaaatcttcatggtgagcaattttaagaaatgttagtgaaaggtagaaattatttcacaaatcagtttctctggtccttcatattaataataatatttggcttcccattgctctttggagttgtttattaaatatgtgtttttgacaacctcctcattagtttcttaaatgagtactggtttgtaaagaattatcaacattatccattccatttatgaagaagaggagaacagctaataaactgtattgtaaaatccatatgttaagtgtgtcttgaattttgaaagaaaaaatatattttgcaagctaacattttcttgaaacaatttgaggcatcatgtaacttataaccgaatccaagagccgttaggcagcagagtgtgttaccacattgaaatacacagtgctgctgttagactaaatgtcgtaggttgttaaccacatagaaacacactagtatgaagaaaactgttgtaaaatctcaagagcttcagaaactgccttacaagaccgcagcataagctattttgaagtatttaccaaatagtcacatgttgtaaaatatcaagtggttataaaaggatgccatttatatattaaaatttacataacattgttttctgga

SEQ ID NO: 8510 - DNA, 4929 bp, Homo sapiens
gttggaaacggcactgctgagtgaggttgaggggtgtctcggtatgtgcgccttggatctggtgtaggcgaggtcacgcctctcttcagacagcccgagccttcccggcctggcgcgtttagttcggaactgcgggacgcgccggtgggctagggcaaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaagccaacagaagctgttcttccctctcctcccactgtccctgtgatccctgtcctgccagtccctgctgagaatactgtcatcctacccaccataccacaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaaggggagatccctgacgacatgggatcaaaaggcctgataggtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggagtctttcttgagtactgatttcatgttgaattgtatcccacacatcatggtctgcagcttctttttcacatgtagtgtctccttcaagttacatcgtgtgtattatttaatgtcactattggttagtggccatttttcagaactgaagatggaatggcctgaccagctattaagaacgtggggagacgcagaaattgtggtaaaattccttaatgtttaagggaaagtaactttaagagatttttggaaaagctttatatacattcttttcaaatttcagtacaaatgaaaaagtggttttaatcagtgatttagtagactttgagcaactgtgcacgcttcagtttaatagcatggtttggccagtgtattactctcaagtccttttctcaatcaacttctatcatcaaagcaattgtttcattatagataaataaggacattttttaatttaaaaattcatgtctgagttgactttcataagggatttcattttttcctcaacattcttaaagccttttagtatttgacggttcttttttcccaggacatttgctaggaataacaacgtttcaatgtttttaatctacttgagcaacactatcgtgtcttacaaaagttgttcatatgtaaatgatcatcacatttcgtgaattgaggccatgttcaggtgctaaggaagttcgccttttacacagaagattgagaaaatttcctagatataaatacagataaatcagacgttacagtggtgacgtagtaaccatcatggcaatggaaaggagtccaattcatagcctaaaacttcaaatgtattcttaggagtcagattttactgaatattttacccacaatagctgcctattttgttataataaaatatatataaatatatatataaaactttctttaaactgtaactatgggaattattttctttacatagttgcgcacacacacaaacatatatatatatttaaaatatattttgtttcttttgccacctactcctaactttttgtttggtttttaaattaaatattaattgaatagacttatcttccttaatcatgtgaactgaaaatgggggcatggtggtcatgaggaggaaacatttagggaaattagattataagtaaaagtgtgggcatattctcctcttttctacaaaggttttcaaatggttcctgaggttttttgttgttgtccgtgttgttactgttgttcttgtcatcaggtttgattttggtccttgccctttccttctagttctccttttattaataggaaggcaggcaaaagccccatttatgtgtgtgttttcccctcagacagctttcatccactgctctgcactagaattgcacaaatcttcatggtgagcaattttaagaaatgttagtgaaaggtagaaattatttcacaaatcagtttctctggtccttcatattaataataatatttggcttcccattgctctttggagttgtttattaaatatgtgtttttgacaacctcctcattagtttcttaaatgagtactggtttgtaaagaattatcaacattatccattccatttatgaagaagaggagaacagctaataaactgtattgtaaaatccatatgttaagtgtgtcttgaattttgaaagaaaaaatatattttgcaagctaacattttcttgaaacaatttgaggcatcatgtaacttataaccgaatccaagagccgttaggcagcagagtgtgttaccacattgaaatacacagtgctgctgttagactaaatgtcgtaggttgttaaccacatagaaacacactagtatgaagaaaactgttgtaaaatctcaagagcttcagaaactgccttacaagaccgcagcataagctattttgaagtatttaccaaatagtcacatgttgtaaaatatcaagtggttataaaaggatgccatttatatattaaaatttacataacattgttttctgga

SEQ ID NO: 8511 - DNA, 716 bp, Homo sapiens
gcggccgctgccctgtccggcccccgctggagcagcccggaggcagcgagcaaggagaaaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaagccaacagaagctgttcttccctctcctcccactgtccctgtgatccctgtcctgccagtccctgctgagaatactgtcatcctacccaccataccacaggcaaatcctcccccagtactggtcaacacagatagcttggaa

SEQ ID NO: 8512 - DNA, 2690 bp, Homo sapiens
ggcggaaagtttcgggggagagcggttgggggcgcggaaggaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaaggggagatccctgacgacatgggatcaaaaggcctgaagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatga

SEQ ID NO: 8513 - DNA, 711 bp, Homo sapiens
ctggctcaggggccaagggtcggagcgcttcacccgcccgtacccagtagcaggtggggagtgtggatacttgtgcgggggaagaggcggcctcaggtctaggctctttggggaggggacgctttcgaggagagtttggaagccgacttctgtctgttcttaatttggaggggtacccactccaaggaaaagctttccacgttgacagacaactgctgcgttttgagactctttctttgacttggtaaaactttggaacgtggggttttcaaataggctgcgagggttttctatttcgataggggaaaatgctagtttaacatgattctatcctttttcctttccgttgtgtgttttaaaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagaga

SEQ ID NO: 8514 - DNA, 1771 bp, Homo sapiens
gttggaaacggcactgctgagtgaggttgaggggtgtctcggtatgtgcgccttggatctggtgtaggcgaggtcacgcctctcttcagacagcccgagccttcccggcctggcgcgtttagttcggaactgcgggacgcgccggtgggctagggcaaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaaggttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagcagtcattcaatgacaagcgtaaaaagaacctcttttcccgaaaattccccttctacaagaacaaggaccagagtgagcaggaaacaagtgatgctgaccgagatccctgacgacatgggatcaaaaggcctgaagcatgtaacttctaatgccagcgatagtgaaagtagttaccgt

SEQ ID NO: 8515 - DNA, 3994 bp, Homo sapiens
agttctgtcactcactcggggtaactttgggcaaattctctctggacctcctaatagggaggtcctcgtcaccccgaggaagttcgaagacgtgggcagtgacttggaaagcttcccgagattccccttctataacctgggtggctcagaccgggagcggggtcccagccggccggtaattccgcccggaggtgcgcacgaaacaaacctgcagcgctggccgagggcggctcagcttcggagggcgcgactccgggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaagccaacagaagctgttcttccctctcctcccactgtccctgtgatccctgtcctgccagtccctgctgagaatactgtcatcctacccaccataccacaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaaggggagatccctgacgacatgggatcaaaaggcctgaagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggagtctttcttgagtactgatttcatgttgaattgtatcccacacatcatggtctgcagcttctttttcacatgtagtgtctccttcaagttacatcgtgtgtattatttaatgtcactattggttagtggccatttttcagaactgaagatggaatggcctgaccagctattaagaacgtggggagacgcagaaattgtggtaaaattccttaatgtttaagggaaagtaactttaagagatttttggaaaagctttatatacattcttttcaaatttcagtacaaatgaaaaagtggttttaatcagtgatttagtagactttgagcaactgtgcacgcttcagtttaatagcatggtttggccagtgtattactctcaagtccttttctcaatcaacttctatcatcaaagcaattgtttcattatagataaataaggacattttttaatttaaaaattcatgtctgagttgactttcataagggatttcattttttcctcaacattcttaaagccttttagtatttgacggttcttttttcccaggacatttgctaggaataacaacgtttcaatgtttttaatctacttgagcaacactatcgtgtcttacaaaagttgttcatatgtaaatgatcatcacatttcgtgaattgaggccatgttcaggtgctaaggaagttcgccttttacacagaagattgagaaaatttcctagatataaatacagataaatcagacgttacagtggtgacgtagtaaccatcatggcaatggaaaggagtccaattcatagcctaaaacttcaaatgtattcttaggagtcagattttactgaatattttacccacaatagctgcctattttgttataataaaatatatataaatatatatataaaactttctttaaactgtaa

SEQ ID NO: 8516 - DNA, 582 bp, Homo sapiens
ggtggggatctacccccggggtcgccaggcgctgtctctgccgcggagttggaaacggcactgctgagtgaggttgaggggtgtctcggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcatt

SEQ ID NO: 8517 - DNA, 2854 bp, Homo sapiens
atgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaaggttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaaggggagatccctgacgacatgggatcaaaaggcctgaagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggagtctttcttgagtactgatttcatgttgaattgtatcccacacatcatggtctgcagcttctttttcacatgtagtgtctccttcaagttacatcgtgtgtattatttaatgtcactattggttagtggccatttttcagaactgaagatggaatggcctgaccagctattaagaacgtggggagacgcagaaattgtggtaaaattccttaatgtttaa

SEQ ID NO: 8518 - DNA, 309 bp, Homo sapiens
tgcgggggaagaggcggcctcaggtctaggctctttggggaggggacgctttcgaggagagtttggaagccgacttctgtctgttcttaatttggaggggtacccactccaaggaaaagctttccacgttgacagacaactgctgcgttttgagactctttctttgacttggtgtgtgccctcttcctgattctggagaaaaatgccggtccggaagcaagatacccagagagcattgcaccttttggaggaatatcgttcaaaactaagccaaactgaagacagacagctcagaagttccatagaacg

SEQ ID NO: 8519 - DNA, 543 bp, Homo sapiens
agcaaggagaaaggcaagcgagaggagggggcccgagcagggcgggcggccagtcccgctggtcccctctcagcgctctgcggccgctgctggctcaggggccaagggtcggagcgcttcacccgcccgtacccagtagcaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccac

SEQ ID NO: 8520 - DNA, 2977 bp, Homo sapiens
gttggaaacggcactgctgagtgaggttgaggggtgtctcggtatgtgcgccttggatctggtgtaggcgaggtcacgcctctcttcagacagcccgagccttcccggcctggcgcgtttagttcggaactgcgggacgcgccggtgggctagggcaaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaagccaacagaagctgttcttccctctcctcccactgtccctgtgatccctgtcctgccagtccctgctgagaatactgtcatcctacccaccataccacaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaaggggagatccctgacgacatgggatcaaaaggcctgaagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctgga

SEQ ID NO: 8521 - DNA, 2682 bp, Homo sapiens
atgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaagggcagtcattcaatgacaagcgtaaaaagaacctcttttcccgaaaattccccttctacaagaacaaggaccagagtgagcaggaaacaagtgatgctgaccagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatga

SEQ ID NO: 8522 - DNA, 3482 bp, Homo sapiens
atgaatgcatacctcaccaagcaacacagctgcagccgggggtccgatgggatggatgccgtcaggagtgcgcccaccctgatcagggatgcccactgtgcttgtggctggcagaggaactgtcaggggctcgggtacagttctcagaccatgccctcctcaggaccagggggcccagcttcaaacaggaccggggggtccagcttcaacaggaccttgtgggacagtgtgcggaaaagcccccacaagacgagcaccaagggcaaagggacttgtggggagcattgtacctgcccacatggttggttcagcccagcacaggccagtcctgctcctataattgtcaacacagatactttggacacaattccttatgtcaatgggacagaaattgaatatgaatttgaagaaattacactggagagggggaattctggcctgggattcagtattgctggggggacagataatccccacattggagatgaccctggcatatttattacgaagattataccaggaggtgctgcagcagaggatggcagactcagggtcaatgattgtatcttgcgggtgaatgaggttgatgtgtcagaggtttcccacagtaaagcggtggaagccctgaaggaagcagggtctatcgttcggctgtatgtgcgtagaagacgacctattttggagaccgttgtggaaatcaaactgttcaaaggccctaaaggtttaggcttcagtattgcaggaggtgtggggaaccaacacattcctggagacaacagcatttatgtaactaaaattatagatggaggagctgcacaaaaagatggaaggttgcaagtaggagatagactactaatggtaaacaactacagtttagaagaagtaacacacgaagaggcagtagcaatattaaagaacacatcagaggtagtttatttaaaagttggcaaacccactaccatttatatgactgatccttatggtccacctgatattactcactcttattctccaccaatggaaaaccatctactctctggcaacaatggcactttagaatataaaacctccctgccacccatctctccaggaaggtactcaccaattccaaagcacatgcttgttgacgacgactacaccaggcctccggaacctgtttacagcactgtgaacaaactatgtgataagcctgcttctcccaggcactattcccctgttgagtgtgacaaaagcttcctcctctcagctccctattcccactaccacctaggcctgctacctgactctgagatgaccagtcattcccaacatagcaccgcaactcgtcagccttcaatgactctccaacgggccgtctccctggaaggagagcctcgcaaggtagtcctgcacaaaggctccactggcctgggcttcaacattgtcggtggggaagatggagaaggtatttttgtgtccttcattctggctggtggaccagcagacctaagtggggagctccagagaggagaccagatcctatcggtgaatggcattgacctccgtggtgcatcccacgagcaggcagctgctgcactaaagggggctggacagacagtgacgattatagcacaatatcaacctgaagattacgctcgatttgaggccaaaatccatgacctacgagagcagatgatgaaccacagcatgagctccgggtccggatccctgcgaaccaatcagaaacgctccctctacgtcagagccatgttcgactacgacaagagcaaggacagtgggctgccaagtcaaggacttagttttaaatatggagatattctccacgttatcaatgcctctgatgatgagtggtggcaagccaggagagtcatgctggagggagacagtgaggagatgggggtcatccccagcaaaaggagggtggaaagaaaggaacgtgcccgattgaagacagtgaagtttaatgccaaacctggagtgattgattcgaaagggtcattcaatgacaagcgtaaaaagagcttcatcttttcacgaaaattcccattctacaagaacaaggagcagagtgagcaggaaaccagtgatcctgaacgaggacaagaagacctcattctttcctatgagcctgttacaaggcaggaaataaactacacccggccggtgattatcctggggcccatgaaggatcggatcaatgacgacttgatatctgaattccctgataaatttggctcctgtgtgcctcatactacgaggccaaagcgagactacgaggtggatggcagagactatcactttgtcatttccagagaacaaatggagaaagatatccaagagcacaagtttatagaagccggccagtacaatgacaatttatatggaaccagtgtgcagtctgtgagatttgtagcagaaagaggcaaacactgtatacttgatgtatcaggaaatgctatcaagcggttacaagttgcccagctctatcccattgccatcttcataaaacccaggtctctggaacctcttatggagatgaataagcgtctaacagaggaacaagccaagaaaacctatgatcgagcaattaagctagaacaagaatttggagaatattttacagctattgtccaaggagatactttagaagatatatataaccaatgcaagcttgttattgaagagcaatctgggcctttcatctggattccctcaaaggaaaagttataaattagctactgcgcctctgacaacgacagaagagcatttagaagaacaaaatatatataacatactacttggaggcttttatgtttttgttgcatttatgtttttgcagtcaatgtgaattcttacgaatgtacaacacaaactgtatgaagccatgaaggaaacagaggggccaaagggtgggacagaaaagacattgcagtatgaaggaaggctttggtttgctcaaagtgccaggtgtagggatgaacctctgacgggctttctgcccaagagatgagatgagagcctcctcaccccagcagatgtccagagctgatttagctgcagagctctctgtgtcttttgctttaaagaaaaattgccagcactcgaacctcatcagccttcccattacccacatctgtaattggtacactttgaattttataactatgcacatcttttgatttcttaacaagcaaatgaaagaaagaaggaaaaaagaaaggaatccctttggagatgacatactatcagggaaggataagtgtgtagttttttgactggcatctgcaaagacaagaatttcataaaatttgcaagtgtatggaggactaacctcactgacaggaggggattccacctgggattagctttatgattgttgattgcctattttgccatttataaactgaaagaaggcactaaagatgagaataatttatacaataaaaatatattaaatgtatagaaacaaatttctataggtt

SEQ ID NO: 8523 - DNA, 2789 bp, Homo sapiens
aacaatgtgaacaagctatgcaacatgcatttattccggccagtcctgctcctataattgtcaacacagatactttggacacaattccttatgtcaatgggacagaaattgaatatgaatttgaagaaattacactggagagggggaattctggcctgggattcagtattgctggggggacagataatccccacattggagatgaccctggcatatttattacgaagattataccaggaggtgctgcagcagaggatggcagactcagggtcaatgattgtatcttgcgggtgaatgaggttgatgtgtcagaggtttcccacagtaaagcggtggaagccctgaaggaagcagggtctatcgttcggctgtatgtgcgtagaagacgacctattttggagaccgttgtggaaatcaaactgttcaaaggccctaaaggtttaggcttcagtattgcaggaggtgtggggaaccaacacattcctggagacaacagcatttatgtaactaaaattatagatggaggagctgcacaaaaagatggaaggttgcaagtaggagatagactactaatggtaaacaactacagtttagaagaagtaacacacgaagaggcagtagcaatattaaagaacacatcagaggtagtttatttaaaagttggcaaacccactaccatttatatgactgatccttatggtccacctgatattactcactcttattctccaccaatggaaaaccatctactctctggcaacaatggcactttagaatataaaacctccctgccacccatctctccaggaaggtactcaccaattccaaagcacatgcttgttgacgacgactacaccaggcctccggaacctgtttacagcactgtgaacaaactatgtgataagcctgcttctcccaggcactattcccctgttgagtgtgacaaaagcttcctcctctcagctccctattcccactaccacctaggcctgctacctgactctgagatgaccagtcattcccaacatagcaccgcaactcgtcagccttcaatgactctccaacgggccgtctccctggaaggagagcctcgcaaggtagtcctgcacaaaggctccactggcctgggcttcaacattgtcggtggggaagatggagaaggtatttttgtgtccttcattctggctggtggaccagcagacctaagtggggagctccagagaggagaccagatcctatcggtgaatggcattgacctccgtggtgcatcccacgagcaggcagctgctgcactaaagggggctggacagacagtgacgattatagcacaatatcaacctgaagattacgctcgatttgaggccaaaatccatgacctacgagagcagatgatgaaccacagcatgagctccgggtccggatccctgcgaaccaatcagaaacgctccctctacgtcagagccatgttcgactacgacaagagcaaggacagtgggctgccaagtcaaggacttagttttaaatatggagatattctccacgttatcaatgcctctgatgatgagtggtggcaagccaggagagtcatgctggagggagacagtgaggagatgggggtcatccccagcaaaaggagggtggaaagaaaggaacgtgcccgattgaagacagtgaagtttaatgccaaacctggagtgattgattcgaaaggggacatccccggattaggtgacgacggttatggaacaaagactctgagaggacaagaagacctcattctttcctatgagcctgttacaaggcaggaaataaactacacccggccggtgattatcctggggcccatgaaggatcggatcaatgacgacttgatatctgaattccctgataaatttggctcctgtgtgcctcatactacgaggccaaagcgagactacgaggtggatggcagagactatcactttgtcatttccagagaacaaatggagaaagatatccaagagcacaagtttatagaagccggccagtacaatgacaatttatatggaaccagtgtgcagtctgtgagatttgtagcagaaagaggcaaacactgtatacttgatgtatcaggaaatgctatcaagcggttacaagttgcccagctctatcccattgccatcttcataaaacccaggtctctggaacctcttatggagatgaataagcgtctaacagaggaacaagccaagaaaacctatgatcgagcaattaagctagaacaagaatttggagaatattttacagctattgtccaaggagatactttagaagatatatataaccaatgcaagcttgttattgaagagcaatctgggcctttcatctggattccctcaaaggaaaagttataaattagctactgcgcctctgacaacgacagaagagcatttagaagaacaaaatatatataacatactacttggaggcttttatgtttttgttgcatttatgtttttgcagtcaatgtgaattcttacgaatgtacaacacaaactgtatgaagccatgaaggaaacagaggggccaaagggtgggacagaaaagacattgcagtatgaaggaaggctttggtttgctcaaagtgccaggtgtagggatgaacctctgacgggctttctgcccaagagatgagatgagagcctcctcaccccagcagatgtccagagctgatttagctgcagagctctctgtgtcttttgctttaaagaaaaattgccagcactcgaacctcatcagccttcccatta

SEQ ID NO: 8524 - DNA, 5139 bp, Homo sapiens
acagaagaaaaaaatgaaagggacagcaagctggattctgagttactgaggggaagactcagcctggatttcaaaactgaacactgaagtggtttgcaacagttacctggctcttggcctcaatccagctggatcaaactgagacctgaaaagagatattgactcctgtggcagtggaaagacccaagaatgccagtcaagaagacaggtgggccataagatactgaccgagctttatcattactggaagaatactgcaaaaaattaaggaaaccagaggagcagctgttgaaaaatgcggttaaaaaggtgatgggtatctttaagagcagcttattccaagctttgctagatatccaagaattttatgaggtgacattgctaaattctcaaaaaagttgtgagcagaagatagaagaagccaatcaagttttacagaaatgggagaagacatcccttcttgctccgtgccatgacagacttcaaaaatcttcagagcttacagattgcagtggatcaaaggaaaatgcttcatgtattgagcaaaataaagaaaatcagagttttgaaaatgaaactgatgagacgacaactcaaaaccaaggcagatgcccagcccagaattgttcagtggaagcccctgcttggatgcctgtccaccactgtactaagtatcgatatcaagatgaggacgctccacatgatcattccttacctcgactaacccacgaagtaagaggcccagaactcgtgcatgtatcagaaaagaacctctctcaaatagaaaatgtccatggatatgtcttgcagtctcatatttctcctctgaaggccagtcctgctcctataattgtcaacacagatactttggacacaattccttatgtcaatgggacagaaattgaatatgaatttgaagaaattacactggagagggggaattctggcctgggattcagtattgctggggggacagataatccccacattggagatgaccctggcatatttattacgaagattataccaggaggtgctgcagcagaggatggcagactcagggtcaatgattgtatcttgcgggtgaatgaggttgatgtgtcagaggtttcccacagtaaagcggtggaagccctgaaggaagcagggtctatcgttcggctgtatgtgcgtagaagacgacctattttggagaccgttgtggaaatcaaactgttcaaaggccctaaaggtttaggcttcagtattgcaggaggtgtggggaaccaacacattcctggagacaacagcatttatgtaactaaaattatagatggaggagctgcacaaaaagatggaaggttgcaagtaggagatagactactaatggtaaacaactacagtttagaagaagtaacacacgaagaggcagtagcaatattaaagaacacatcagaggtagtttatttaaaagttggcaaacccactaccatttatatgactgatccttatggtccacctgatattactcactcttattctccaccaatggaaaaccatctactctctggcaacaatggcactttagaatataaaacctccctgccacccatctctccaggaaggtactcaccaattccaaagcacatgcttgttgacgacgactacaccaggcctccggaacctgtttacagcactgtgaacaaactatgtgataagcctgcttctcccaggcactattcccctgttgagtgtgacaaaagcttcctcctctcagctccctattcccactaccacctaggcctgctacctgactctgagatgaccagtcattcccaacatagcaccgcaactcgtcagccttcaatgactctccaacgggccgtctccctggaaggagagcctcgcaaggtagtcctgcacaaaggctccactggcctgggcttcaacattgtcggtggggaagatggagaaggtatttttgtgtccttcattctggctggtggaccagcagacctaagtggggagctccagagaggagaccagatcctatcggtgaatggcattgacctccgtggtgcatcccacgagcaggcagctgctgcactaaagggggctggacagacagtgacgattatagcacaatatcaacctgaagattacgctcgatttgaggccaaaatccatgacctacgagagcagatgatgaaccacagcatgagctccgggtccggatccctgcgaaccaatcagaaacgctccctctacgtcagagccatgttcgactacgacaagagcaaggacagtgggctgccaagtcaaggacttagttttaaatatggagatattctccacgttatcaatgcctctgatgatgagtggtggcaagccaggagagtcatgctggagggagacagtgaggagatgggggtcatccccagcaaaaggagggtggaaagaaaggaacgtgcccgattgaagacagtgaagtttaatgccaaacctggagtgattgattcgaaagggtcattcaatgacaagcgtaaaaagagcttcatcttttcacgaaaattcccattctacaagaacaaggagcagagtgagcaggaaaccagtgatcctgaacgaggacaagaagacctcattctttcctatgagcctgttacaaggcaggaaataaactacacccggccggtgattatcctggggcccatgaaggatcggatcaatgacgacttgatatctgaattccctgataaatttggctcctgtgtgcctcatactacgaggccaaagcgagactacgaggtggatggcagagactatcactttgtcatttccagagaacaaatggagaaagatatccaagagcacaagtttatagaagccggccagtacaatgacaatttatatggaaccagtgtgcagtctgtgagatttgtagcagaaagaggcaaacactgtatacttgatgtatcaggaaatgctatcaagcggttacaagttgcccagctctatcccattgccatcttcataaaacccaggtctctggaacctcttatggagatgaataagcgtctaacagaggaacaagccaagaaaacctatgatcgagcaattaagctagaacaagaatttggagaatattttacagctattgtccaaggagatactttagaagatatatataaccaatgcaagcttgttattgaagagcaatctgggcctttcatctggattccctcaaaggaaaagttataaattagctactgcgcctctgacaacgacagaagagcatttagaagaacaaaatatatataacatactacttggaggcttttatgtttttgttgcatttatgtttttgcagtcaatgtgaattcttacgaatgtacaacacaaactgtatgaagccatgaaggaaacagaggggccaaagggtgggacagaaaagacattgcagtatgaaggaaggctttggtttgctcaaagtgccaggtgtagggatgaacctctgacgggctttctgcccaagagatgagatgagagcctcctcaccccagcagatgtccagagctgatttagctgcagagctctctgtgtcttttgctttaaagaaaaattgccagcactcgaacctcatcagccttcccattacccacatctgtaattggtacactttgaattttataactatgcacatcttttgatttcttaacaagcaaatgaaagaaagaaggaaaaaagaaaggaatccctttggagatgacatactatcagggaaggataagtgtgtagttttttgactggcatctgcaaagacaagaatttcataaaatttgcaagtgtatggaggactaacctcactgacaggaggggattccacctgggattagctttatgattgttgattgcctattttgccatttataaactgaaagaaggcactaaagatgagaataatttatacaataaaaatatattaaatgtatagaaacaaatttctataggttaaaaaagttttgtgaaatattttgtaaagactaatattgaaagactaaatgtatgcaacatcagcagatgatcaaattcaagacctgaaagttgcactctcccttttgttgccaatgatctgttaagagcatctgagttccttttaagtctgacaaagacttcttcctcacttacctcccttccacattagtgatacactctcatgcagcacatcccttaatgagttgccctcatggatatttttggaagacatttggttaatgcatttttttatgctgatggcttttcagagacaaacttatgcaaatgatctaaagggaagtttttgctttcctctagttaaataacctgagcctgccatgcaaatagttgaataactttgttcctagttactgacatacaattcttaaaggaccatttagcattttggccaacaatgagtaattaggattagtacctttttgttttacagagtaactgagagttttgtaacatccagagatggtactagagccaatgagagatctgttcctagatgcactatttctttgaggaagagagagaagagaagtgtctggttgggggtgagggggtgcagacttttttgtttctatgtacagagcaaagagatagagtcacaaggaaagacaattaatgactttgagctcaaccaactgaactgcctttcttggagctgcacctggaccaagtttattttttaacaattataataacgatgatttaaaaaaagaaacctcccaaagcctataaactgaactagaagagttggtttcccactttagagtggatggcgacatcagcattgcttttgcccatggtgtttggggagagacttttcagtgataataaccactctactctgggttctgtgcatgcccagactaagccccatcgccttatttctggggtacatccagacctggcagggattctgccacactgtgcagcaaaccagcatgtaggctgggtaggagagcaagagatagagccatcagagtgatggggcttcttcacagtaagaacatcggagcttagaatgagagtctctttccaaaaacaggcattgttcatcttacgctaaacatcattgtctgcctggctacagtcaccaaaacaaaacagaaa

SEQ ID NO: 8525 - DNA, 2789 bp, Homo sapiens; identical to SEQ ID NO: 8523

SEQ ID NO: 8526 - DNA, 7890 bp, Homo sapiens
atttacagtctgcgatgcgatcccattgtaaagtatttaataggataacaccggggctctccagaaatataagtaactcattggttaaatttcaattcttcacctttccccccctccttcctgagtgagctcattcccccctccttcttcttcttcttttttttttttaatccagtgatttaaaatgctagaaggaaaagcaactgaggtcttaactttcagacgctgaattctcatctaattgaaattactgggcataatgctatatatagccaatgaagagattttgagctctcactcagtgccttcaagacatgtcgttttgtagtcagagaaaacagagatcaatgcattttcaaactgacagagggaacggatgctctttagtagcacatgcccaggatcgtgtgtgtggggcttgcgctgtgctgagaagctgaataccggtccatatgctccttatttactgcaatgttctttgcatgttactgtgcactccggactaacgtgaagaagtatcgatatcaagatgaggacgctccacatgatcattccttacctcgactaacccacgaagtaagaggcccagaactcgtgcatgtatcagaaaagaacctctctcaaatagaaaatgtccatggatatgtcttgcagtctcatatttctcctctgaaggccagtcctgctcctataattgtcaacacagatactttggacacaattccttatgtcaatgggacagaaattgaatatgaatttgaagaaattacactggagagggggaattctggcctgggattcagtattgctggggggacagataatccccacattggagatgaccctggcatatttattacgaagattataccaggaggtgctgcagcagaggatggcagactcagggtcaatgattgtatcttgcgggtgaatgaggttgatgtgtcagaggtttcccacagtaaagcggtggaagccctgaaggaagcagggtctatcgttcggctgtatgtgcgtagaagacgacctattttggagaccgttgtggaaatcaaactgttcaaaggccctaaaggtttaggcttcagtattgcaggaggtgtggggaaccaacacattcctggagacaacagcatttatgtaactaaaattatagatggaggagctgcacaaaaagatggaaggttgcaagtaggagatagactactaatggtaaacaactacagtttagaagaagtaacacacgaagaggcagtagcaatattaaagaacacatcagaggtagtttatttaaaagttggcaaacccactaccatttatatgactgatccttatggtccacctgatattactcactcttattctccaccaatggaaaaccatctactctctggcaacaatggcactttagaatataaaacctccctgccacccatctctccaggaaggtactcaccaattccaaagcacatgcttgttgacgacgactacaccaggcctccggaacctgtttacagcactgtgaacaaactatgtgataagcctgcttctcccaggcactattcccctgttgagtgtgacaaaagcttcctcctctcagctccctattcccactaccacctaggcctgctacctgactctgagatgaccagtcattcccaacatagcaccgcaactcgtcagccttcaatgactctccaacgggccgtctccctggaaggagagcctcgcaaggtagtcctgcacaaaggctccactggcctgggcttcaacattgtcggtggggaagatggagaaggtatttttgtgtccttcattctggctggtggaccagcagacctaagtggggagctccagagaggagaccagatcctatcggtgaatggcattgacctccgtggtgcatcccacgagcaggcagctgctgcactaaagggggctggacagacagtgacgattatagcacaatatcaacctgaagattacgctcgatttgaggccaaaatccatgacctacgagagcagatgatgaaccacagcatgagctccgggtccggatccctgcgaaccaatcagaaacgctccctctacgtcagagccatgttcgactacgacaagagcaaggacagtgggctgccaagtcaaggacttagttttaaatatggagatattctccacgttatcaatgcctctgatgatgagtggtggcaagccaggagagtcatgctggagggagacagtgaggagatgggggtcatccccagcaaaaggagggtggaaagaaaggaacgtgcccgattgaagacagtgaagtttaatgccaaacctggagtgattgattcgaaagggtcattcaatgacaagcgtaaaaagagcttcatcttttcacgaaaattcccattctacaagaacaaggagcagagtgagcaggaaaccagtgatcctgaacgaggacaagaagacctcattctttcctatgagcctgttacaaggcaggaaataaactacacccggccggtgattatcctggggcccatgaaggatcggatcaatgacgacttgatatctgaattccctgataaatttggctcctgtgtgcctcatactacgaggccaaagcgagactacgaggtggatggcagagactatcactttgtcatttccagagaacaaatggagaaagatatccaagagcacaagtttatagaagccggccagtacaatgacaatttatatggaaccagtgtgcagtctgtgagatttgtagcagaaagaggcaaacactgtatacttgatgtatcaggaaatgctatcaagcggttacaagttgcccagctctatcccattgccatcttcataaaacccaggtctctggaacctcttatggagatgaataagcgtctaacagaggaacaagccaagaaaacctatgatcgagcaattaagctagaacaagaatttggagaatattttacagctattgtccaaggagatactttagaagatatatataaccaatgcaagcttgttattgaagagcaatctgggcctttcatctggattccctcaaaggaaaagttataaattagctactgcgcctctgacaacgacagaagagcatttagaagaacaaaatatatataacatactacttggaggcttttatgtttttgttgcatttatgtttttgcagtcaatgtgaattcttacgaatgtacaacacaaactgtatgaagccatgaaggaaacagaggggccaaagggtgggacagaaaagacattgcagtatgaaggaaggctttggtttgctcaaagtgccaggtgtagggatgaacctctgacgggctttctgcccaagagatgagatgagagcctcctcaccccagcagatgtccagagctgatttagctgcagagctctctgtgtcttttgctttaaagaaaaattgccagcactcgaacctcatcagccttcccattacccacatctgtaattggtacactttgaattttataactatgcacatcttttgatttcttaacaagcaaatgaaagaaagaaggaaaaaagaaaggaatccctttggagatgacatactatcagggaaggataagtgtgtagttttttgactggcatctgcaaagacaagaatttcataaaatttgcaagtgtatggaggactaacctcactgacaggaggggattccacctgggattagctttatgattgttgattgcctattttgccatttataaactgaaagaaggcactaaagatgagaataatttatacaataaaaatatattaaatgtatagaaacaaatttctataggttaaaaaagttttgtgaaatattttgtaaagactaatattgaaagactaaatgtatgcaacatcagcagatgatcaaattcaagacctgaaagttgcactctcccttttgttgccaatgatctgttaagagcatctgagttccttttaagtctgacaaagacttcttcctcacttacctcccttccacattagtgatacactctcatgcagcacatcccttaatgagttgccctcatggatatttttggaagacatttggttaatgcatttttttatgctgatggcttttcagagacaaacttatgcaaatgatctaaagggaagtttttgctttcctctagttaaataacctgagcctgccatgcaaatagttgaataactttgttcctagttactgacatacaattcttaaaggaccatttagcattttggccaacaatgagtaattaggattagtacctttttgttttacagagtaactgagagttttgtaacatccagagatggtactagagccaatgagagatctgttcctagatgcactatttctttgaggaagagagagaagagaagtgtctggttgggggtgagggggtgcagacttttttgtttctatgtacagagcaaagagatagagtcacaaggaaagacaattaatgactttgagctcaaccaactgaactgcctttcttggagctgcacctggaccaagtttattttttaacaattataataacgatgatttaaaaaaagaaacctcccaaagcctataaactgaactagaagagttggtttcccactttagagtggatggcgacatcagcattgcttttgcccatggtgtttggggagagacttttcagtgataataaccactctactctgggttctgtgcatgcccagactaagccccatcgccttatttctggggtacatccagacctggcagggattctgccacactgtgcagcaaaccagcatgtaggctgggtaggagagcaagagatagagccatcagagtgatggggcttcttcacagtaagaacatcggagcttagaatgagagtctctttccaaaaacaggcattgttcatcttacgctaaacatcattgtctgcctggctacagtcaccaaaacaaaacagaaatgcaaaattatgcatcttcccatagtcctgaggcttcctttgccaatggaagggctagcaatgcattctccctctcatgaaagttaaatttccagagacttccttagattgctcaaaatgttaaagatatgtccatgtctgcaattcgccagtttcaggtcaaggcctactttcatcaatattgctcccagaagttttctgacaccagaatgccattcctgatcccagctctatttttaggccaccacgataacttctttggtttctcaactgagcatgcaaccatttatttaaaagactgtcattaatgagtagatgttttcgcgggtcgtgtgatgtgctttccatttactagtgttgctgtggctaagtacaatcaaattgaaccaccaacccttggttttgtagtaatataactatttattttcctagtgtagatgctttcagattagaattggcatttgcactgatttttttatgtagatttatataaatatatagatacatatatatttgcttgaagaatcaccaagcaaattggtgagagggtcttttccaatagaatttacacctccatttgttgtgttgtcttgcacttcccaatgttgatgtctctatggctccaatgaactggtgtattttgcagcaaatctgatgacttgtatggaaatggcatgaaagttacccagattacatctggtgcaaatgcactcggagcctggggccagactggtgctaacactgcaaactttgtccagagctctctccaacctgaaggcttgctgggggtgcaatgtcaccttcacacatgctgggccctttcagaaaagtgccagatcgtgtaactggtgctatttttcatgctctggtacaatgtgtagcaccacgggggtctcagctttaccaaaatcaaaattccatttgtcagctaagtgcagaggcatttgttttttgctctcctcccacagaattgtcggccatttatttgcaggccttttgcgggatttcttggctatttatttgcaggccttttttcccagccccaaattcttgggttggctctgtctgcttaaagagcctgtcttcacaaagctgcactcgggtgcctctgtgcgctgtcttagatcctactgccggcccttcaggactccgagccaggaaagaactctccaacctctggctcgagactctactttttttctcattcttttccttactctcctcctccttctacttccgactaattccatctctttttttttttgttcctctccttttcctattcctccttcccaccatctctgagttgttgactttctcctataatccttctctattccctttctctttttgtccacctctcctttagtctctgtttctctgcccttcttattcctcttctgtcctttctcctctcctcaaatctctgatcatcttctcccgtacatccctgtattgatttttctgtcctctaaagggctcatggctgattcagacagcaagtccatgcactggactaatgacacaaatactttaggtcgccgtttcacctactcagcccagaaagtaaagctgagcgtgaggccctgacctggagcctgctccagcccgcctcccggagccagcctgcaccgttgccctggcagcgatgatgcatgtgctgtgggccctgccggcgcctgagtgcctctgcctgaacactgctcctaagcgagcccactcccagcactaccgcatggctctgaggacattttctttcaataaaggcagactctggccccaattattctgatagcaaacctcttcctcctcattgaagccatgccatcaccttggtttggagagagacatttttttcccattcataagctttctttttcccatttttatgtgaagccccctctgcttttcagctggtgattgctctggtgagactgaatggacttgctggtgaaatgaaatctcttctttcctgtcttggtcctgcctaaattcctacaaatatatttaagccaaggactcaggctaattcctaagttgatcacattaatttgttactcctagagggaaaaagatcaattcccttgaagcatgtggagtacctcctgtgacagctgacttgccaggggactccctacagaattctgtgatatacattttacttctgtgtatgtatggtatatatggtatgtataccatgtacacacgttacattgagtatgaatgactgtggttggaaacacacacacacactcaagtctgtaaatatccttcctcactgaaacctgtgctttggaaatcatttcttgtacagctgtgcagtttcttgtaacagctgaggacaaagctaagacaggcggacaatttagacaaagatcatctaaagagtatagtatctccctagcaactcatgaggacagacaaccaagtggcaaggttgactcccaatgggatggcagacttttcttctctcctttttgagtttgtgtttcctaagtgtttcttaacttctgagtgcaccaggctgtacccgttagatcctttcaatatgacagttttgtgcttctctctgacaggatgtttctccaccgagctgtagcacaggatgggagggaggtgggaatactccttgcctaggctggagtttacagagacactgcacagcttacactcctgttaagtgtaaatattcaacacttccattccatttgtgtaaaaaataaagcacacacgattataaaatcaagatgtatatttcatactcagtgtgtctgtgcatatttattgcgtttctagttgtcagcggtgggtggccccattgtaaaaatgcctgatagagtgtttataaacatgtcatggttttattataagatataaatattaaaacattttatactttatggcaaa

SEQ ID NO: 8527 - DNA, 1831 bp, Homo sapiens
atatttatcaggatgagttacaaggaaatatatgtacccagtgagcgagaatgctgcatggtcaccccctgtgatgtaaaatatgagaatctaggaggggctgttttataattcatcaggttccgctagtgagttctgtcagagtcttagttataaaggcaagtgtgaaccggacagcagacaggagaacctggcaccaaggagacggagaagctgcctttggtgcctcctgcctcctccctgctttgttccaataattttgtgctcgattacgctcgatttgaggccaaaatccatgacctacgagagcagatgatgaaccacagcatgagctccgggtccggatccctgcgaaccaatcagaaacgctccctctacgtcagagccatgttcgactacgacaagagcaaggacagtgggctgccaagtcaaggacttagttttaaatatggagatattctccacgttatcaatgcctctgatgatgagtggtggcaagccaggagagtcatgctggagggagacagtgaggagatgggggtcatccccagcaaaaggagggtggaaagaaaggaacgtgcccgattgaagacagtgaagtttaatgccaaacctggagtgattgattcgaaaggggacatccccggattaggtgacgacggttatggaacaaagactctgaaacatgtttcttctaatgccagcgatagcgaaagtagctaccgaggacaagaagacctcattctttcctatgagcctgttacaaggcaggaaataaactacacccggccggtgattatcctggggcccatgaaggatcggatcaatgacgacttgatatctgaattccctgataaatttggctcctgtgtgcctcatactacgaggccaaagcgagactacgaggtggatggcagagactatcactttgtcatttccagagaacaaatggagaaagatatccaagagcacaagtttatagaagccggccagtacaatgacaatttatatggaaccagtgtgcagtctgtgagatttgtagcagaaagaggcaaacactgtatacttgatgtatcaggaaatgctatcaagcggttacaagttgcccagctctatcccattgccatcttcataaaacccaggtctctggaacctcttatggagatgaataagcgtctaacagaggaacaagccaagaaaacctatgatcgagcaattaagctagaacaagaatttggagaatattttacagctattgtccaaggagatactttagaagatatatataaccaatgcaagcttgttattgaagagcaatctgggcctttcatctggattccctcaaaggaaaagttataaattagctactgcgcctctgacaacgacagaagagcatttagaagaacaaaatatatataacatactacttggaggcttttatgtttttgttgcatttatgtttttgcagtcaatgtgaattcttacgaatgtacaacacaaactgtatgaagccatgaaggaaacagaggggccaaagggtgggacagaaaagacattgcagtatgaaggaaggctttggtttgctcaaagtgccaggtgtagggatgaacctctgacgggctttctgcccaagagatgagatgagagcctcctcaccccagcagatgtccagagctgatttagctgcagagctctctgtgtcttttgctttaaagaaaaattgccagcactcgaacctcatcagccttcccattacccacatctgtaattggtacactttgaattttataactatgcacatcttttgatttcttaacaagcaaatgaaaga

SEQ ID NO: 8528 - DNA, 3027 bp, Homo sapiens
agtttgagtgttaccagctttcgctatgcaacggccaagtgtttctcgggctgagaattatcagcttttgtgggatactattgcttccttaaaacaatgtgaacaagctatgcaacatgcatttattccggtcaatgggacagaaattgaatatgaatttgaagaaattacactggagagggggaattctggcctgggattcagtattgctggggggacagataatccccacattggagatgaccctggcatatttattacgaagattataccaggaggtgctgcagcagaggatggcagactcagggtcaatgattgtatcttgcgggtgaatgaggttgatgtgtcagaggtttcccacagtaaagcggtggaagccctgaaggaagcagggtctatcgttcggctgtatgtgcgtagaagacgacctattttggagaccgttgtggaaatcaaactgttcaaaggccctaaaggtttaggcttcagtattgcaggaggtgtggggaaccaacacattcctggagacaacagcatttatgtaactaaaattatagatggaggagctgcacaaaaagatggaaggttgcaagtaggagatagactactaatggtaaacaactacagtttagaagaagtaacacacgaagaggcagtagcaatattaaagaacacatcagaggtagtttatttaaaagttggcaaacccactaccatttatatgactgatccttatggtccacctgatattactcactcttattctccaccaatggaaaaccatctactctctggcaacaatggcactttagaatataaaacctccctgccacccatctctccaggaaggtactcaccaattccaaagcacatgcttgttgacgacgactacaccagtcattcccaacatagcaccgcaactcgtcagccttcaatgactctccaacgggccgtctccctggaaggagagcctcgcaaggtagtcctgcacaaaggctccactggcctgggcttcaacattgtcggtggggaagatggagaaggtatttttgtgtccttcattctggctggtggaccagcagacctaagtggggagctccagagaggagaccagatcctatcggtgaatggcattgacctccgtggtgcatcccacgagcaggcagctgctgcactaaagggggctggacagacagtgacgattatagcacaatatcaacctgaagattacgctcgatttgaggccaaaatccatgacctacgagagcagatgatgaaccacagcatgagctccgggtccggatccctgcgaaccaatcagaaacgctccctctacgtcagagccatgttcgactacgacaagagcaaggacagtgggctgccaagtcaaggacttagttttaaatatggagatattctccacgttatcaatgcctctgatgatgagtggtggcaagccaggagagtcatgctggagggagacagtgaggagatgggggtcatccccagcaaaaggagggtggaaagaaaggaacgtgcccgattgaagacagtgaagtttaatgccaaacctggagtgattgattcgaaaggggacatccccggattaggtgacgacggttatggaacaaagactctgagaggacaagaagacctcattctttcctatgagcctgttacaaggcaggaaataaactacacccggccggtgattatcctggggcccatgaaggatcggatcaatgacgacttgatatctgaattccctgataaatttggctcctgtgtgcctcatactacgaggccaaagcgagactacgaggtggatggcagagactatcactttgtcatttccagagaacaaatggagaaagatatccaagagcacaagtttatagaagccggccagtacaatgacaatttatatggaaccagtgtgcagtctgtgagatttgtagcagaaagaggcaaacactgtatacttgatgtatcaggaaatgctatcaagcggttacaagttgcccagctctatcccattgccatcttcataaaacccaggtctctggaacctcttatggagatgaataagcgtctaacagaggaacaagccaagaaaacctatgatcgagcaattaagctagaacaagaatttggagaatattttacagctattgtccaaggagatactttagaagatatatataaccaatgcaagcttgttattgaagagcaatctgggcctttcatctggattccctcaaaggaaaagttataaattagctactgcgcctctgacaacgacagaagagcatttagaagaacaaaatatatataacatactacttggaggcttttatgtttttgttgcatttatgtttttgcagtcaatgtgaattcttacgaatgtacaacacaaactgtatgaagccatgaaggaaacagaggggccaaagggtgggacagaaaagacattgcagtatgaaggaaggctttggtttgctcaaagtgccaggtgtagggatgaacctctgacgggctttctgcccaagagatgagatgagagcctcctcaccccagcagatgtccagagctgatttagctgcagagctctctgtgtcttttgctttaaagaaaaattgccagcactcgaacctcatcagccttcccattacccacatctgtaattggtacactttgaattttataactatgcacatcttttgatttcttaacaagcaaatgaaagaaagaaggaaaaaagaaaggaatccctttggagatgacatactatcagggaaggataagtgtgtagttttttgactggcatctgcaaagacaagaatttcataaaatttgcaagtgtatggaggactaacctcactgacaggaggggattccacctgggattagctttatgattgttgattgcctattttgccatttataaactgaaagaaggcactaaagatgagaataatttatacaataaaaatatattaaatgtatagaaacaaatttctataggtt

SEQ ID NO: 8529 - DNA, 5927 bp, Homo sapiens
atgtacccagtgagcgagaatgctgcatggtcaccccctgtgatgtaaaatatgagaatctaggaggggctgttttataattcatcaggttccgctagtgagttctgtcagagtcttagttataaaggcaagtgtgaaccggacagcagacaggagaacctggcaccaaggagacggagaagctgcctttggtgcctcctgcctcctccctgctttgttccaataattttgtgctcgattacgctcgatttgaggccaaaatccatgacctacgagagcagatgatgaaccacagcatgagctccgggtccggatccctgcgaaccaatcagaaacgctccctctacgtcagagccatgttcgactacgacaagagcaaggacagtgggctgccaagtcaaggacttagttttaaatatggagatattctccacgttatcaatgcctctgatgatgagtggtggcaagccaggagagtcatgctggagggagacagtgaggagatgggggtcatccccagcaaaaggagggtggaaagaaaggaacgtgcccgattgaagacagtgaagtttaatgccaaacctggagtgattgattcgaaaggggacatccccggattaggtgacgacggttatggaacaaagactctgagaggacaagaagacctcattctttcctatgagcctgttacaaggcaggaaataaactacacccggccggtgattatcctggggcccatgaaggatcggatcaatgacgacttgatatctgaattccctgataaatttggctcctgtgtgcctcatactacgaggccaaagcgagactacgaggtggatggcagagactatcactttgtcatttccagagaacaaatggagaaagatatccaagagcacaagtttatagaagccggccagtacaatgacaatttatatggaaccagtgtgcagtctgtgagatttgtagcagaaagaggcaaacactgtatacttgatgtatcaggaaatgctatcaagcggttacaagttgcccagctctatcccattgccatcttcataaaacccaggtctctggaacctcttatggagatgaataagcgtctaacagaggaacaagccaagaaaacctatgatcgagcaattaagctagaacaagaatttggagaatattttacagctattgtccaaggagatactttagaagatatatataaccaatgcaagcttgttattgaagagcaatctgggcctttcatctggattccctcaaaggaaaagttataaattagctactgcgcctctgacaacgacagaagagcatttagaagaacaaaatatatataacatactacttggaggcttttatgtttttgttgcatttatgtttttgcagtcaatgtgaattcttacgaatgtacaacacaaactgtatgaagccatgaaggaaacagaggggccaaagggtgggacagaaaagacattgcagtatgaaggaaggctttggtttgctcaaagtgccaggtgtagggatgaacctctgacgggctttctgcccaagagatgagatgagagcctcctcaccccagcagatgtccagagctgatttagctgcagagctctctgtgtcttttgctttaaagaaaaattgccagcactcgaacctcatcagccttcccattacccacatctgtaattggtacactttgaattttataactatgcacatcttttgatttcttaacaagcaaatgaaagaaagaaggaaaaaagaaaggaatccctttggagatgacatactatcagggaaggataagtgtgtagttttttgactggcatctgcaaagacaagaatttcataaaatttgcaagtgtatggaggactaacctcactgacaggaggggattccacctgggattagctttatgattgttgattgcctattttgccatttataaactgaaagaaggcactaaagatgagaataatttatacaataaaaatatattaaatgtatagaaacaaatttctataggttaaaaaagttttgtgaaatattttgtaaagactaatattgaaagactaaatgtatgcaacatcagcagatgatcaaattcaagacctgaaagttgcactctcccttttgttgccaatgatctgttaagagcatctgagttccttttaagtctgacaaagacttcttcctcacttacctcccttccacattagtgatacactctcatgcagcacatcccttaatgagttgccctcatggatatttttggaagacatttggttaatgcatttttttatgctgatggcttttcagagacaaacttatgcaaatgatctaaagggaagtttttgctttcctctagttaaataacctgagcctgccatgcaaatagttgaataactttgttcctagttactgacatacaattcttaaaggaccatttagcattttggccaacaatgagtaattaggattagtacctttttgttttacagagtaactgagagttttgtaacatccagagatggtactagagccaatgagagatctgttcctagatgcactatttctttgaggaagagagagaagagaagtgtctggttgggggtgagggggtgcagacttttttgtttctatgtacagagcaaagagatagagtcacaaggaaagacaattaatgactttgagctcaaccaactgaactgcctttcttggagctgcacctggaccaagtttattttttaacaattataataacgatgatttaaaaaaagaaacctcccaaagcctataaactgaactagaagagttggtttcccactttagagtggatggcgacatcagcattgcttttgcccatggtgtttggggagagacttttcagtgataataaccactctactctgggttctgtgcatgcccagactaagccccatcgccttatttctggggtacatccagacctggcagggattctgccacactgtgcagcaaaccagcatgtaggctgggtaggagagcaagagatagagccatcagagtgatggggcttcttcacagtaagaacatcggagcttagaatgagagtctctttccaaaaacaggcattgttcatcttacgctaaacatcattgtctgcctggctacagtcaccaaaacaaaacagaaatgcaaaattatgcatcttcccatagtcctgaggcttcctttgccaatggaagggctagcaatgcattctccctctcatgaaagttaaatttccagagacttccttagattgctcaaaatgttaaagatatgtccatgtctgcaattcgccagtttcaggtcaaggcctactttcatcaatattgctcccagaagttttctgacaccagaatgccattcctgatcccagctctatttttaggccaccacgataacttctttggtttctcaactgagcatgcaaccatttatttaaaagactgtcattaatgagtagatgttttcgcgggtcgtgtgatgtgctttccatttactagtgttgctgtggctaagtacaatcaaattgaaccaccaacccttggttttgtagtaatataactatttattttcctagtgtagatgctttcagattagaattggcatttgcactgatttttttatgtagatttatataaatatatagatacatatatatttgcttgaagaatcaccaagcaaattggtgagagggtcttttccaatagaatttacacctccatttgttgtgttgtcttgcacttcccaatgttgatgtctctatggctccaatgaactggtgtattttgcagcaaatctgatgacttgtatggaaatggcatgaaagttacccagattacatctggtgcaaatgcactcggagcctggggccagactggtgctaacactgcaaactttgtccagagctctctccaacctgaaggcttgctgggggtgcaatgtcaccttcacacatgctgggccctttcagaaaagtgccagatcgtgtaactggtgctatttttcatgctctggtacaatgtgtagcaccacgggggtctcagctttaccaaaatcaaaattccatttgtcagctaagtgcagaggcatttgttttttgctctcctcccacagaattgtcggccatttatttgcaggccttttgcgggatttcttggctatttatttgcaggccttttttcccagccccaaattcttgggttggctctgtctgcttaaagagcctgtcttcacaaagctgcactcgggtgcctctgtgcgctgtcttagatcctactgccggcccttcaggactccgagccaggaaagaactctccaacctctggctcgagactctactttttttctcattcttttccttactctcctcctccttctacttccgactaattccatctctttttttttttgttcctctccttttcctattcctccttcccaccatctctgagttgttgactttctcctataatccttctctattccctttctctttttgtccacctctcctttagtctctgtttctctgcccttcttattcctcttctgtcctttctcctctcctcaaatctctgatcatcttctcccgtacatccctgtattgatttttctgtcctctaaagggctcatggctgattcagacagcaagtccatgcactggactaatgacacaaatactttaggtcgccgtttcacctactcagcccagaaagtaaagctgagcgtgaggccctgacctggagcctgctccagcccgcctcccggagccagcctgcaccgttgccctggcagcgatgatgcatgtgctgtgggccctgccggcgcctgagtgcctctgcctgaacactgctcctaagcgagcccactcccagcactaccgcatggctctgaggacattttctttcaataaaggcagactctggccccaattattctgatagcaaacctcttcctcctcattgaagccatgccatcaccttggtttggagagagacatttttttcccattcataagctttctttttcccatttttatgtgaagccccctctgcttttcagctggtgattgctctggtgagactgaatggacttgctggtgaaatgaaatctcttctttcctgtcttggtcctgcctaaattcctacaaatatatttaagccaaggactcaggctaattcctaagttgatcacattaatttgttactcctagagggaaaaagatcaattcccttgaagcatgtggagtacctcctgtgacagctgacttgccaggggactccctacagaattctgtgatatacattttacttctgtgtatgtatggtatatatggtatgtataccatgtacacacgttacattgagtatgaatgactgtggttggaaacacacacacacactcaagtctgtaaatatccttcctcactgaaacctgtgctttggaaatcatttcttgtacagctgtgcagtttcttgtaacagctgaggacaaagctaagacaggcggacaatttagacaaagatcatctaaagagtatagtatctccctagcaactcatgaggacagacaaccaagtggcaaggttgactcccaatgggatggcagacttttcttctctcctttttgagtttgtgtttcctaagtgtttcttaacttctgagtgcaccaggctgtacccgttagatcctttcaatatgacagttttgtgcttctctctgacaggatgtttctccaccgagctgtagcacaggatgggagggaggtgggaatactccttgcctaggctggagtttacagagacactgcacagcttacactcctgttaagtgtaaatattcaacacttccattccatttgtgtaaaaaataaagcacacacgattataaaa

SEQ ID NO: 8530 - DNA, 2872 bp, Homo sapiens
gtgtggggcttgcgctgtgctgagaagctgaataccggtccatatgctccttatttactgcaatgttctttgcatgttactgtgcactccggactaacgtgaagaagtatcgatatcaagatgaggacgctccacatgatcattccttacctcgactaacccacgaagtaagaggcccagaactcgtgcatgtatcagaaaagaacctctctcaaatagaaaatgtccatggatatgtcttgcagtctcatatttctcctctgaaggccagtcctgctcctataattgtcaacacagatactttggacacaattccttatgtcaatgggacagaaattgaatatgaatttgaagaaattacactggagagggggaattctggcctgggattcagtattgctggggggacagataatccccacattggagatgaccctggcatatttattacgaagattataccaggaggtgctgcagcagaggatggcagactcagggtcaatgattgtatcttgcgggtgaatgaggttgatgtgtcagaggtttcccacagtaaagcggtggaagccctgaaggaagcagggtctatcgttcggctgtatgtgcgtagaagacgacctattttggagaccgttgtggaaatcaaactgttcaaaggccctaaaggtttaggcttcagtattgcaggaggtgtggggaaccaacacattcctggagacaacagcatttatgtaactaaaattatagatggaggagctgcacaaaaagatggaaggttgcaagtaggagatagactactaatggtaaacaactacagtttagaagaagtaacacacgaagaggcagtagcaatattaaagaacacatcagaggtagtttatttaaaagttggcaaacccactaccatttatatgactgatccttatggtccacctgatattactcactcttattctccaccaatggaaaaccatctactctctggcaacaatggcactttagaatataaaacctccctgccacccatctctccaggaaggtactcaccaattccaaagcacatgcttgttgacgacgactacaccaggcctccggaacctgtttacagcactgtgaacaaactatgtgataagcctgcttctcccaggcactattcccctgttgagtgtgacaaaagcttcctcctctcagctccctattcccactaccacctaggcctgctacctgactctgagatgaccagtcattcccaacatagcaccgcaactcgtcagccttcaatgactctccaacgggccgtctccctggaaggagagcctcgcaaggtagtcctgcacaaaggctccactggcctgggcttcaacattgtcggtggggaagatggagaaggtatttttgtgtccttcattctggctggtggaccagcagacctaagtggggagctccagagaggagaccagatcctatcggtgaatggcattgacctccgtggtgcatcccacgagcaggcagctgctgcactaaagggggctggacagacagtgacgattatagcacaatatcaacctgaagattacgctcgatttgaggccaaaatccatgacctacgagagcagatgatgaaccacagcatgagctccgggtccggatccctgcgaaccaatcagaaacgctccctctacgtcagagccatgttcgactacgacaagagcaaggacagtgggctgccaagtcaaggacttagttttaaatatggagatattctccacgttatcaatgcctctgatgatgagtggtggcaagccaggagagtcatgctggagggagacagtgaggagatgggggtcatccccagcaaaaggagggtggaaagaaaggaacgtgcccgattgaagacagtgaagtttaatgccaaacctggagtgattgattcgaaaggggacatccccggattaggtgacgacggttatggaacaaagactctgaaacatgtttcttctaatgccagcgatagcgaaagtagctaccgaggacaagaagacctcattctttcctatgagcctgttacaaggcaggaaataaactacacccggccggtgattatcctggggcccatgaaggatcggatcaatgacgacttgatatctgaattccctgataaatttggctcctgtgtgcctcatactacgaggccaaagcgagactacgaggtggatggcagagactatcactttgtcatttccagagaacaaatggagaaagatatccaagagcacaagtttatagaagccggccagtacaatgacaatttatatggaaccagtgtgcagtctgtgagatttgtagcagaaagaggcaaacactgtatacttgatgtatcaggaaatgctatcaagcggttacaagttgcccagctctatcccattgccatcttcataaaacccaggtctctggaacctcttatggagatgaataagcgtctaacagaggaacaagccaagaaaacctatgatcgagcaattaagctagaacaagaatttggagaatattttacagctattgtccaaggagatactttagaagatatatataaccaatgcaagcttgttattgaagagcaatctgggcctttcatctggattccctcaaaggaaaagttataaattagctactgcgcctctgacaacgacagaagagcatttagaagaacaaaatatatataacatactacttggaggcttttatgtttttgttgcatttatgtttttgcagtcaatgtgaattcttacgaatgtacaacacaaactgtatgaagccatgaaggaaacagaggggccaaagggtgggacagaaaagacattgcagtatgaag

SEQ ID NO: 8531 - DNA, 559 bp, Homo sapiens
attaacactacgctgtgaataactttgtttactctcttccacattttaaaagaagataccagactaccacttcagagttggaatttcaaacaccagcagctagctgggaggcaggattgaatttggagataagaattcttcctggcgtccttcagcagcctccccaggcaggttttcacctcttcgacttttccaggactaagcctttttaactgagaagagaaagaaaaagagattacgctcgatttgaggccaaaatccatgacctacgagagcagatgatgaaccacagcatgagctccgggtccggatccctgcgaaccaatcagaaacgctccctctacgtcagagccatgttcgactacgacaagagcaaggacagtgggctgccaagtcaaggacttagttttaaatatggagatattctccacgttatcaatgcctctgatgatgagtggtggcaagccaggagagtcatgctggagggagacagtgaggagatgggggtcatccccagcaaaaggagggtggaaagaaaggaacgtgcccgattgaagac

SEQ ID NO: 8532 - DNA, 2891 bp, Homo sapiens
aatccagtgatttaaaatgctagaaggaaaagcaactgaggtcttaactttcagacgctgaattctcatctaattgaaattactgggcataatgctatatatagccaatgaagagattttgagctctcactcagtgccttcaagacatgtcgttttgtagtcagagaaaacagagatcaatgcattttcaaactgacagagggaacggatgctctttagtagcacatgcccaggatcgtgtgtgtggggcttgcgctgtgctgagaagctgaataccggtccatatgctccttatttactgcaatgttctttgcatgttactgtgcactccggactaacgtgaagaagtatcgatatcaagatgaggacgctccacatgatcattccttacctcgactaacccacgaagtaagaggcccagaactcgtgcatgtatcagaaaagaacctctctcaaatagaaaatgtccatggatatgtcttgcagtctcatatttctcctctgaaggccagtcctgctcctataattgtcaacacagatactttggacacaattccttatgtcaatgggacagaaattgaatatgaatttgaagaaattacactggagagggggaattctggcctgggattcagtattgctggggggacagataatccccacattggagatgaccctggcatatttattacgaagattataccaggaggtgctgcagcagaggatggcagactcagggtcaatgattgtatcttgcgggtgaatgaggttgatgtgtcagaggtttcccacagtaaagcggtggaagccctgaaggaagcagggtctatcgttcggctgtatgtgcgtagaagacgacctattttggagaccgttgtggaaatcaaactgttcaaaggccctaaaggtttaggcttcagtattgcaggaggtgtggggaaccaacacattcctggagacaacagcatttatgtaactaaaattatagatggaggagctgcacaaaaagatggaaggttgcaagtaggagatagactactaatggtaaacaactacagtttagaagaagtaacacacgaagaggcagtagcaatattaaagaacacatcagaggtagtttatttaaaagttggcaaacccactaccatttatatgactgatccttatggtccacctgatattactcactcttattctccaccaatggaaaaccatctactctctggcaacaatggcactttagaatataaaacctccctgccacccatctctccaggaaggtactcaccaattccaaagcacatgcttgttgacgacgactacaccaggcctccggaacctgtttacagcactgtgaacaaactatgtgataagcctgcttctcccaggcactattcccctgttgagtgtgacaaaagcttcctcctctcagctccctattcccactaccacctaggcctgctacctgactctgagatgaccagtcattcccaacatagcaccgcaactcgtcagccttcaatgactctccaacgggccgtctccctggaaggagagcctcgcaaggtagtcctgcacaaaggctccactggcctgggcttcaacattgtcggtggggaagatggagaaggtatttttgtgtccttcattctggctggtggaccagcagacctaagtggggagctccagagaggagaccagatcctatcggtgaatggcattgacctccgtggtgcatcccacgagcaggcagctgctgcactaaagggggctggacagacagtgacgattatagcacaatatcaacctgaagattacgctcgatttgaggccaaaatccatgacctacgagagcagatgatgaaccacagcatgagctccgggtccggatccctgcgaaccaatcagaaacgctccctctacgtcagagccatgttcgactacgacaagagcaaggacagtgggctgccaagtcaaggacttagttttaaatatggagatattctccacgttatcaatgcctctgatgatgagtggtggcaagccaggagagtcatgctggagggagacagtgaggagatgggggtcatccccagcaaaaggagggtggaaagaaaggaacgtgcccgattgaagacagtgaagtttaatgccaaacctggagtgattgattcgaaaggggacatccccggattaggtgacgacggttatggaacaaagactctgagaggacaagaagacctcattctttcctatgagcctgttacaaggcaggaaataaactacacccggccggtgattatcctggggcccatgaaggatcggatcaatgacgacttgatatctgaattccctgataaatttggctcctgtgtgcctcatactacgaggccaaagcgagactacgaggtggatggcagagactatcactttgtcatttccagagaacaaatggagaaagatatccaagagcacaagtttatagaagccggccagtacaatgacaatttatatggaaccagtgtgcagtctgtgagatttgtagcagaaagaggcaaacactgtatacttgatgtatcaggaaatgctatcaagcggttacaagttgcccagctctatcccattgccatcttcataaaacccaggtctctggaacctcttatggagatgaataagcgtctaacagaggaacaagccaagaaaacctatgatcgagcaattaagctagaacaagaatttggagaatattttacagctattgtccaaggagatactttagaagatatatataaccaatgcaagcttgttattgaagagcaatctgggcctttcatctggattccctcaaaggaaaagttataaattagctactgcgcctctgacaacgacag

SEQ ID NO: 8533 - DNA, 2831 bp, Homo sapiens
aacaatgtgaacaagctatgcaacatgcatttattccggccagtcctgctcctataattgtcaacacagatactttggacacaattccttatgtcaatgggacagaaattgaatatgaatttgaagaaattacactggagagggggaattctggcctgggattcagtattgctggggggacagataatccccacattggagatgaccctggcatatttattacgaagattataccaggaggtgctgcagcagaggatggcagactcagggtcaatgattgtatcttgcgggtgaatgaggttgatgtgtcagaggtttcccacagtaaagcggtggaagccctgaaggaagcagggtctatcgttcggctgtatgtgcgtagaagacgacctattttggagaccgttgtggaaatcaaactgttcaaaggccctaaaggtttaggcttcagtattgcaggaggtgtggggaaccaacacattcctggagacaacagcatttatgtaactaaaattatagatggaggagctgcacaaaaagatggaaggttgcaagtaggagatagactactaatggtaaacaactacagtttagaagaagtaacacacgaagaggcagtagcaatattaaagaacacatcagaggtagtttatttaaaagttggcaaacccactaccatttatatgactgatccttatggtccacctgatattactcactcttattctccaccaatggaaaaccatctactctctggcaacaatggcactttagaatataaaacctccctgccacccatctctccaggaaggtactcaccaattccaaagcacatgcttgttgacgacgactacaccaggcctccggaacctgtttacagcactgtgaacaaactatgtgataagcctgcttctcccaggcactattcccctgttgagtgtgacaaaagcttcctcctctcagctccctattcccactaccacctaggcctgctacctgactctgagatgaccagtcattcccaacatagcaccgcaactcgtcagccttcaatgactctccaacgggccgtctccctggaaggagagcctcgcaaggtagtcctgcacaaaggctccactggcctgggcttcaacattgtcggtggggaagatggagaaggtatttttgtgtccttcattctggctggtggaccagcagacctaagtggggagctccagagaggagaccagatcctatcggtgaatggcattgacctccgtggtgcatcccacgagcaggcagctgctgcactaaagggggctggacagacagtgacgattatagcacaatatcaacctgaagattacgctcgatttgaggccaaaatccatgacctacgagagcagatgatgaaccacagcatgagctccgggtccggatccctgcgaaccaatcagaaacgctccctctacgtcagagccatgttcgactacgacaagagcaaggacagtgggctgccaagtcaaggacttagttttaaatatggagatattctccacgttatcaatgcctctgatgatgagtggtggcaagccaggagagtcatgctggagggagacagtgaggagatgggggtcatccccagcaaaaggagggtggaaagaaaggaacgtgcccgattgaagacagtgaagtttaatgccaaacctggagtgattgattcgaaaggggacatccccggattaggtgacgacggttatggaacaaagactctgaaacatgtttcttctaatgccagcgatagcgaaagtagctaccgaggacaagaagacctcattctttcctatgagcctgttacaaggcaggaaataaactacacccggccggtgattatcctggggcccatgaaggatcggatcaatgacgacttgatatctgaattccctgataaatttggctcctgtgtgcctcatactacgaggccaaagcgagactacgaggtggatggcagagactatcactttgtcatttccagagaacaaatggagaaagatatccaagagcacaagtttatagaagccggccagtacaatgacaatttatatggaaccagtgtgcagtctgtgagatttgtagcagaaagaggcaaacactgtatacttgatgtatcaggaaatgctatcaagcggttacaagttgcccagctctatcccattgccatcttcataaaacccaggtctctggaacctcttatggagatgaataagcgtctaacagaggaacaagccaagaaaacctatgatcgagcaattaagctagaacaagaatttggagaatattttacagctattgtccaaggagatactttagaagatatatataaccaatgcaagcttgttattgaagagcaatctgggcctttcatctggattccctcaaaggaaaagttataaattagctactgcgcctctgacaacgacagaagagcatttagaagaacaaaatatatataacatactacttggaggcttttatgtttttgttgcatttatgtttttgcagtcaatgtgaattcttacgaatgtacaacacaaactgtatgaagccatgaaggaaacagaggggccaaagggtgggacagaaaagacattgcagtatgaaggaaggctttggtttgctcaaagtgccaggtgtagggatgaacctctgacgggctttctgcccaagagatgagatgagagcctcctcaccccagcagatgtccagagctgatttagctgcagagctctctgtgtcttttgctttaaagaaaaattgccagcactcgaacctcatcagccttcccatta

SEQ ID NO: 8534 - DNA, 3680 bp, Homo sapiens
atgggtatctttaagagcagcttattccaagctttgctagatatccaagaattttatgaggtgacattgctaaattctcaaaaaagttgtgagcagaagatagaagaagccaatcaagttttacagaaatgggagaagacatcccttcttgctccgtgccatgacagacttcaaaaatcttcagagcttacagattgcagtggatcaaaggaaaatgcttcatgtattgagcaaaataaagaaaatcagagttttgaaaatgaaactgatgagacgacaactcaaaaccaaggcagatgcccagcccagaattgttcagtggaagcccctgcttggatgcctgtccaccactgtactaagtatcgatatcaagatgaggacgctccacatgatcattccttacctcgactaacccacgaagtaagaggcccagaactcgtgcatgtatcagaaaagaacctctctcaaatagaaaatgtccatggatatgtcttgcagtctcatatttctcctctgaaggccagtcctgctcctataattgtcaacacagatactttggacacaattccttatgtcaatgggacagaaattgaatatgaatttgaagaaattacactggagagggggaattctggcctgggattcagtattgctggggggacagataatccccacattggagatgaccctggcatatttattacgaagattataccaggaggtgctgcagcagaggatggcagactcagggtcaatgattgtatcttgcgggtgaatgaggttgatgtgtcagaggtttcccacagtaaagcggtggaagccctgaaggaagcagggtctatcgttcggctgtatgtgcgtagaagacgacctattttggagaccgttgtggaaatcaaactgttcaaaggccctaaaggtttaggcttcagtattgcaggaggtgtggggaaccaacacattcctggagacaacagcatttatgtaactaaaattatagatggaggagctgcacaaaaagatggaaggttgcaagtaggagatagactactaatggtaaacaactacagtttagaagaagtaacacacgaagaggcagtagcaatattaaagaacacatcagaggtagtttatttaaaagttggcaaacccactaccatttatatgactgatccttatggtccacctgatattactcactcttattctccaccaatggaaaaccatctactctctggcaacaatggcactttagaatataaaacctccctgccacccatctctccaggaaggtactcaccaattccaaagcacatgcttgttgacgacgactacaccaggcctccggaacctgtttacagcactgtgaacaaactatgtgataagcctgcttctcccaggcactattcccctgttgagtgtgacaaaagcttcctcctctcagctccctattcccactaccacctaggcctgctacctgactctgagatgaccagtcattcccaacatagcaccgcaactcgtcagccttcaatgactctccaacgggccgtctccctggaaggagagcctcgcaaggtagtcctgcacaaaggctccactggcctgggcttcaacattgtcggtggggaagatggagaaggtatttttgtgtccttcattctggctggtggaccagcagacctaagtggggagctccagagaggagaccagatcctatcggtgaatggcattgacctccgtggtgcatcccacgagcaggcagctgctgcactaaagggggctggacagacagtgacgattatagcacaatatcaacctgaagattacgctcgatttgaggccaaaatccatgacctacgagagcagatgatgaaccacagcatgagctccgggtccggatccctgcgaaccaatcagaaacgctccctctacgtcagagccatgttcgactacgacaagagcaaggacagtgggctgccaagtcaaggacttagttttaaatatggagatattctccacgttatcaatgcctctgatgatgagtggtggcaagccaggagagtcatgctggagggagacagtgaggagatgggggtcatccccagcaaaaggagggtggaaagaaaggaacgtgcccgattgaagacagtgaagtttaatgccaaacctggagtgattgattcgaaagggtcattcaatgacaagcgtaaaaagagcttcatcttttcacgaaaattcccattctacaagaacaaggagcagagtgagcaggaaaccagtgatcctgaacgaggacaagaagacctcattctttcctatgagcctgttacaaggcaggaaataaactacacccggccggtgattatcctggggcccatgaaggatcggatcaatgacgacttgatatctgaattccctgataaatttggctcctgtgtgcctcatactacgaggccaaagcgagactacgaggtggatggcagagactatcactttgtcatttccagagaacaaatggagaaagatatccaagagcacaagtttatagaagccggccagtacaatgacaatttatatggaaccagtgtgcagtctgtgagatttgtagcagaaagaggcaaacactgtatacttgatgtatcaggaaatgctatcaagcggttacaagttgcccagctctatcccattgccatcttcataaaacccaggtctctggaacctcttatggagatgaataagcgtctaacagaggaacaagccaagaaaacctatgatcgagcaattaagctagaacaagaatttggagaatattttacagctattgtccaaggagatactttagaagatatatataaccaatgcaagcttgttattgaagagcaatctgggcctttcatctggattccctcaaaggaaaagttataaattagctactgcgcctctgacaacgacagaagagcatttagaagaacaaaatatatataacatactacttggaggcttttatgtttttgttgcatttatgtttttgcagtcaatgtgaattcttacgaatgtacaacacaaactgtatgaagccatgaaggaaacagaggggccaaagggtgggacagaaaagacattgcagtatgaaggaaggctttggtttgctcaaagtgccaggtgtagggatgaacctctgacgggctttctgcccaagagatgagatgagagcctcctcaccccagcagatgtccagagctgatttagctgcagagctctctgtgtcttttgctttaaagaaaaattgccagcactcgaacctcatcagccttcccattacccacatctgtaattggtacactttgaattttataactatgcacatcttttgatttcttaacaagcaaatgaaagaaagaaggaaaaaagaaaggaatccctttggagatgacatactatcagggaaggataagtgtgtagttttttgactggcatctgcaaagacaagaatttcataaaatttgcaagtgtatggaggactaacctcactgacaggaggggattccacctgggattagctttatgattgttgattgcctattttgccatttataaactgaaagaaggcactaaagatgagaataatttatacaataaaaatatattaaatgtatagaaacaaatttctataggtt

SEQ ID NO: 8535 - DNA, 2928 bp, Homo sapiens
tttggttttatagtctctgttcattttcaaagttacttaaatatccaagaattttatgaggtgacattgctaaattctcaaaaaagttgtgagcagaagatagaagaagccaatcaagttttacagaaatgggagaagacatcccttcttgctccgtgccatgacagacttcaaaaatcttcagagcttacagattgcagtggatcaaaggaaaatgcttcatgtattgagcaaaataaagaaaatcagagttttgaaaatgaaactgatgagacgacaactcaaaaccaaggcagatgcccagcccagaattgttcagtggaagcccctgcttggatgcctgtccaccactgtactaagtatcgatatcaagatgaggacgctccacatgatcattccttacctcgactaacccacgaagtaagaggcccagaactcgtgcatgtatcagaaaagaacctctctcaaatagaaaatgtccatggatatgtcttgcagtctcatatttctcctctgaaggccagtcctgctcctataattgtcaacacagatactttggacacaattccttatgtcaatgggacagaaattgaatatgaatttgaagaaattacactggagagggggaattctggcctgggattcagtattgctggggggacagataatccccacattggagatgaccctggcatatttattacgaagattataccaggaggtgctgcagcagaggatggcagactcagggtcaatgattgtatcttgcgggtgaatgaggttgatgtgtcagaggtttcccacagtaaagcggtggaagccctgaaggaagcagggtctatcgttcggctgtatgtgcgtagaagacgacctattttggagaccgttgtggaaatcaaactgttcaaaggccctaaaggtttaggcttcagtattgcaggaggtgtggggaaccaacacattcctggagacaacagcatttatgtaactaaaattatagatggaggagctgcacaaaaagatggaaggttgcaagtaggagatagactactaatggtaaacaactacagtttagaagaagtaacacacgaagaggcagtagcaatattaaagaacacatcagaggtagtttatttaaaagttggcaaacccactaccatttatatgactgatccttatggtccacctgatattactcactcttattctccaccaatggaaaaccatctactctctggcaacaatggcactttagaatataaaacctccctgccacccatctctccaggaaggtactcaccaattccaaagcacatgcttgttgacgacgactacaccaggcctccggaacctgtttacagcactgtgaacaaactatgtgataagcctgcttctcccaggcactattcccctgttgagtgtgacaaaagcttcctcctctcagctccctattcccactaccacctaggcctgctacctgactctgagatgaccagtcattcccaacatagcaccgcaactcgtcagccttcaatgactctccaacgggccgtctccctggaaggagagcctcgcaaggtagtcctgcacaaaggctccactggcctgggcttcaacattgtcggtggggaagatggagaaggtatttttgtgtccttcattctggctggtggaccagcagacctaagtggggagctccagagaggagaccagatcctatcggtgaatggcattgacctccgtggtgcatcccacgagcaggcagctgctgcactaaagggggctggacagacagtgacgattatagcacaatatcaacctgaagattacgctcgatttgaggccaaaatccatgacctacgagagcagatgatgaaccacagcatgagctccgggtccggatccctgcgaaccaatcagaaacgctccctctacgtcagagccatgttcgactacgacaagagcaaggacagtgggctgccaagtcaaggacttagttttaaatatggagatattctccacgttatcaatgcctctgatgatgagtggtggcaagccaggagagtcatgctggagggagacagtgaggagatgggggtcatccccagcaaaaggagggtggaaagaaaggaacgtgcccgattgaagacagtgaagtttaatgccaaacctggagtgattgattcgaaagggtcattcaatgacaagcgtaaaaagagcttcatcttttcacgaaaattcccattctacaagaacaaggagcagagtgagcaggaaaccagtgatcctgaacgaggacaagaagacctcattctttcctatgagcctgttacaaggcaggaaataaactacacccggccggtgattatcctggggcccatgaaggatcggatcaatgacgacttgatatctgaattccctgataaatttggctcctgtgtgcctcatactacgaggccaaagcgagactacgaggtggatggcagagactatcactttgtcatttccagagaacaaatggagaaagatatccaagagcacaagtttatagaagccggccagtacaatgacaatttatatggaaccagtgtgcagtctgtgagatttgtagcagaaagaggcaaacactgtatacttgatgtatcaggaaatgctatcaagcggttacaagttgcccagctctatcccattgccatcttcataaaacccaggtctctggaacctcttatggagatgaataagcgtctaacagaggaacaagccaagaaaacctatgatcgagcaattaagctagaacaagaatttggagaatattttacagctattgtccaaggagatactttagaagatatatataaccaatgcaagcttgttattgaagagcaatctgggcctttcatctggattccctcaaaggaaaagttataa

SEQ ID NO: 8536 - DNA, 6109 bp, Homo sapiens
cagagcagaagcggtcctcacagcacccattctctgcttgagctcccgcttcttctttgccgctgggcctcggcccagaagccacgacgggcgacacggagccgccagtgctggagggggagccgtgggtgcggggcagcgtgggggccgaggccccgggacgcccgcccggccccaggccccgctcagcccgggcgcccccacgggtgccccccccttcttggtccgagcagtgtgagtgtgccagggagcccggcggcggcggcggcggtggtggcggcggtggcggcggcgtggaatccggcgtgggctggggggtccgagccgcggggggcagtgccatgcacaagcaccagcactgctgtaagtgccctgagtgctatgaggtgacccgcctggccgccctgcggcgcctcgagcctccgggctacggcgactggcaagtccccgacccttacgggccaggtgggggcaacggcgccagcgcgggttatgggggctacagctcgcagaccttgccctcgcaggcgggggccacccccacccctcgcaccaaggccaagctcatccccaccggccgggatgtggggccggtgcctcctaagccagtcccgggcaagagcacccccaaactcaacggcagcggccccagctggtggccagagtgcacctgtaccaaccgggactggtatgagcaggccaggcctgcacccctcctagtgaaccctgagacactgaagcacagcctctcggtgaatggcagtgatggcatgttcaaatatgaggaaatcgtacttgagaggggcaactctggcctgggcttcagtatcgcaggtggcatcgacaatccccatgtccctgatgaccctggcatctttattaccaagattatccctggtggagcagctgccatggatgggaggctgggggtgaatgactgtgtgctgcgggtgaatgaggtggacgtgtcggaggtggtacacagccgggcggtggaggcgctgaaggaggcaggccctgtggtgcgattggtggtgcggaggcgacagcctccacccgagaccatcatggaggtcaacctgctcaaagggcccaaaggcctgggtttcagcattgctgggggtattggcaaccagcacatcccaggagacaacagcatctacatcaccaagatcattgaggggggtgctgctcagaaggatggacgcctacagattggggaccggctgctggcggtgaacaacaccaatctgcaggatgtgaggcacgaggaagctgtggcctcactgaagaacacatctgatatggtgtatttgaaggtggccaagccaggcagcctccacctcaacgacatgtacgctccccctgactacgccagcacttttactgccttggctgacaaccacataagccataattccagcctgggttatctcggggctgtggagagcaaggtcagctaccctgctcctcctcaggttccccccacccgctactctcctattcccaggcacatgctggctgaggaggacttcaccagagagcctcgcaagatcatcctgcacaaaggctccacaggcctgggcttcaacatcgtaggaggagaggatggagaaggcatttttgtctccttcatcctggcaggaggcccagctgacctgagtggggagctgcgcaggggagaccggatcttatcggtgaatggagtgaatctgaggaatgcaactcatgagcaggctgcagctgctctgaaacgggccggccagtcagtcaccattgtggcccagtacagacctgaagaatacagtcgctttgaatcgaagatacatgacttacgagaacaaatgatgaacagcagcatgagctctgggtctgggtccctccgaacaagtgaaaagaggtccttgtatgtcagggccctgtttgattatgatcggactcgggacagctgcctgccaagccaggggctcagcttctcttatggtgacattctgcatgtcattaatgcctctgatgatgagtggtggcaggcaaggctggtgaccccacacggagaaagtgagcagatcggtgtgatccccagtaagaagagggtggaaaagaaagaaagagctcgattgaaaactgtgaagttccatgccaggacggggatgattgagtctaacagggacttcccggggttaagtgacgattattatggagcaaagaacctgaagggagtgacatccaacaccagtgacagcgaaagcagttccaaaggacaagaggatgctattttgtcatatgagccagtgacacggcaagaaattcactatgcaaggcctgtgatcatcctgggcccaatgaaggaccgagtcaatgatgacctgatctccgaatttccacataaatttggatcctgtgtgccacatactacccggcctcgacgtgataatgaggtggatggacaagactaccactttgtggtgtcccgagaacaaatggagaaagatattcaggacaacaagttcatcgaggcgggccaatttaatgataacctctatgggaccagcatccagtcagtgcgggcagttgcagagaggggcaagcactgcatcttagatgtttccggcaatgctatcaagagactgcagcaagcacaactttaccccattgccattttcatcaagcccaagtccattgaagcccttatggaaatgaaccgaaggcagacatatgaacaagcaaataagatctatgacaaagccatgaaactggagcaggaatttggagagtactttacagccattgtacagggtgactcactggaagagatttataacaaaatcaaacaaatcattgaggaccagtctgggcactacatttgggtcccatcccctgaaaaactctgaagaatcccctccaaccattctcttgtgaacagaagaaatcaagtccctcttccctcctccctcttcattcctgtccccatggggagaacaaatgctactgttcttgtccccttttttagatatgtcaaaaaaaattaagttttctagtcctgttctttttttttttttaagtttttgtttgtttcagtttattttttgggatgatgccatctcattcatcatgtgactgtgcccattcctgcatggacctttcccaagcgctagcacaggtgcaaaatccatcagagccattgttttcataaaaaccaagcagaagtgaagagaaaagaggaggactgatggaaagacagactctggacagctgcacggcttgtgaagtgagctaaatgcaccacatgatgagatgctcctgggcatttctccctatctgtactgctgtcttgcagctctgaacggtgcaacgtaatggcgacagaaagtatcttatttatatatagatatatatatgtaatttatataaaatatatagaaattattatatatatatattatacactctcatataatatatatatattcacacacatttgggttagaaaatctatggagacttcatcaatggtactatgttattagagaaatgctttaattttcatattccaatcagatggcatcttctatcccagctggttgggaagggattgaagatggtagcaagtgctgcactaagggcactcgcatttggtcattctcttgagagctaggaggggtcagcctgaggccggagaggaagggcttttgcctggggtgagagggtgagagacttgacctgaaagcagctgctgcccctgaggtgcagccagagtcctgtgtgcggacagagagaatggctaatgatgctccgcgtggaattgcctattgttttatgccacctgatgtgtctgcatgagaggtttcctttttgttcctttttaagctgctgttaaaccaaaaccatgttgtgctactgtgtcagccttttcattattgcaaattttacttttactatttaagtgaatgcatagaatccaatttgccaaggttctaaaggcttatgaggtcctgaaggagccaggccttgtgatggagtaggtgacacaggcctggttgtcctgtcagcagaagggaaagcaggggctgggctgagaggaggacacggagggctctgctgaggttccttcctgggttccaccaacagggacagggagtcacttgccttccagttctgtgctgggatggcgggacagcacttggcttgcttggccagctgcgtcatgagtttgatttggtttttttttttttgcagctgcttcatatgctctgctccagcccctccccaacagctggtagcttatggtttcttcaagaggaaagtagactttatgctgtacatttgagctgtagagctaagattcgcttactggtgagctgtgaaaccttgttgctttttcccagagtctgatggcagtgactgtgatcaagggaatcttcaccgccacaagtgcaggcagcaggtgtggttcaggtccccccccaccccactgtgctcctttgaagccaacgtgcctccctcgcctccatactggagggacgacgcaggggagaacagagaagtgcttggccctaggattgaggcacttgtttcctagcccgctgggttagggctggtgcaagcgaggcaatgttgaggatgctttaagcactaccagccgaatccgggaactctgttaacagttgtccaaccagcagaatgaggctaactgtataaagcatgggacccaggatgaggataaggaaaggacagcggctttccctgggcagtacaatggcttgaaggcaaaaagggataaagtgacagccgactgtgactctggtgaggaggggtgagcagggaggttgattctctgatgttaactaagtggcaaagtctcaaccgtgctcagccctccccctcccagggaagagaaacaaagattcaaagtaagcatgatactagtgggtttaccagtgtttcttccaaggagacatatattttttaataaacgatagttgcaatgaactgtggctcagagaccttcttaaagtagttgagaagggagggcgtgggcaaagcagtgggaagaacatcccaaacttttgggggccagagggctctctccttagtgatgatcagctagccgagctgggccgtcctggggatcggtacagctccctggggtggtgacaggccctttgtgaaagttgtgtgcttggtcttccaccccagccccagacactgcttcaaatagcaccaaccagatgggagtccacatctgtggtggcaaaatgctgacattttcccaagaggtacacaaggtgggagaggcctgctgtagcagaggtgtgtgttagagaaagcaggggcctgatttagtagcagagaactgggtgagaaaaatggccagagaaagtgacctgccagctaccagtgtttccgaaaatgagggtgggatgggcccatttgcagagcaggacagcagtcatccccatagccctctgaggaggggagggatgcttagagcaggcagttctggcagttctgacgtggcaggtgccattgcaacttgtgcggaggagtcttaggaagtgctgtcataattcataaggtcaagagcaacatctggatgaatgagccacctgaaatgtgtgtgggctgagccacaggaagggtgagtcctcttgcttgtggtgctttatggtgtgcaggttgcttgctttcccacattctctcatttgcttgaaggcagcctaacaaaagggagtccccaaagagctccatgagagcttaagaaaattcatctcctgaggacaaagagaacaaagatctgtcctgtggtcacactgttgaggctctgtcttcacagctgatgttctcctagtggaggtacagctgaagaacattcagccccagcacgagaagatacagagcaacttggaaaccccaaagggagacacacccttaacactgccgtgctgtgctgtgccgtgtcctgaaggaggagagagccctatctcctcctggttttgttgctgacattgcagctgatcatgccttgactccttcatctctaacagaggaagaactgtattatcaaaccttatggtctacccatgaataaataaaatatttgttcaagcac

SEQ ID NO: 8537 - DNA, 5905 bp, Homo sapiens
tgctggagggggagccgtgggtgcggggcagcgtgggggccgaggccccgggacgcccgcccggccccaggccccgctcagcccgggcgcccccacgggtgccccccccttcttggtccgagcagtgtgagtgtgccagggagcccggcggcggcggcggcggtggtggcggcggtggcggcggcgtggaatccggcgtgggctggggggtccgagccgcggggggcagtgccatgcacaagcaccagcactgctgtaagtgccctgagtgctatgaggtgacccgcctggccgccctgcggcgcctcgagcctccgggctacggcgactggcaagtccccgacccttacgggccaggtgggggcaacggcgccagcgcgggttatgggggctacagctcgcagaccttgccctcgcaggcgggggccacccccacccctcgcaccaaggccaagctcatccccaccggccgggatgtggggccggtgcctcctaagccagtcccgggcaagagcacccccaaactcaacggcagcggccccagctggtggccagagtgcacctgtaccaaccgggactggtatgagcaggtgaatggcagtgatggcatgttcaaatatgaggaaatcgtacttgagaggggcaactctggcctgggcttcagtatcgcaggtggcatcgacaatccccatgtccctgatgaccctggcatctttattaccaagattatccctggtggagcagctgccatggatgggaggctgggggtgaatgactgtgtgctgcgggtgaatgaggtggacgtgtcggaggtggtacacagccgggcggtggaggcgctgaaggaggcaggccctgtggtgcgattggtggtgcggaggcgacagcctccacccgagaccatcatggaggtcaacctgctcaaagggcccaaaggcctgggtttcagcattgctgggggtattggcaaccagcacatcccaggagacaacagcatctacatcaccaagatcattgaggggggtgctgctcagaaggatggacgcctacagattggggaccggctgctggcggtgaacaacaccaatctgcaggatgtgaggcacgaggaagctgtggcctcactgaagaacacatctgatatggtgtatttgaaggtggccaagccaggcagcctccacctcaacgacatgtacgctccccctgactacgccagcacttttactgccttggctgacaaccacataagccataattccagcctgggttatctcggggctgtggagagcaaggtcagctaccctgctcctcctcaggttccccccacccgctactctcctattcccaggcacatgctggctgaggaggacttcaccagagagcctcgcaagatcatcctgcacaaaggctccacaggcctgggcttcaacatcgtaggaggagaggatggagaaggcatttttgtctccttcatcctggcaggaggcccagctgacctgagtggggagctgcgcaggggagaccggatcttatcggtgaatggagtgaatctgaggaatgcaactcatgagcaggctgcagctgctctgaaacgggccggccagtcagtcaccattgtggcccagtacagacctgaagaatacagtcgctttgaatcgaagatacatgacttacgagaacaaatgatgaacagcagcatgagctctgggtctgggtccctccgaacaagtgaaaagaggtccttgtatgtcagggccctgtttgattatgatcggactcgggacagctgcctgccaagccaggggctcagcttctcttatggtgacattctgcatgtcattaatgcctctgatgatgagtggtggcaggcaaggctggtgaccccacacggagaaagtgagcagatcggtgtgatccccagtaagaagagggtggaaaagaaagaaagagctcgattgaaaactgtgaagttccatgccaggacggggatgattgagtctaacagggacttcccggggttaagtgacgattattatggagcaaagaacctgaaaggacaagaggatgctattttgtcatatgagccagtgacacggcaagaaattcactatgcaaggcctgtgatcatcctgggcccaatgaaggaccgagtcaatgatgacctgatctccgaatttccacataaatttggatcctgtgtgccacatactacccggcctcgacgtgataatgaggtggatggacaagactaccactttgtggtgtcccgagaacaaatggagaaagatattcaggacaacaagttcatcgaggcgggccaatttaatgataacctctatgggaccagcatccagtcagtgcgggcagttgcagagaggggcaagcactgcatcttagatgtttccggcaatgctatcaagagactgcagcaagcacaactttaccccattgccattttcatcaagcccaagtccattgaagcccttatggaaatgaaccgaaggcagacatatgaacaagcaaataagatctatgacaaagccatgaaactggagcaggaatttggagagtactttacagccattgtacagggtgactcactggaagagatttataacaaaatcaaacaaatcattgaggaccagtctgggcactacatttgggtcccatcccctgaaaaactctgaagaatcccctccaaccattctcttgtgaacagaagaaatcaagtccctcttccctcctccctcttcattcctgtccccatggggagaacaaatgctactgttcttgtccccttttttagatatgtcaaaaaaaattaagttttctagtcctgttctttttttttttttaagtttttgtttgtttcagtttattttttgggatgatgccatctcattcatcatgtgactgtgcccattcctgcatggacctttcccaagcgctagcacaggtgcaaaatccatcagagccattgttttcataaaaaccaagcagaagtgaagagaaaagaggaggactgatggaaagacagactctggacagctgcacggcttgtgaagtgagctaaatgcaccacatgatgagatgctcctgggcatttctccctatctgtactgctgtcttgcagctctgaacggtgcaacgtaatggcgacagaaagtatcttatttatatatagatatatatatgtaatttatataaaatatatagaaattattatatatatatattatacactctcatataatatatatatattcacacacatttgggttagaaaatctatggagacttcatcaatggtactatgttattagagaaatgctttaattttcatattccaatcagatggcatcttctatcccagctggttgggaagggattgaagatggtagcaagtgctgcactaagggcactcgcatttggtcattctcttgagagctaggaggggtcagcctgaggccggagaggaagggcttttgcctggggtgagagggtgagagacttgacctgaaagcagctgctgcccctgaggtgcagccagagtcctgtgtgcggacagagagaatggctaatgatgctccgcgtggaattgcctattgttttatgccacctgatgtgtctgcatgagaggtttcctttttgttcctttttaagctgctgttaaaccaaaaccatgttgtgctactgtgtcagccttttcattattgcaaattttacttttactatttaagtgaatgcatagaatccaatttgccaaggttctaaaggcttatgaggtcctgaaggagccaggccttgtgatggagtaggtgacacaggcctggttgtcctgtcagcagaagggaaagcaggggctgggctgagaggaggacacggagggctctgctgaggttccttcctgggttccaccaacagggacagggagtcacttgccttccagttctgtgctgggatggcgggacagcacttggcttgcttggccagctgcgtcatgagtttgatttggtttttttttttttgcagctgcttcatatgctctgctccagcccctccccaacagctggtagcttatggtttcttcaagaggaaagtagactttatgctgtacatttgagctgtagagctaagattcgcttactggtgagctgtgaaaccttgttgctttttcccagagtctgatggcagtgactgtgatcaagggaatcttcaccgccacaagtgcaggcagcaggtgtggttcaggtccccccccaccccactgtgctcctttgaagccaacgtgcctccctcgcctccatactggagggacgacgcaggggagaacagagaagtgcttggccctaggattgaggcacttgtttcctagcccgctgggttagggctggtgcaagcgaggcaatgttgaggatgctttaagcactaccagccgaatccgggaactctgttaacagttgtccaaccagcagaatgaggctaactgtataaagcatgggacccaggatgaggataaggaaaggacagcggctttccctgggcagtacaatggcttgaaggcaaaaagggataaagtgacagccgactgtgactctggtgaggaggggtgagcagggaggttgattctctgatgttaactaagtggcaaagtctcaaccgtgctcagccctccccctcccagggaagagaaacaaagattcaaagtaagcatgatactagtgggtttaccagtgtttcttccaaggagacatatattttttaataaacgatagttgcaatgaactgtggctcagagaccttcttaaagtagttgagaagggagggcgtgggcaaagcagtgggaagaacatcccaaacttttgggggccagagggctctctccttagtgatgatcagctagccgagctgggccgtcctggggatcggtacagctccctggggtggtgacaggccctttgtgaaagttgtgtgcttggtcttccaccccagccccagacactgcttcaaatagcaccaaccagatgggagtccacatctgtggtggcaaaatgctgacattttcccaagaggtacacaaggtgggagaggcctgctgtagcagaggtgtgtgttagagaaagcaggggcctgatttagtagcagagaactgggtgagaaaaatggccagagaaagtgacctgccagctaccagtgtttccgaaaatgagggtgggatgggcccatttgcagagcaggacagcagtcatccccatagccctctgaggaggggagggatgcttagagcaggcagttctggcagttctgacgtggcaggtgccattgcaacttgtgcggaggagtcttaggaagtgctgtcataattcataaggtcaagagcaacatctggatgaatgagccacctgaaatgtgtgtgggctgagccacaggaagggtgagtcctcttgcttgtggtgctttatggtgtgcaggttgcttgctttcccacattctctcatttgcttgaaggcagcctaacaaaagggagtccccaaagagctccatgagagcttaagaaaattcatctcctgaggacaaagagaacaaagatctgtcctgtggtcacactgttgaggctctgtcttcacagctgatgttctcctagtggaggtacagctgaagaacattcagccccagcacgagaagatacagagcaacttggaaaccccaaagggagacacacccttaacactgccgtgctgtgctgtgccgtgtcctgaaggaggagagagccctatctcctcctggttttgttgctgacattgcagctgatcatgccttgactccttcatctctaacagaggaagaactgtattatcaaaccttatggtctacccatgaataaataaaatatttgttcaagcac

SEQ ID NO: 8538 - DNA, 4529 bp, Homo sapiens
cccatcgcgcgcctcaggcgtctcctcctcctccctccttccccctcctctctcctcccctcctcccgcgcgccccgctttgtgtccgtggtctcccgcgcgggacggagggactggccggagctggcgctttctcagcactagatctggactccgacccggcgccagaatacagtcgctttgaatcgaagatacatgacttacgagaacaaatgatgaacagcagcatgagctctgggtctgggtccctccgaacaagtgaaaagaggtccttgtatgtcagggccctgtttgattatgatcggactcgggacagctgcctgccaagccaggggctcagcttctcttatggtgacattctgcatgtcattaatgcctctgatgatgagtggtggcaggcaaggctggtgaccccacacggagaaagtgagcagatcggtgtgatccccagtaagaagagggtggaaaagaaagaaagagctcgattgaaaactgtgaagttccatgccaggacggggatgattgagtctaacaggtcgatcaaaacgaaacgtaaaaagagtttccgcctctctcgaaagtttccattttacaagagcaaagaaaacatggcccaggagagcagcatacaggaacagggagtgacatccaacaccagtgacagcgaaagcagttccaaaggacaagaggatgctattttgtcatatgagccagtgacacggcaagaaattcactatgcaaggcctgtgatcatcctgggcccaatgaaggaccgagtcaatgatgacctgatctccgaatttccacataaatttggatcctgtgtgccacatactacccggcctcgacgtgataatgaggtggatggacaagactaccactttgtggtgtcccgagaacaaatggagaaagatattcaggacaacaagttcatcgaggcgggccaatttaatgataacctctatgggaccagcatccagtcagtgcgggcagttgcagagaggggcaagcactgcatcttagatgtttccggcaatgctatcaagagactgcagcaagcacaactttaccccattgccattttcatcaagcccaagtccattgaagcccttatggaaatgaaccgaaggcagacatatgaacaagcaaataagatctatgacaaagccatgaaactggagcaggaatttggagagtactttacagccattgtacagggtgactcactggaagagatttataacaaaatcaaacaaatcattgaggaccagtctgggcactacatttgggtcccatcccctgaaaaactctgaagaatcccctccaaccattctcttgtgaacagaagaaatcaagtccctcttccctcctccctcttcattcctgtccccatggggagaacaaatgctactgttcttgtccccttttttagatatgtcaaaaaaaattaagttttctagtcctgttctttttttttttttaagtttttgtttgtttcagtttattttttgggatgatgccatctcattcatcatgtgactgtgcccattcctgcatggacctttcccaagcgctagcacaggtgcaaaatccatcagagccattgttttcataaaaaccaagcagaagtgaagagaaaagaggaggactgatggaaagacagactctggacagctgcacggcttgtgaagtgagctaaatgcaccacatgatgagatgctcctgggcatttctccctatctgtactgctgtcttgcagctctgaacggtgcaacgtaatggcgacagaaagtatcttatttatatatagatatatatatgtaatttatataaaatatatagaaattattatatatatatattatacactctcatataatatatatatattcacacacatttgggttagaaaatctatggagacttcatcaatggtactatgttattagagaaatgctttaattttcatattccaatcagatggcatcttctatcccagctggttgggaagggattgaagatggtagcaagtgctgcactaagggcactcgcatttggtcattctcttgagagctaggaggggtcagcctgaggccggagaggaagggcttttgcctggggtgagagggtgagagacttgacctgaaagcagctgctgcccctgaggtgcagccagagtcctgtgtgcggacagagagaatggctaatgatgctccgcgtggaattgcctattgttttatgccacctgatgtgtctgcatgagaggtttcctttttgttcctttttaagctgctgttaaaccaaaaccatgttgtgctactgtgtcagccttttcattattgcaaattttacttttactatttaagtgaatgcatagaatccaatttgccaaggttctaaaggcttatgaggtcctgaaggagccaggccttgtgatggagtaggtgacacaggcctggttgtcctgtcagcagaagggaaagcaggggctgggctgagaggaggacacggagggctctgctgaggttccttcctgggttccaccaacagggacagggagtcacttgccttccagttctgtgctgggatggcgggacagcacttggcttgcttggccagctgcgtcatgagtttgatttggtttttttttttttgcagctgcttcatatgctctgctccagcccctccccaacagctggtagcttatggtttcttcaagaggaaagtagactttatgctgtacatttgagctgtagagctaagattcgcttactggtgagctgtgaaaccttgttgctttttcccagagtctgatggcagtgactgtgatcaagggaatcttcaccgccacaagtgcaggcagcaggtgtggttcaggtccccccccaccccactgtgctcctttgaagccaacgtgcctccctcgcctccatactggagggacgacgcaggggagaacagagaagtgcttggccctaggattgaggcacttgtttcctagcccgctgggttagggctggtgcaagcgaggcaatgttgaggatgctttaagcactaccagccgaatccgggaactctgttaacagttgtccaaccagcagaatgaggctaactgtataaagcatgggacccaggatgaggataaggaaaggacagcggctttccctgggcagtacaatggcttgaaggcaaaaagggataaagtgacagccgactgtgactctggtgaggaggggtgagcagggaggttgattctctgatgttaactaagtggcaaagtctcaaccgtgctcagccctccccctcccagggaagagaaacaaagattcaaagtaagcatgatactagtgggtttaccagtgtttcttccaaggagacatatattttttaataaacgatagttgcaatgaactgtggctcagagaccttcttaaagtagttgagaagggagggcgtgggcaaagcagtgggaagaacatcccaaacttttgggggccagagggctctctccttagtgatgatcagctagccgagctgggccgtcctggggatcggtacagctccctggggtggtgacaggccctttgtgaaagttgtgtgcttggtcttccaccccagccccagacactgcttcaaatagcaccaaccagatgggagtccacatctgtggtggcaaaatgctgacattttcccaagaggtacacaaggtgggagaggcctgctgtagcagaggtgtgtgttagagaaagcaggggcctgatttagtagcagagaactgggtgagaaaaatggccagagaaagtgacctgccagctaccagtgtttccgaaaatgagggtgggatgggcccatttgcagagcaggacagcagtcatccccatagccctctgaggaggggagggatgcttagagcaggcagttctggcagttctgacgtggcaggtgccattgcaacttgtgcggaggagtcttaggaagtgctgtcataattcataaggtcaagagcaacatctggatgaatgagccacctgaaatgtgtgtgggctgagccacaggaagggtgagtcctcttgcttgtggtgctttatggtgtgcaggttgcttgctttcccacattctctcatttgcttgaaggcagcctaacaaaagggagtccccaaagagctccatgagagcttaagaaaattcatctcctgaggacaaagagaacaaagatctgtcctgtggtcacactgttgaggctctgtcttcacagctgatgttctcctagtggaggtacagctgaagaacattcagccccagcacgagaagatacagagcaacttggaaaccccaaagggagacacacccttaacactgccgtgctgtgctgtgccgtgtcctgaaggaggagagagccctatctcctcctggttttgttgctgacattgcagctgatcatgccttgactccttcatctctaacagaggaagaactgtattatcaaaccttatggtctacccatgaataaataaaatatttgttcaagc

SEQ ID NO: 8539 - DNA, 4323 bp, Homo sapiens
agaccttccgcccccgagcctcagcagctgccgccccaagctcgcggccatccgagccgcctgcatctccgaatctctccgggcgccgctggctcgagctctgacccagctctggcgtcctgcacgcccacgtcctggcgcccctaaccctgactcatcgtccacagtgcaccgggcggcggacggttgcgggccccggggcatgctgggagctgtagttccctggagcccggccctgcgttccgctgacttagagggatctccaagcgtccctcgtctcccccaaactccttaatcccgcccgtccgacctagagtctagtcctccgacggggtgatgggataggatgggacagaagaggaaggggcttaagtcactgcagccagagggatggaggtggactgaagggagggcttctccggtggggttagaagggaaaagtagggaaagagaagtgtaaggtagatggcagaggcagagacatggaaagacagactctagggttcctgatgaaatctatctcggccaacacaaaagggagggtacagtggtggggggcacccaagctagggtgtgagtaccctaagtgtattcttctgagatgtaggccattcactaactcttggaacagctacagtttcacagtaggaagacccccccagattcactgcccctcccttagtaaagcctctgagaccttcctgaacattcccttctgtctttgccctctgttccttccagagaccatgtgcccaggcagatggattcctcccgggcctgagaggaactgcaggaattctcctgcctcttacccgtaaaaccccaacttctctagccctagggcaggaagtcccaaacaatttctacccctttttctgcaattctcattggggtgagaggaggcccaggaggagagagagctgggctcagcttctttttgagctgctggagccctctgtgaggaggccctctttgctggcttctcaggagagcgtggctaggttctgcctgcctatgggaagagggggccagggtgtgtggagcaagatggtggcggtgctggtgccttgggacctgggggaatgggacagctggtcggctcagagacggcctactttactcacagctggaatttagtggggagaagcagctcaactccaatcctggaggattagggagattaaagtgagagaagagagagatgtcccagagaccaagagctcccaggtcagccctctggctcctggcacccccactgctgcggtgggcacccccactcctcacagtgctgcatagcgacctcttccaggccttgctggacatcctggactattatgaggcttccctctcagagagtcagaaataccgctaccaagatgaagacacgccccctctggagcacagcccggcccacctccccaaccaggccaattctcccccagtgattgtcaacacagataccctagaagccccaggatatgagttgcaggtgaacgggaccgagggggagatggaatacgaggaaatcacattggaaaggggtaactcaggtctgggcttcagcatcgcaggtggcactgacaacccacacatcggtgacgacccatccattttcatcaccaagatcattcctggtggggctgcggcccaggatggccgcctcagggtcaacgacagcatcctgtttgtaaatgaagtggacgtgcgcgaggtgacccactcagcggcggtggaagccctcaaagaggcaggctccatcgttcgcctctatgtcatgcgccggaagcccccggctgagaaggtcatggagatcaagctcatcaaggggcctaaaggtcttggcttcagcatcgcagggggcgtagggaaccagcacatcccaggagataatagcatctatgtaacaaagatcatcgaagggggtgctgcccacaaggatgggaggttgcagattggagacaagatcctggcggtcaacagtgtggggctagaggacgtcatgcatgaagatgctgtggcagccctgaagaacacgtatgatgttgtctacctaaaggtggccaagcccagcaatgcctacctgagtgacagctatgctcccccagacatcacaacctcttattcccagcacctggacaatgagatcagtcacagcagctacctgggcaccgactaccccacagccatgacccccacttcccctcggcgctactctccagtggccaaggacctgctcggggaggaagacattccccgagaaccgaggcgaattgtgatccaccggggctccacgggcctgggcttcaacatcgtgggtggcgaggacggtgaaggcatcttcatctcctttatcctggccgggggccctgcagacctcagtggggagctgcggaagggggaccagatcctgtcggtcaacggtgtggacctccgaaatgccagccatgagcaggctgccattgccctgaagaatgcgggtcagacggtcacgatcatcgctcagtataaaccagaagagtacagccgattcgaggccaagatccacgaccttcgggaacagctcatgaacagcagcctgggctcagggactgcgtccctgcggagcaaccccaaaaggggtttctacatcagggccctgtttgattacgacaagaccaaggactgcggcttcctgagccaggccctgagcttccgctttggggatgtgctgcatgtcatcgatgctagtgatgaggagtggtggcaggcacggcgggtccactctgacagtgagaccgacgacattgggttcatccccagcaaacggcgggttgagcgacgagagtggtcaaggttaaaggccaaggactggggctccagctctggatcgcagggtcgagaagactcggttctgagctacgagacagtgacgcagatggaagtgcactatgctcgccccatcatcatccttgggcccaccaaggaccgcgccaacgatgatcttctctccgagttccccgacaagtttggatcctgtgttccccatacgacacggcccaagcgggagtatgagatagatggccgggattaccactttgtgtcgtcccgggagaaaatggagaaggacattcaggcgcacaagttcattgaggccggccagtacaacagccacctctatgggaccagcgtccagtccgtgcgagaggtggcagagcaggggaagcactgcatcctcgatgtctcggccaatgccgtgcggcggctgcaggcggcccacctgcaccccatcgccatcttcatccgcccccgctccctggagaatgtgctagagattaacaagcggatcacagaggagcaagcccgcaaagccttcgacagagccaccaagctggagcaggagttcacagagtgcttctcagccatcgtggagggtgacagctttgaggagatctaccacaaggtgaagcgtgtcatcgaggacctctcaggcccctacatctgggttccagcccgagagagactctgattcctgccctggcttggcctggactcgccctgcctccatcacctgggcccttggtctggactgaattgcccaagcccttggctccccccggcctccctcccaccccttcttatttatttcctttctaactggatccagcctgttggaggggggacactcctctgcatgtatccccgcaccccagaactgggctcctgaacgccaggaacctggggtctgggggggagctgggctccttgttccgagcccttgctccttaggatccccgcccccacctgcccccaatgcacacacagacccaccgggggccacctgccctcccccatcctctcccacacacattccagaagtcagggccccctcgaggagcacccgctgcagggatgcagggccacaggcctccgctctctcctaaggcagggtctggggtcacccctgccctcatcgtaattccccatgttccttgatttctcatttattttttccactttttttcttctcaaaggtggttttttggggggagaagcaggggactccgcagcgggcccctgccttccacatgcccccaccatttttctttgccggtttgcatgagtggaaggtctaaatgtggcttttttttttttttttcctgggaatttttttggggaaaagggagggatgggtctagggagtgggaaatgcgggagggagggtggggggcaggggtcgggggtcgggtgtccgggagccagggaagactggaaatgctgccgccttctgcaatttatttatttttttcttttgagagagtgaaaggaagagacagatacttgaaa

SEQ ID NO: 8540 - DNA, 3184 bp, Homo sapiens
gcccccttcccctccctcccacgctcccctccccttcccttctccaaccccctccttcccctctcacccctccccccatcctggccccccctgcaaaagtggggtgcggaggggggaggggtgagaacccacggaggggaggaacgaaactccgatgaagtcagagccccttacccgccgccgcggccaggccccccaacatggactgtctctgtatagtgacaaccaagaaataccgctaccaagatgaagacacgccccctctggagcacagcccggcccacctccccaaccaggccaattctcccccagtgattgtcaacacagataccctagaagccccaggatatgtgaacgggaccgagggggagatggaatacgaggaaatcacattggaaaggggtaactcaggtctgggcttcagcatcgcaggtggcactgacaacccacacatcggtgacgacccatccattttcatcaccaagatcattcctggtggggctgcggcccaggatggccgcctcagggtcaacgacagcatcctgtttgtaaatgaagtggacgtgcgcgaggtgacccactcagcggcggtggaagccctcaaagaggcaggctccatcgttcgcctctatgtcatgcgccggaagcccccggctgagaaggtcatggagatcaagctcatcaaggggcctaaaggtcttggcttcagcatcgcagggggcgtagggaaccagcacatcccaggagataatagcatctatgtaacaaagatcatcgaagggggtgctgcccacaaggatgggaggttgcagattggagacaagatcctggcggtcaacagtgtggggctagaggacgtcatgcatgaagatgctgtggcagccctgaagaacacgtatgatgttgtctacctaaaggtggccaagcccagcaatgcctacctgagtgacagctatgctcccccagacatcacaacctcttattcccagcacctggacaatgagatcagtcacagcagctacctgggcaccgactaccccacagccatgacccccacttcccctcggcgctactctccagtggccaaggacctgctcggggaggaagacattccccgagaaccgaggcgaattgtgatccaccggggctccacgggcctgggcttcaacatcgtgggtggcgaggacggtgaaggcatcttcatctcctttatcctggccgggggccctgcagacctcagtggggagctgcggaagggggaccagatcctgtcggtcaacggtgtggacctccgaaatgccagccatgagcaggctgccattgccctgaagaatgcgggtcagacggtcacgatcatcgctcagtataaaccagaagagtacagccgattcgaggccaagatccacgaccttcgggaacagctcatgaacagcagcctgggctcagggactgcgtccctgcggagcaaccccaaaaggggtttctacatcagggccctgtttgattacgacaagaccaaggactgcggcttcctgagccaggccctgagcttccgctttggggatgtgctgcatgtcatcgatgctagtgatgaggagtggtggcaggcacggcgggtccactctgacagtgagaccgacgacattgggttcatccccagcaaacggcgggttgagcgacgagagtggtcaaggttaaaggccaaggactggggctccagctctggatcgcagggtcgagaagactcggttctgagctacgagacagtgacgcagatggaagtgcactatgctcgccccatcatcatccttgggcccaccaaggaccgcgccaacgatgatcttctctccgagttccccgacaagtttggatcctgtgttccccatacgacacggcccaagcgggagtatgagatagatggccgggattaccactttgtgtcgtcccgggagaaaatggagaaggacattcaggcgcacaagttcattgaggccggccagtacaacagccacctctatgggaccagcgtccagtccgtgcgagaggtggcagagcaggggaagcactgcatcctcgatgtctcggccaatgccgtgcggcggctgcaggcggcccacctgcaccccatcgccatcttcatccgcccccgctccctggagaatgtgctagagattaacaagcggatcacagaggagcaagcccgcaaagccttcgacagagccaccaagctggagcaggagttcacagagtgcttctcagccatcgtggagggtgacagctttgaggagatctaccacaaggtgaagcgtgtcatcgaggacctctcaggcccctacatctgggttccagcccgagagagactctgattcctgccctggcttggcctggactcgccctgcctccatcacctgggcccttggtctggactgaattgcccaagcccttggctccccccggcctccctcccaccccttcttatttatttcctttctaactggatccagcctgttggaggggggacactcctctgcatgtatccccgcaccccagaactgggctcctgaacgccaggaacctggggtctgggggggagctgggctccttgttccgagcccttgctccttaggatccccgcccccacctgcccccaatgcacacacagacccaccgggggccacctgccctcccccatcctctcccacacacattccagaagtcagggccccctcgaggagcacccgctgcagggatgcagggccacaggcctccgctctctcctaaggcagggtctggggtcacccctgccctcatcgtaattccccatgttccttgatttctcatttattttttccactttttttcttctcaaaggtggttttttggggggagaagcaggggactccgcagcgggcccctgccttccacatgcccccaccatttttctttgccggtttgcatgagtggaaggtctaaatgtggcttttttttttttttttcctgggaatttttttggggaaaagggagggatgggtctagggagtgggaaatgcgggagggagggtggggggcaggggtcgggggtcgggtgtccgggagccagggaagactggaaatgctgccgccttctgcaatttatttatttttttcttttgagagagtgaaaggaagagacagatacttgaaa

SEQ ID NO: 8541 - DNA, 2712 bp, Homo sapiens
aggttattcaggatgcgctgcgcccacaaacctcttcagcccggcctcctctcggcctggctaacgtggggcggggcccagggcaggagaggcggggctagcggatcccttctgcgctcaggagtttggtcggccccaggccacgccccacccccctgttgtcctgacgacagggcctcctggaggccaattctcccccagtgattgtcaacacagataccctagaagccccaggatatgagttgcaggtgaacgggaccgagggggagatggaatacgaggaaatcacattggaaaggggtaactcaggtctgggcttcagcatcgcaggtggcactgacaacccacacatcggtgacgacccatccattttcatcaccaagatcattcctggtggggctgcggcccaggatggccgcctcagggtcaacgacagcatcctgtttgtaaatgaagtggacgtgcgcgaggtgacccactcagcggcggtggaagccctcaaagaggcaggctccatcgttcgcctctatgtcatgcgccggaagcccccggctgagaaggtcatggagatcaagctcatcaaggggcctaaaggtcttggcttcagcatcgcagggggcgtagggaaccagcacatcccaggagataatagcatctatgtaacaaagatcatcgaagggggtgctgcccacaaggatgggaggttgcagattggagacaagatcctggcggtcaacagtgtggggctagaggacgtcatgcatgaagatgctgtggcagccctgaagaacacgtatgatgttgtctacctaaaggtggccaagcccagcaatgcctacctgagtgacagctatgctcccccagacatcacaacctcttattcccagcacctggacaatgagatcagtcacagcagctacctgggcaccgactaccccacagccatgacccccacttcccctcggcgctactctccagtggccaaggacctgctcggggaggaagacattccccgagaaccgaggcgaattgtgatccaccggggctccacgggcctgggcttcaacatcgtgggtggcgaggacggtgaaggcatcttcatctcctttatcctggccgggggccctgcagacctcagtggggagctgcggaagggggaccagatcctgtcggtcaacggtgtggacctccgaaatgccagccatgagcaggctgccattgccctgaagaatgcgggtcagacggtcacgatcatcgctcagtataaaccagaagagtacagccgattcgaggccaagatccacgaccttcgggaacagctcatgaacagcagcctgggctcagggactgcgtccctgcggagcaaccccaaaaggggtttctacatcagggccctgtttgattacgacaagaccaaggactgcggcttcctgagccaggccctgagcttccgctttggggatgtgctgcatgtcatcgatgctagtgatgaggagtggtggcaggcacggcgggtccactctgacagtgagaccgacgacattgggttcatccccagcaaacggcgggttgagcgacgagagtggtcaaggttaaaggccaaggactggggctccagctctggatcgcagggtcgagaagactcggttctgagctacgagacagtgacgcagatggaagtgcactatgctcgccccatcatcatccttgggcccaccaaggaccgcgccaacgatgatcttctctccgagttccccgacaagtttggatcctgtgttccccatacgacacggcccaagcgggagtatgagatagatggccgggattaccactttgtgtcgtcccgggagaaaatggagaaggacattcaggcgcacaagttcattgaggccggccagtacaacagccacctctatgggaccagcgtccagtccgtgcgagaggtggcagagcaggggaagcactgcatcctcgatgtctcggccaatgccgtgcggcggctgcaggcggcccacctgcaccccatcgccatcttcatccgcccccgctccctggagaatgtgctagagattaacaagcggatcacagaggagcaagcccgcaaagccttcgacagagccaccaagctggagcaggagttcacagagtgcttctcagccatcgtggagggtgacagctttgaggagatctaccacaaggtgaagcgtgtcatcgaggacctctcaggcccctacatctgggttccagcccgagagagactctgattcctgccctggcttggcctggactcgccctgcctccatcacctgggcccttggtctggactgaattgcccaagcccttggctccccccggcctccctcccaccccttcttatttatttcctttctaactggatccagcctgttggaggggggacactcctctgcatgtatccccgcaccccagaactgggctcctgaacgccaggaacctggggtctgggggggagctgggctccttgttccgagcccttgctccttaggatccccgcccccacctgcccccaatgcacacacagacccaccgggggccacctgccctcccccatcctctcccacacacattccagaagtcagggccccctcgaggagcacccgctgcagggatgcagggccacaggcctccgctctctcctaaggcagggtctggggtcacccctgccctcatcgt

SEQ ID NO: 8542 - DNA, 3185 bp, Homo sapiens
cccctccctcccacgctcccctccccttcccttctccaaccccctccttcccctctcacccctccccccatcctggccccccctgcaaaagtggggtgcggaggggggaggggtgagaacccacggaggggaggaacgaaactccgatgaagtcagagccccttacccgccgccgcggccaggccccccaacatggactgtctctgtatagtgacaaccaagaaataccgctaccaagatgaagacacgccccctctggagcacagcccggcccacctccccaaccaggccaattctcccccagtgattgtcaacacagataccctagaagccccaggatatgtgttgcaggtgaacgggaccgagggggagatggaatacgaggaaatcacattggaaaggggtaactcaggtctgggcttcagcatcgcaggtggcactgacaacccacacatcggtgacgacccatccattttcatcaccaagatcattcctggtggggctgcggcccaggatggccgcctcagggtcaacgacagcatcctgtttgtaaatgaagtggacgtgcgcgaggtgacccactcagcggcggtggaagccctcaaagaggcaggctccatcgttcgcctctatgtcatgcgccggaagcccccggctgagaaggtcatggagatcaagctcatcaaggggcctaaaggtcttggcttcagcatcgcagggggcgtagggaaccagcacatcccaggagataatagcatctatgtaacaaagatcatcgaagggggtgctgcccacaaggatgggaggttgcagattggagacaagatcctggcggtcaacagtgtggggctagaggacgtcatgcatgaagatgctgtggcagccctgaagaacacgtatgatgttgtctacctaaaggtggccaagcccagcaatgcctacctgagtgacagctatgctcccccagacatcacaacctcttattcccagcacctggacaatgagatcagtcacagcagctacctgggcaccgactaccccacagccatgacccccacttcccctcggcgctactctccagtggccaaggacctgctcggggaggaagacattccccgagaaccgaggcgaattgtgatccaccggggctccacgggcctgggcttcaacatcgtgggtggcgaggacggtgaaggcatcttcatctcctttatcctggccgggggccctgcagacctcagtggggagctgcggaagggggaccagatcctgtcggtcaacggtgtggacctccgaaatgccagccatgagcaggctgccattgccctgaagaatgcgggtcagacggtcacgatcatcgctcagtataaaccagaagagtacagccgattcgaggccaagatccacgaccttcgggaacagctcatgaacagcagcctgggctcagggactgcgtccctgcggagcaaccccaaaaggggtttctacatcagggccctgtttgattacgacaagaccaaggactgcggcttcctgagccaggccctgagcttccgctttggggatgtgctgcatgtcatcgatgctagtgatgaggagtggtggcaggcacggcgggtccactctgacagtgagaccgacgacattgggttcatccccagcaaacggcgggttgagcgacgagagtggtcaaggttaaaggccaaggactggggctccagctctggatcgcagggtcgagaagactcggttctgagctacgagacagtgacgcagatggaagtgcactatgctcgccccatcatcatccttgggcccaccaaggaccgcgccaacgatgatcttctctccgagttccccgacaagtttggatcctgtgttccccatacgacacggcccaagcgggagtatgagatagatggccgggattaccactttgtgtcgtcccgggagaaaatggagaaggacattcaggcgcacaagttcattgaggccggccagtacaacagccacctctatgggaccagcgtccagtccgtgcgagaggtggcagagcaggggaagcactgcatcctcgatgtctcggccaatgccgtgcggcggctgcaggcggcccacctgcaccccatcgccatcttcatccgcccccgctccctggagaatgtgctagagattaacaagcggatcacagaggagcaagcccgcaaagccttcgacagagccaccaagctggagcaggagttcacagagtgcttctcagccatcgtggagggtgacagctttgaggagatctaccacaaggtgaagcgtgtcatcgaggacctctcaggcccctacatctgggttccagcccgagagagactctgattcctgccctggcttggcctggactcgccctgcctccatcacctgggcccttggtctggactgaattgcccaagcccttggctccccccggcctccctcccaccccttcttatttatttcctttctaactggatccagcctgttggaggggggacactcctctgcatgtatccccgcaccccagaactgggctcctgaacgccaggaacctggggtctgggggggagctgggctccttgttccgagcccttgctccttaggatccccgcccccacctgcccccaatgcacacacagacccaccgggggccacctgccctcccccatcctctcccacacacattccagaagtcagggccccctcgaggagcacccgctgcagggatgcagggccacaggcctccgctctctcctaaggcagggtctggggtcacccctgccctcatcgtaattccccatgttccttgatttctcatttattttttccactttttttcttctcaaaggtggttttttggggggagaagcaggggactccgcagcgggcccctgccttccacatgcccccaccatttttctttgccggtttgcatgagtggaaggtctaaatgtggcttttttttttttttttcctgggaatttttttggggaaaagggagggatgggtctagggagtgggaaatgcgggagggagggtggggggcaggggtcgggggtcgggtgtccgggagccagggaagactggaaatgctgccgccttctgcaatttatttatttttttcttttgagagagtgaaaggaagagacagatacttgaaa

SEQ ID NO: 8543 - DNA, 3975 bp, Homo sapiens
gggacagaagaggaaggggcttaagtcactgcagccagagggatggaggtggactgaagggagggcttctccggtggggttagaagggaaaagtagggaaagagaagtgtaaggtagatggcagaggcagagacatggaaagacagactctagggttcctgatgaaatctatctcggccaacacaaaagggagggtacagtggtggggggcacccaagctagggtgtgagtaccctaagtgtattcttctgagatgtaggccattcactaactcttggaacagctacagtttcacagtaggaagacccccccagattcactgcccctcccttagtaaagcctctgagaccttcctgaacattcccttctgtctttgccctctgttccttccagagaccatgtgcccaggcagatggattcctcccgggcctgagaggaactgcaggaattctcctgcctcttacccgtaaaaccccaacttctctagccctagggcaggaagtcccaaacaatttctacccctttttctgcaattctcattggggtgagaggaggcccaggaggagagagagctgggctcagcttctttttgagctgctggagccctctgtgaggaggccctctttgctggcttctcaggagagcgtggctaggttctgcctgcctatgggaagagggggccagggtgtgtggagcaagatggtggcggtgctggtgccttgggacctgggggaatgggacagctggtcggctcagagacggcctactttactcacagctggaatttagtggggagaagcagctcaactccaatcctggaggattagggagattaaagtgagagaagagagagatgtcccagagaccaagagctcccaggtcagccctctggctcctggcacccccactgctgcggtgggcacccccactcctcacagtgctgcatagcgacctcttccaggccttgctggacatcctggactattatgaggcttccctctcagagagtcagaaataccgctaccaagatgaagacacgccccctctggagcacagcccggcccacctccccaaccaggccaattctcccccagtgattgtcaacacagataccctagaagccccaggatatgtgttgcaggtgaacgggaccgagggggagatggaatacgaggaaatcacattggaaaggggtaactcaggtctgggcttcagcatcgcaggtggcactgacaacccacacatcggtgacgacccatccattttcatcaccaagatcattcctggtggggctgcggcccaggatggccgcctcagggtcaacgacagcatcctgtttgtaaatgaagtggacgtgcgcgaggtgacccactcagcggcggtggaagccctcaaagaggcaggctccatcgttcgcctctatgtcatgcgccggaagcccccggctgagaaggtcatggagatcaagctcatcaaggggcctaaaggtcttggcttcagcatcgcagggggcgtagggaaccagcacatcccaggagataatagcatctatgtaacaaagatcatcgaagggggtgctgcccacaaggatgggaggttgcagattggagacaagatcctggcggtcaacagtgtggggctagaggacgtcatgcatgaagatgctgtggcagccctgaagaacacgtatgatgttgtctacctaaaggtggccaagcccagcaatgcctacctgagtgacagctatgctcccccagacatcacaacctcttattcccagcacctggacaatgagatcagtcacagcagctacctgggcaccgactaccccacagccatgacccccacttcccctcggcgctactctccagtggccaaggacctgctcggggaggaagacattccccgagaaccgaggcgaattgtgatccaccggggctccacgggcctgggcttcaacatcgtgggtggcgaggacggtgaaggcatcttcatctcctttatcctggccgggggccctgcagacctcagtggggagctgcggaagggggaccagatcctgtcggtcaacggtgtggacctccgaaatgccagccatgagcaggctgccattgccctgaagaatgcgggtcagacggtcacgatcatcgctcagtataaaccagaagagtacagccgattcgaggccaagatccacgaccttcgggaacagctcatgaacagcagcctgggctcagggactgcgtccctgcggagcaaccccaaaaggggtttctacatcagggccctgtttgattacgacaagaccaaggactgcggcttcctgagccaggccctgagcttccgctttggggatgtgctgcatgtcatcgatgctagtgatgaggagtggtggcaggcacggcgggtccactctgacagtgagaccgacgacattgggttcatccccagcaaacggcgggttgagcgacgagagtggtcaaggttaaaggccaaggactggggctccagctctggatcgcagggtcgagaagactcggttctgagctacgagacagtgacgcagatggaagtgcactatgctcgccccatcatcatccttgggcccaccaaggaccgcgccaacgatgatcttctctccgagttccccgacaagtttggatcctgtgttccccatacgacacggcccaagcgggagtatgagatagatggccgggattaccactttgtgtcgtcccgggagaaaatggagaaggacattcaggcgcacaagttcattgaggccggccagtacaacagccacctctatgggaccagcgtccagtccgtgcgagaggtggcagagcaggggaagcactgcatcctcgatgtctcggccaatgccgtgcggcggctgcaggcggcccacctgcaccccatcgccatcttcatccgcccccgctccctggagaatgtgctagagattaacaagcggatcacagaggagcaagcccgcaaagccttcgacagagccaccaagctggagcaggagttcacagagtgcttctcagccatcgtggagggtgacagctttgaggagatctaccacaaggtgaagcgtgtcatcgaggacctctcaggcccctacatctgggttccagcccgagagagactctgattcctgccctggcttggcctggactcgccctgcctccatcacctgggcccttggtctggactgaattgcccaagcccttggctccccccggcctccctcccaccccttcttatttatttcctttctaactggatccagcctgttggaggggggacactcctctgcatgtatccccgcaccccagaactgggctcctgaacgccaggaacctggggtctgggggggagctgggctccttgttccgagcccttgctccttaggatccccgcccccacctgcccccaatgcacacacagacccaccgggggccacctgccctcccccatcctctcccacacacattccagaagtcagggccccctcgaggagcacccgctgcagggatgcagggccacaggcctccgctctctcctaaggcagggtctggggtcacccctgccctcatcgtaattccccatgttccttgatttctcatttattttttccactttttttcttctcaaaggtggttttttggggggagaagcaggggactccgcagcgggcccctgccttccacatgcccccaccatttttctttgccggtttgcatgagtggaaggtctaaatgtggcttttttttttttttttcctgggaatttttttggggaaaagggagggatgggtctagggagtgggaaatgcgggagggagggtggggggcaggggtcgggggtcgggtgtccgggagccagggaagactggaaatgctgccgccttctgcaatttatttatttttttcttttgagagagtgaaaggaagagacagatacttgaaa

SEQ ID NO: 8544 - DNA, 3103 bp, Homo sapiens
agagtctagtcctccgacggggtgatgggataggatgggacagaagaggaaggggcttaagtcactgcagccagagggatggaggtggactgaagggagggcttctccggtggggttagaagggaaaagtagggaaagagaagtgtaaggtagatggcagaggcagagacatggaaagacagactctagggttcctgatgaaatctatctcggccaacacaaaagggagggtacagtggtggggggcacccaagctagggtgtgagtaccctaagtgtattcttctgagatgtaggccattcactaactcttggaacagctacagtttcacagtaggaagacccccccagattcactgcccctcccttagtaaagcctctgagaccttcctgaacattcccttctgtctttgccctctgttccttccagagaccatgtgcccaggcagatggattcctcccgggcctgagaggaactgcaggaattctcctgcctcttacccgtaaaaccccaacttctctagccctagggcaggaagtcccaaacaatttctacccctttttctgcaattctcattggggtgagaggaggcccaggaggagagagagctgggctcagcttctttttgagctgctggagccctctgtgaggaggccctctttgctggcttctcaggagagcgtggctaggttctgcctgcctatgggaagagggggccagggtgtgtggagcaagatggtggcggtgctggtgccttgggacctgggggaatgggacagctggtcggctcagagacggcctactttactcacagctggaatttagtggggagaagcagctcaactccaatcctggaggattagggagattaaagtgagagaagagagagatgtcccagagaccaagagctcccaggtcagccctctggctcctggcacccccactgctgcggtgggcacccccactcctcacagtgctgcatagcgacctcttccaggccttgctggacatcctggactattatgaggcttccctctcagagagtcagaaataccgctaccaagatgaagacacgccccctctggagcacagcccggcccacctccccaaccaggccaattctcccccagtgattgtcaacacagataccctagaagccccaggatatgagttgcaggtgaacgggaccgagggggagatggaatacgaggaaatcacattggaaaggggtaactcaggtctgggcttcagcatcgcaggtggcactgacaacccacacatcggtgacgacccatccattttcatcaccaagatcattcctggtggggctgcggcccaggatggccgcctcagggtcaacgacagcatcctgtttgtaaatgaagtggacgtgcgcgaggtgacccactcagcggcggtggaagccctcaaagaggcaggctccatcgttcgcctctatgtcatgcgccggaagcccccggctgagaaggtcatggagatcaagctcatcaaggggcctaaaggtcttggcttcagcatcgcagggggcgtagggaaccagcacatcccaggagataatagcatctatgtaacaaagatcatcgaagggggtgctgcccacaaggatgggaggttgcagattggagacaagatcctggcggtcaacagtgtggggctagaggacgtcatgcatgaagatgctgtggcagccctgaagaacacgtatgatgttgtctacctaaaggtggccaagcccagcaatgcctacctgagtgacagctatgctcccccagacatcacaacctcttattcccagcacctggacaatgagatcagtcacagcagctacctgggcaccgactaccccacagccatgacccccacttcccctcggcgctactctccagtggccaaggacctgctcggggaggaagacattccccgagaaccgaggcgaattgtgatccaccggggctccacgggcctgggcttcaacatcgtgggtggcgaggacggtgaaggcatcttcatctcctttatcctggccgggggccctgcagacctcagtggggagctgcggaagggggaccagatcctgtcggtcaacggtgtggacctccgaaatgccagccatgagcaggctgccattgccctgaagaatgcgggtcagacggtcacgatcatcgctcagtataaaccagaagagtacagccgattcgaggccaagatccacgaccttcgggaacagctcatgaacagcagcctgggctcagggactgcgtccctgcggagcaaccccaaaaggggtttctacatcagggccctgtttgattacgacaagaccaaggactgcggcttcctgagccaggccctgagcttccgctttggggatgtgctgcatgtcatcgatgctagtgatgaggagtggtggcaggcacggcgggtccactctgacagtgagaccgacgacattgggttcatccccagcaaacggcgggttgagcgacgagagtggtcaaggttaaaggccaaggactggggctccagctctggatcgcagggtcgagaagactcggttctgagctacgagacagtgacgcagatggaagtgcactatgctcgccccatcatcatccttgggcccaccaaggaccgcgccaacgatgatcttctctccgagttccccgacaagtttggatcctgtgttccccatacgacacggcccaagcgggagtatgagatagatggccgggattaccactttgtgtcgtcccgggagaaaatggagaaggacattcaggcgcacaagttcattgaggccggccagtacaacagccacctctatgggaccagcgtccagtccgtgcgagaggtggcagagcagagagattaacaagcggatcacagaggagcaagcccgcaaagccttcgacagagccaccaagctggagcaggagttcacagagtgcttctcagccatcgtggagggtgacagctttgaggagatctaccacaaggtgaagcgtgtcatcgaggacctctcaggcccctacatctgggttccagcccgagagagactctgattcctgccctggcttggcct

SEQ ID NO: 8545 - DNA, 6487 bp, Homo sapiens
cggcgccctagggctgctgccgaggtgctcgcctgcccgcccgccggcctcggggggcccgggaggcgtccggcggggcggggcggcgcggcccgccaccatggagccccagcgccgggagctgctcgcccagtgtcagcagagcctggcccaggccatgacggaggtggaagccgtgctcgggctgctcgaggccgcgggagcgctcagtcccggcgagcggcggcagctggacgaggaggcgggaggcgccaaggcggagctgctgctcaagctgctcttggccaaggagcgggaccacttccaggacctgcgggcggcgctggagaagacgcagcctcacctgctgcccattctctacctgaacggcgtcgtcgggccgccgcagcccgccgaaggcgcgggttctacctacagcgtcctgtccaccatgccctcagactcagaaagcagcagctccctcagcagtgtgggcactaccgggaaggcgccgtccccaccacccctcctcactgaccagcaagtgaatgagaaggtggagaacctctccattcagctgcggctgatgacccgggagagaaacgagctccgcaagcgcctggcctttgctacgcatggcacggcctttgacaagaggccctaccacaggctgaatcctgactatgagaggctgaagatccagtgcgtgcgagccatgtcggacctgcagagcctgcagaaccagcacaccaacgccttgaagaggtgtgaggaggtggccaaggagactgacttctaccacacactccacagccggctcctgagtgaccagactcggctgaaggatgacgtggacatgctgaggcgggagaatgggcagctgctgcgggagcgaaacctgctgcagcagtcatgggaggacatgaagcggctccacgaggaggaccagaaggagatcggtgacctccgtgcccagcagcagcaggtgttgaagcacaacgggtcatccgagattctcaacaaactgtatgacacggccatggacaagttggaggtggtcaagaaggactatgacgcccttcggaagaggtacagtgagaaagtcgccatccacaatgcagacctgagccgcctggagcagctgggggaggagaaccagcggttgctgaagcagacagagatgctgacccagcagagggacacggccatccagctgcagcaccagtgcgccctctccctgaggaggtttgaggcgatccaccatgagctgaacaaggccacggcgcagaacaaggacctgcagtgggagatggagctgctgcagtcagagctgaccgagctgagaaccacgcaggtgaagacagcaaaggagtcggagaaatacagggaggagcgggacgctgtgtacagcgagtacaagctcatcatgagtgagcgtgaccaggtcatctctgagctggacaagctgcagaccgaagtggagctggccgagtccaagctcaagagcagcacatctgagaagaaggcggccaatgaggagatggaggcgctgcggcagatcaaagacacggtgacaatggatgctgggagagccaacaaggaggttgaaatccttcgaaagcagtgcaaggctctgtgccaggagctgaaggaagccctccaggaggcggatgtggccaagtgccggcgggactgggccttccaggagcgagacaagattgtagcagagcgtgacagcatccggacactgtgtgacaacctgaggcgggagcgggaccgtgcggtgagcgagctggctgaggccctgcgcagcctggatgacacccgcaagcagaagaatgatgtcagccgcgagctgaaggagctcaaggaacagatggaatcccagttggaaaaggaggcccggttccgacagctgatggcccacagctcccacgactcggccattgacacggattccatggagtgggaaacggaagttgtagagttcgagagggagacggaggatattgacttgaaggcactggggtttgatatggcagaaggtgtgaatgagccttgtttcccgggggactgtggcatatttgtcactaaagtggacaaaggaagcattgctgatggccgcttaagggtcaatgactggctgctgagaatcaacgatgtggacctcatcaacaaggacaagaagcaggccatcaaggcgctcctcaatggggagggggccatcaacatggtcgtgcggcggaggaagtccctgggtgggaaggtggtcacgccgctgcacatcaacctcagtggacagaaagacagtggcatcagtctggagaatggagtgtatgctgccgctgtgctgcctggaagccctgccgctaaagaagggtcccttgctgtgggagacaggatcgttgcgatcaatggcattgcactggacaacaagtctctgaatgaatgtgaatctctgctgcgcagctgccaggactccctgaccctgtccctcctgaaggaacagaagtgtgtcccggccagtggagaactctccccggagctccaggagtgggcaccttactcgcctgggcattccagccggcacagcaaccccccgctataccctagcaggccgtctgtgggcactgttccccggagtttgacccccagcaccactgtgagctccatcctgcggaaccccatctacactgtgcgcagtcacagggtcggcccctgcagctctccacctgcggcccgagatgctggcccccagggtttgcatcccagtgtccagcaccagggacgcctgagcctggacctgagccacaggacctgcagcgactactccgagatgagagccacccatgggtccaactcactgccctccagcgcccgcctgggttcttcgagtaacttgcagttcaaggcggaacgcattaaaatcccatcaacaccaagatatccgcggagtgtcgtgggctccgagagaggttcagtgtcacattctgaatgcagcactcctccacagtcacccctgaacatcgacaccctgtcctcttgtagccagtcccagacctcagcctccacattgcccagaatcgctgtcaaccccgcgtccctcggggagcggagaaaggacaggccttatgtggaggagccacgccacgtgaaggtgcagaagggctcagagccgctgggcatctccatcgtgagtggagagaagggcggcatctacgtctccaaggtgaccgtggggagcatcgctcaccaggctggcctcgagtatggggatcagttactggagttcaacggcataaacctgcggagcgccacggagcagcaggcgcggctcatcatcgggcagcagtgtgataccatcaccatcctggcccagtacaacccccacgtgcaccagctcagcagccactcccggtccagctcacacctggaccctgccggtacccactccactctccagggcagtggcaccaccaccccggagcatccatctgtcatcgacccactgatggagcaggacgaggggcctagcacccccccagccaagcagagcagctccaggattgcgggagatgccaacaagaagaccctggagccacgcgttgtcttcatcaaaaagtcccagctggagcttggggtgcacttgtgtggtgggaacctgcatggggtgtttgtggccgaggtggaggatgacagtcctgccaagggtcctgacggcctcgtgccaggggacctcatcctggagtatggcagcctggacgtgcggaacaagacagtggaggaagtctatgtggagatgctgaagcccagggatggcgtccgcctgaaggtgcagtaccgccctgaggagttcacgaaggccaagggcctgcctggtgacagcttctacatcagggccctgtacgaccggctggcagatgtggagcaagagttgagctttaagaaggacgacatcctctacgtggatgacaccttaccccagggcacgttcgggtcctggatggcttggcagctggacgagaatgcccagaagatccagcgcgggcagattcccagcaaatatgtgatggaccaagaattctccaggaggctcagcatgtctgaagtcaaagatgacaatagcgccacaaagacgctgtcagcggctgcacgccggtccttttttcggaggaaacacaagcacaaacgcagcgggtccaaggacgggaaagacctgctcgccttggatgccttttccagtgactccattccactctttgaagattcggtgagcctggcctatcagcgggtccagaaggtggactgcaccgctctgaggcctgtcctgattctggggcctttgctggacgtggtgaaggagatgctggtgaatgaggctcctggcaagttctgcagatgtccccttgaggtgatgaaggcctcccagcaggccattgagcggggtgtcaaagattgcctgtttgtcgactataagcggagaagcggccatttcgatgtgaccactgtggcgtcaataaaggagatcacagaaaagaaccgacactgcctcctggacattgctccgcacgctattgagcggctccaccacatgcacatctaccccattgtcatcttcatccactacaagagcgccaagcacatcaaggagcagagagaccccatctacctgagggacaaggtgactcagaggcattccaaagagcagtttgaggcggcgcagaagcttgagcaggagtacagcaggtacttcacaggggtcatccagggaggagccctgtcaagcatttgcactcagatcttggcaatggtcaatcaagaacaaaataaagtcctgtggattccagcctgcccgctctaggagaatgctgtgctgtggatgactgcagctggccgcctgaggggacaccagactcagctcttttctagcgactgaaagtagaagtctgtccgtctatgaacatgcgggggaaggatccggaaccaggacccagaagcacctcctttgtagacagagggccacggctgcgtgcgatccaggcccaggcccacacactctgcccgtgtcacacgtgtgctttaacacaaaacagataacactaaagacgggttcagcacccacctttctttagccagctgatcagagatgctgcaaagagaacctttcggatcactcgtttacaagccttttctaagtatttggtggtttatgtttacttgaacggctccatgttgccggtgcccagcccctgtcccctctgtcaaccccctgtcgctttggtgttggtttcgttcccgtcttcagcaaaacgaccttggaacctcaatgggggctgctttgctttgggaggttcttgttggtgggaccagagctttgacaaacctcctgctccttggtggcacctctcctggaaggacgtcacaactccaggtgctcagactgcctgtggcagcagaaccagtgcctttggcattttcctcccacaatggggaaggtgactttggcattcttacaaactcgtctctcggcctttctctcctgccttccacagcctctcgtttctcctccatctgtgcttattacttgaggactgtgtctgctccgtgagagctgcgtgggcagggctgcagtggggtccaggtggtgttcagctgtgctgatgcctgccattgggtcctccttaggctctgtaagtcgtgacagccttcatcagtgcaatgtttgcagggtaattcttaaactttttagagggtggcaggtacatcagttctttttgatatgaaaacattcatgtttcagacattgaattgagagcttttaggggaagcataatggttattgtcactatcaacagtctaaaaagaaaaactgaggtctttttaatcttgattacagcactcacggcatgcaccctactcagtgtgggtgtcttcgtttgggggctttttttttttttgcacttctgaggctagatatgtctggctgaagatttgatgtggttcctccttaagctatgcgtcctgttaataataggtactgtactgggctctgtgtaagtgtcgttggggtaggacctatattttaatactgttcctaacatttcattttactagcgagaaatctttgatttcattttattctttgtaattctagacactagattgtagtttagccataactgatgttttttaaaaagggatatattttcttgcacagttgttcaaaaaagagacaagtttcagtcctcaatgctgtcctttgttttacaggtacaagttttctagctcagacaaactatgaaaaactgtagactattctcaaggtattaactcgcagaccctctgggggtaggggctgttttctaagttacaggcagagtgggactgagatggtacagtgtgcacagacaggtactgagctgacagactgggattttctgtactaaaatgttactttgtatcaaaagttaaacaggctttagtacaacaaataaaggtcaatttctgt

SEQ ID NO: 8546 - DNA, 7415 bp, Homo sapiens
gccaccatggagccccagcgccgggagctgctcgcccagtgtcagcagagcctggcccaggccatgacggaggtggaagccgtgctcgggctgctcgaggccgcgggagcgctcagtcccggcgagcggcggcagctggacgaggaggcgggaggcgccaaggcggagctgctgctcaagctgctcttggccaaggagcgggaccacttccaggacctgcgggcggcgctggagaagacgcagcctcacctgctgcccattctctacctgaacggcgtcgtcgggccgccgcagcccgccgaaggcgcgggttctacctacagcgtcctgtccaccatgccctcagactcagaaagcagcagctccctcagcagtgtgggcactaccgggaaggcgccgtccccaccacccctcctcactgaccagcaagtgaatgagaaggtggagaacctctccattcagctgcggctgatgacccgggagagaaacgagctccgcaagcgcctggcctttgctacgcatggcacggcctttgacaagaggccctaccacaggctgaatcctgactatgagaggctgaagatccagtgcgtgcgagccatgtcggacctgcagagcctgcagaaccagcacaccaacgccttgaagaggtgtgaggaggtggccaaggagactgacttctaccacacactccacagccggctcctgagtgaccagactcggctgaaggatgacgtggacatgctgaggcgggagaatgggcagctgctgcgggagcgaaacctgctgcagcagtcatgggaggacatgaagcggctccacgaggaggaccagaaggagatcggtgacctccgtgcccagcagcagcaggtgttgaagcacaacgggtcatccgagattctcaacaaactgtatgacacggccatggacaagttggaggtggtcaagaaggactatgacgcccttcggaagaggtacagtgagaaagtcgccatccacaatgcagacctgagccgcctggagcagctgggggaggagaaccagcggttgctgaagcagacagagatgctgacccagcagagggacacggccatccagctgcagcaccagtgcgccctctccctgaggaggtttgaggcgatccaccatgagctgaacaaggccacggcgcagaacaaggacctgcagtgggagatggagctgctgcagtcagagctgaccgagctgagaaccacgcaggtgaagacagcaaaggagtcggagaaatacagggaggagcgggacgctgtgtacagcgagtacaagctcatcatgagtgagcgtgaccaggtcatctctgagctggacaagctgcagaccgaagtggagctggccgagtccaagctcaagagcagcacatctgagaagaaggcggccaatgaggagatggaggcgctgcggcagatcaaagacacggtgacaatggatgctgggagagccaacaaggaggttgaaatccttcgaaagcagtgcaaggctctgtgccaggagctgaaggaagccctccaggaggcggatgtggccaagtgccggcgggactgggccttccaggagcgagacaagattgtagcagagcgtgacagcatccggacactgtgtgacaacctgaggcgggagcgggaccgtgcggtgagcgagctggctgaggccctgcgcagcctggatgacacccgcaagcagaagaatgatgtcagccgcgagctgaaggagctcaaggaacagatggaatcccagttggaaaaggaggcccggttccgacagctgatggcccacagctcccacgactcggccattgacacggattccatggagtgggaaacggaagttgtagagttcgagagggagacggaggatattgacttgaaggcactggggtttgatatggcagaaggtgtgaatgagccttgtttcccgggggactgtggcatatttgtcactaaagtggacaaaggaagcattgctgatggccgcttaagggtcaatgactggctgctgagaatcaacgatgtggacctcatcaacaaggacaagaagcaggccatcaaggcgctcctcaatggggagggggccatcaacatggtcgtgcggcggaggaagtccctgggtgggaaggtggtcacgccgctgcacatcaacctcagtggacagaaagacagtggcatcagtctggagaatggagtgtatgctgccgctgtgctgcctggaagccctgccgctaaagaagggtcccttgctgtgggagacaggatcgttgcgatcaatggcattgcactggacaacaagtctctgaatgaatgtgaatctctgctgcgcagctgccaggactccctgaccctgtccctcctgaaggtattccctcagagctcctcgtggagtggccagaacatttttgaaaatatcaaagactctgataagatgctgagttttcgagcccatggcccggaggtccaggctcataacaaacggaacttgatacagcacaataactccacgcagacagacatcttctacacggacaggctggaagacaggaaggagccaggccccccaggaggcagcagctcctttctgcataagccattccctgggggacccttgcaggtctgcccccaggcctgtcccagtgcctctgagcgtagcctgagctccttccgctcagatgcctctggggaccgtggctttgggctggtggacgtgcgtggccggcggccactgctgccctttgagaccgaggtgggcccctgtggggttggggaggcctccctggacaaggcagactctgaaggctccaacagcggcgggacctggcccaaggccatgctcagctccacggcagtgcctgagaagctctctgtttataaaaagccaaagcaaagaaagtccatctttgaccctaacactttcaaacgcccccagacaccccccaaaatagactacctgcttccaggtcctgggcctgctcactctccccagccctccaagagggcggggcctctgacacccccaaaacctcccagaaggagcgactccattaagttccagcacaggctggagactagctccgagtcagaagccactctggtgggcagctccccatccactagtcccccgagcgccctgccccctgacgtggaccccggggagcccatgcacgcatcaccccctcgcaaggccagggtccgcattgcttccagctactaccctgaaggagatggggactcctcccacctgccggccaagaaatcctgtgatgaggacctcacctcccagaaggtggatgagctggggcagaagcgtcgccggccaaaatctgctcccagttttcggccgaagcttgctccagtagtgattcctgctcagttcctggaggaacagaagtgtgtcccggccagtggagaactctccccggagctccaggagtgggcaccttactcgcctgggcattccagccggcacagcaaccccccgctataccctagcaggccgtctgtgggcactgttccccggagtttgacccccagcaccactgtgagctccatcctgcggaaccccatctacactgtgcgcagtcacagggtcggcccctgcagctctccacctgcggcccgagatgctggcccccagggtttgcatcccagtgtccagcaccagggacgcctgagcctggacctgagccacaggacctgcagcgactactccgagatgagagccacccatgggtccaactcactgccctccagcgcccgcctgggttcttcgagtaacttgcagttcaaggcggaacgcattaaaatcccatcaacaccaagatatccgcggagtgtcgtgggctccgagagaggttcagtgtcacattctgaatgcagcactcctccacagtcacccctgaacatcgacaccctgtcctcttgtagccagtcccagacctcagcctccacattgcccagaatcgctgtcaaccccgcgtccctcggggagcggagaaaggacaggccttatgtggaggagccacgccacgtgaaggtgcagaagggctcagagccgctgggcatctccatcgtgagtggagagaagggcggcatctacgtctccaaggtgaccgtggggagcatcgctcaccaggctggcctcgagtatggggatcagttactggagttcaacggcataaacctgcggagcgccacggagcagcaggcgcggctcatcatcgggcagcagtgtgataccatcaccatcctggcccagtacaacccccacgtgcaccagctcagcagccactcccggtccagctcacacctggaccctgccggtacccactccactctccagggcagtggcaccaccaccccggagcatccatctgtcatcgacccactgatggagcaggacgaggggcctagcacccccccagccaagcagagcagctccaggattgcgggagatgccaacaagaagaccctggagccacgcgttgtcttcatcaaaaagtcccagctggagcttggggtgcacttgtgtggtgggaacctgcatggggtgtttgtggccgaggtggaggatgacagtcctgccaagggtcctgacggcctcgtgccaggggacctcatcctggagtatggcagcctggacgtgcggaacaagacagtggaggaagtctatgtggagatgctgaagcccagggatggcgtccgcctgaaggtgcagtaccgccctgaggagttcacgaaggccaagggcctgcctggtgacagcttctacatcagggccctgtacgaccggctggcagatgtggagcaagagttgagctttaagaaggacgacatcctctacgtggatgacaccttaccccagggcacgttcgggtcctggatggcttggcagctggacgagaatgcccagaagatccagcgcgggcagattcccagcaaatatgtgatggaccaagaattctccaggaggctcagcatgtctgaagtcaaagatgacaatagcgccacaaagacgctgtcagcggctgcacgccggtccttttttcggaggaaacacaagcacaaacgcagcgggtccaaggacgggaaagacctgctcgccttggatgccttttccagtgactccattccactctttgaagattcggtgagcctggcctatcagcgggtccagaaggtggactgcaccgctctgaggcctgtcctgattctggggcctttgctggacgtggtgaaggagatgctggtgaatgaggctcctggcaagttctgcagatgtccccttgaggtgatgaaggcctcccagcaggccattgagcggggtgtcaaagattgcctgtttgtcgactataagcggagaagcggccatttcgatgtgaccactgtggcgtcaataaaggagatcacagaaaagaaccgacactgcctcctggacattgctccgcacgctattgagcggctccaccacatgcacatctaccccattgtcatcttcatccactacaagagcgccaagcacatcaaggagcagagagaccccatctacctgagggacaaggtgactcagaggcattccaaagagcagtttgaggcggcgcagaagcttgagcaggagtacagcaggtacttcacaggggtcatccagggaggagccctgtcaagcatttgcactcagatcttggcaatggtcaatcaagaacaaaataaagtcctgtggattccagcctgcccgctctaggagaatgctgtgctgtggatgactgcagctggccgcctgaggggacaccagactcagctcttttctagcgactgaaagtagaagtctgtccgtctatgaacatgcgggggaaggatccggaaccaggacccagaagcacctcctttgtagacagagggccacggctgcgtgcgatccaggcccaggcccacacactctgcccgtgtcacacgtgtgctttaacacaaaacagataacactaaagacgggttcagcacccacctttctttagccagctgatcagagatgctgcaaagagaacctttcggatcactcgtttacaagccttttctaagtatttggtggtttatgtttacttgaacggctccatgttgccggtgcccagcccctgtcccctctgtcaaccccctgtcgctttggtgttggtttcgttcccgtcttcagcaaaacgaccttggaacctcaatgggggctgctttgctttgggaggttcttgttggtgggaccagagctttgacaaacctcctgctccttggtggcacctctcctggaaggacgtcacaactccaggtgctcagactgcctgtggcagcagaaccagtgcctttggcattttcctcccacaatggggaaggtgactttggcattcttacaaactcgtctctcggcctttctctcctgccttccacagcctctcgtttctcctccatctgtgcttattacttgaggactgtgtctgctccgtgagagctgcgtgggcagggctgcagtggggtccaggtggtgttcagctgtgctgatgcctgccattgggtcctccttaggctctgtaagtcgtgacagccttcatcagtgcaatgtttgcagggtaattcttaaactttttagagggtggcaggtacatcagttctttttgatatgaaaacattcatgtttcagacattgaattgagagcttttaggggaagcataatggttattgtcactatcaacagtctaaaaagaaaaactgaggtctttttaatcttgattacagcactcacggcatgcaccctactcagtgtgggtgtcttcgtttgggggctttttttttttttgcacttctgaggctagatatgtctggctgaagatttgatgtggttcctccttaagctatgcgtcctgttaataataggtactgtactgggctctgtgtaagtgtcgttggggtaggacctatattttaatactgttcctaacatttcattttactagcgagaaatctttgatttcattttattctttgtaattctagacactagattgtagtttagccataactgatgttttttaaaaagggatatattttcttgcacagttgttcaaaaaagagacaagtttcagtcctcaatgctgtcctttgttttacaggtacaagttttctagctcagacaaactatgaaaaactgtagactattctcaaggtattaactcgcagaccctctgggggtaggggctgttttctaagttacaggcagagtgggactgagatggtacagtgtgcacagacaggtactgagctgacagactgggattttctgtactaaaatgttactttgtatcaaaagttaaacaggctttagtacaacaaataaaggtcaatttctgtaa

SEQ ID NO: 8547 - DNA, 6154 bp, Homo sapiens
cggcgccctagggctgctgccgaggtgctcgcctgcccgcccgccggcctcggggggcccgggaggcgtccggcggggcggggcggcgcggcccgccaccatggagccccagcgccgggagctgctcgcccagtgtcagcagagcctggcccaggccatgacggaggtggaagccgtgctcgggctgctcgaggccgcgggagcgctcagtcccggcgagcggcggcagctggacgaggaggcgggaggcgccaaggcggagctgctgctcaagctgctcttggccaaggagcgggaccacttccaggacctgcgggcggcgctggagaagacgcagcctcacctgctgcccattctctacctgaacggcgtcgtcgggccgccgcagcccgccgaaggcgcgggttctacctacagcgtcctgtccaccatgccctcagactcagaaagcagcagctccctcagcagtgtgggcactaccgtaaaacatttgagggaacagatggaatcccagttggaaaaggaggcccggttccgacagctgatggcccacagctcccacgactcggccattgacacggattccatggagtgggaaacggaagttgtagagttcgagagggagacggaggatattgacttgaaggcactggggtttgatatggcagaaggtgtgaatgagccttgtttcccgggggactgtggcatatttgtcactaaagtggacaaaggaagcattgctgatggccgcttaagggtcaatgactggctgctgagaatcaacgatgtggacctcatcaacaaggacaagaagcaggccatcaaggcgctcctcaatggggagggggccatcaacatggtcgtgcggcggaggaagtccctgggtgggaaggtggtcacgccgctgcacatcaacctcagtggacagaaagacagtggcatcagtctggagaatggagtgtatgctgccgctgtgctgcctggaagccctgccgctaaagaagggtcccttgctgtgggagacaggatcgttgcgatcaatggcattgcactggacaacaagtctctgaatgaatgtgaatctctgctgcgcagctgccaggactccctgaccctgtccctcctgaaggtattccctcagagctcctcgtggagtggccagaacatttttgaaaatatcaaagactctgataagatgctgagttttcgagcccatggcccggaggtccaggctcataacaaacggaacttgatacagcacaataactccacgcagacagacatcttctacacggacaggctggaagacaggaaggagccaggccccccaggaggcagcagctcctttctgcataagccattccctgggggacccttgcaggtctgcccccaggcctgtcccagtgcctctgagcgtagcctgagctccttccgctcagatgcctctggggaccgtggctttgggctggtggacgtgcgtggccggcggccactgctgccctttgagaccgaggtgggcccctgtggggttggggaggcctccctggacaaggcagactctgaaggctccaacagcggcgggacctggcccaaggccatgctcagctccacggcagtgcctgagaagctctctgtttataaaaagccaaagcaaagaaagtccatctttgaccctaacactttcaaacgcccccagacaccccccaaaatagactacctgcttccaggtcctgggcctgctcactctccccagccctccaagagggcggggcctctgacacccccaaaacctcccagaaggagcgactccattaagttccagcacaggctggagactagctccgagtcagaagccactctggtgggcagctccccatccactagtcccccgagcgccctgccccctgacgtggaccccggggagcccatgcacgcatcaccccctcgcaaggccagggtccgcattgcttccagctactaccctgaaggagatggggactcctcccacctgccggccaagaaatcctgtgatgaggacctcacctcccagaaggtggatgagctggggcagaagcgtcgccggccaaaatctgctcccagttttcggccgaagcttgctccagtagtgattcctgctcagttcctggaggaacagaagtgtgtcccggccagtggagaactctccccggagctccaggagtgggcaccttactcgcctgggcattccagccggcacagcaaccccccgctataccctagcaggccgtctgtgggcactgttccccggagtttgacccccagcaccactgtgagctccatcctgcggaaccccatctacactgtgcgcagtcacagggtcggcccctgcagctctccacctgcggcccgagatgctggcccccagggtttgcatcccagtgtccagcaccagggacgcctgagcctggacctgagccacaggacctgcagcgactactccgagatgagagccacccatgggtccaactcactgccctccagcgcccgcctgggttcttcgagtaacttgcagttcaaggcggaacgcattaaaatcccatcaacaccaagatatccgcggagtgtcgtgggctccgagagaggttcagtgtcacattctgaatgcagcactcctccacagtcacccctgaacatcgacaccctgtcctcttgtagccagtcccagacctcagcctccacattgcccagaatcgctgtcaaccccgcgtccctcggggagcggagaaaggacaggccttatgtggaggagccacgccacgtgaaggtgcagaagggctcagagccgctgggcatctccatcgtgagtggagagaagggcggcatctacgtctccaaggtgaccgtggggagcatcgctcaccaggctggcctcgagtatggggatcagttactggagttcaacggcataaacctgcggagcgccacggagcagcaggcgcggctcatcatcgggcagcagtgtgataccatcaccatcctggcccagtacaacccccacgtgcaccagctcagcagccactcccggtccagctcacacctggaccctgccggtacccactccactctccagggcagtggcaccaccaccccggagcatccatctgtcatcgacccactgatggagcaggacgaggggcctagcacccccccagccaagcagagcagctccaggattgcgggagatgccaacaagaagaccctggagccacgcgttgtcttcatcaaaaagtcccagctggagcttggggtgcacttgtgtggtgggaacctgcatggggtgtttgtggccgaggtggaggatgacagtcctgccaagggtcctgacggcctcgtgccaggggacctcatcctggagtatggcagcctggacgtgcggaacaagacagtggaggaagtctatgtggagatgctgaagcccagggatggcgtccgcctgaaggtgcagtaccgccctgaggagttcacgaaggccaagggcctgcctggtgacagcttctacatcagggccctgtacgaccggctggcagatgtggagcaagagttgagctttaagaaggacgacatcctctacgtggatgacaccttaccccagggcacgttcgggtcctggatggcttggcagctggacgagaatgcccagaagatccagcgcgggcagattcccagcaaatatgtgatggaccaagaattctccaggaggctcagcatgtctgaagtcaaagatgacaatagcgccacaaagacgctgtcagcggctgcacgccggtccttttttcggaggaaacacaagcacaaacgcagcgggtccaaggacgggaaagacctgctcgccttggatgccttttccagtgactccattccactctttgaagattcggtgagcctggcctatcagcgggtccagaaggtggactgcaccgctctgaggcctgtcctgattctggggcctttgctggacgtggtgaaggagatgctggtgaatgaggctcctggcaagttctgcagatgtccccttgaggtgatgaaggcctcccagcaggccattgagcggggtgtcaaagattgcctgtttgtcgactataagcggagaagcggccatttcgatgtgaccactgtggcgtcaataaaggagatcacagaaaagaaccgacactgcctcctggacattgctccgcacgctattgagcggctccaccacatgcacatctaccccattgtcatcttcatccactacaagagcgccaagcacatcaaggagcagagagaccccatctacctgagggacaaggtgactcagaggcattccaaagagcagtttgaggcggcgcagaagcttgagcaggagtacagcaggtacttcacaggggtcatccagggaggagccctgtcaagcatttgcactcagatcttggcaatggtcaatcaagaacaaaataaagtcctgtggattccagcctgcccgctctaggagaatgctgtgctgtggatgactgcagctggccgcctgaggggacaccagactcagctcttttctagcgactgaaagtagaagtctgtccgtctatgaacatgcgggggaaggatccggaaccaggacccagaagcacctcctttgtagacagagggccacggctgcgtgcgatccaggcccaggcccacacactctgcccgtgtcacacgtgtgctttaacacaaaacagataacactaaagacgggttcagcacccacctttctttagccagctgatcagagatgctgcaaagagaacctttcggatcactcgtttacaagccttttctaagtatttggtggtttatgtttacttgaacggctccatgttgccggtgcccagcccctgtcccctctgtcaaccccctgtcgctttggtgttggtttcgttcccgtcttcagcaaaacgaccttggaacctcaatgggggctgctttgctttgggaggttcttgttggtgggaccagagctttgacaaacctcctgctccttggtggcacctctcctggaaggacgtcacaactccaggtgctcagactgcctgtggcagcagaaccagtgcctttggcattttcctcccacaatggggaaggtgactttggcattcttacaaactcgtctctcggcctttctctcctgccttccacagcctctcgtttctcctccatctgtgcttattacttgaggactgtgtctgctccgtgagagctgcgtgggcagggctgcagtggggtccaggtggtgttcagctgtgctgatgcctgccattgggtcctccttaggctctgtaagtcgtgacagccttcatcagtgcaatgtttgcagggtaattcttaaactttttagagggtggcaggtacatcagttctttttgatatgaaaacattcatgtttcagacattgaattgagagcttttaggggaagcataatggttattgtcactatcaacagtctaaaaagaaaaactgaggtctttttaatcttgattacagcactcacggcatgcaccctactcagtgtgggtgtcttcgtttgggggctttttttttttttgcacttctgaggctagatatgtctggctgaagatttgatgtggttcctccttaagctatgcgtcctgttaataataggtactgtactgggctctgtgtaagtgtcgttggggtaggacctatattttaatactgttcctaacatttcattttactagcgagaaatctttgatttcattttattctttgtaattctagacactagattgtagtttagccataactgatgttttttaaaaagggatatattttcttgcacagttgttcaaaaaagagacaagtttcagtcctcaatgctgtcctttgttttacaggtacaagttttctagctcagacaaactatgaaaaactgtagactattctcaaggtattaactcgcagaccctctgggggtaggggctgttttctaagttacaggcagagtgggactgagatggtacagtgtgcacagacaggtactgagctgacagactgggattttctgtactaaaatgttactttgtatcaaaagttaaacaggctttagtacaacaaataaaggtcaatttctgt

SEQ ID NO: 8548 - DNA, 4292 bp, Homo sapiens
ggggccatcaacatggtcgtgcggcggaggaagtccctgggtgggaaggtggtcacgccgctgcacatcaacctcagtggacagaaagacagtggcatcagtctggagaatggagtgtatgctgccgctgtgctgcctggaagccctgccgctaaagaagggtcccttgctgtgggagacaggatcgttgcgatcaatggcattgcactggacaacaagtctctgaatgaatgtgaatctctgctgcgcagctgccaggactccctgaccctgtccctcctgaaggaacagaagtgtgtcccggccagtggagaactctccccggagctccaggagtgggcaccttactcgcctgggcattccagccggcacagcaaccccccgctataccctagcaggccgtctgtgggcactgttccccggagtttgacccccagcaccactgtgagctccatcctgcggaaccccatctacactgtgcgcagtcacagggtcggcccctgcagctctccacctgcggcccgagatgctggcccccagggtttgcatcccagtgtccagcaccagggacgcctgagcctggacctgagccacaggacctgcagcgactactccgagatgagagccacccatgggtccaactcactgccctccagcgcccgcctgggttcttcgagtaacttgcagttcaaggcggaacgcattaaaatcccatcaacaccaagatatccgcggagtgtcgtgggctccgagagaggttcagtgtcacattctgaatgcagcactcctccacagtcacccctgaacatcgacaccctgtcctcttgtagccagtcccagacctcagcctccacattgcccagaatcgctgtcaaccccgcgtccctcggggagcggagaaaggacaggccttatgtggaggagccacgccacgtgaaggtgcagaagggctcagagccgctgggcatctccatcgtgagtggagagaagggcggcatctacgtctccaaggtgaccgtggggagcatcgctcaccaggctggcctcgagtatggggatcagttactggagttcaacggcataaacctgcggagcgccacggagcagcaggcgcggctcatcatcgggcagcagtgtgataccatcaccatcctggcccagtacaacccccacgtgcaccagctcagcagccactcccggtccagctcacacctggaccctgccggtacccactccactctccagggcagtggcaccaccaccccggagcatccatctgtcatcgacccactgatggagcaggacgaggggcctagcacccccccagccaagcagagcagctccaggattgcgggagatgccaacaagaagaccctggagccacgcgttgtcttcatcaaaaagtcccagctggagcttggggtgcacttgtgtggtgggaacctgcatggggtgtttgtggccgaggtggaggatgacagtcctgccaagggtcctgacggcctcgtgccaggggacctcatcctggagtatggcagcctggacgtgcggaacaagacagtggaggaagtctatgtggagatgctgaagcccagggatggcgtccgcctgaaggtgcagtaccgccctgaggagttcacgaaggccaagggcctgcctggtgacagcttctacatcagggccctgtacgaccggctggcagatgtggagcaagagttgagctttaagaaggacgacatcctctacgtggatgacaccttaccccagggcacgttcgggtcctggatggcttggcagctggacgagaatgcccagaagatccagcgcgggcagattcccagcaaatatgtgatggaccaagaattctccaggaggctcagcatgtctgaagtcaaagatgacaatagcgccacaaagacgctgtcagcggctgcacgccggtccttttttcggaggaaacacaagcacaaacgcagcgggtccaaggacgggaaagacctgctcgccttggatgccttttccagtgactccattccactctttgaagattcggtgagcctggcctatcagcgggtccagaaggtggactgcaccgctctgaggcctgtcctgattctggggcctttgctggacgtggtgaaggagatgctggtgaatgaggctcctggcaagttctgcagatgtccccttgaggtgatgaaggcctcccagcaggccattgagcggggtgtcaaagattgcctgtttgtcgactataagcggagaagcggccatttcgatgtgaccactgtggcgtcaataaaggagatcacagaaaagaaccgacactgcctcctggacattgctccgcacgctattgagcggctccaccacatgcacatctaccccattgtcatcttcatccactacaagagcgccaagcacatcaaggagcagagagaccccatctacctgagggacaaggtgactcagaggcattccaaagagcagtttgaggcggcgcagaagcttgagcaggagtacagcaggtacttcacaggggtcatccagggaggagccctgtcaagcatttgcactcagatcttggcaatggtcaatcaagaacaaaataaagtcctgtggattccagcctgcccgctctaggagaatgctgtgctgtggatgactgcagctggccgcctgaggggacaccagactcagctcttttctagcgactgaaagtagaagtctgtccgtctatgaacatgcgggggaaggatccggaaccaggacccagaagcacctcctttgtagacagagggccacggctgcgtgcgatccaggcccaggcccacacactctgcccgtgtcacacgtgtgctttaacacaaaacagataacactaaagacgggttcagcacccacctttctttagccagctgatcagagatgctgcaaagagaacctttcggatcactcgtttacaagccttttctaagtatttggtggtttatgtttacttgaacggctccatgttgccggtgcccagcccctgtcccctctgtcaaccccctgtcgctttggtgttggtttcgttcccgtcttcagcaaaacgaccttggaacctcaatgggggctgctttgctttgggaggttcttgttggtgggaccagagctttgacaaacctcctgctccttggtggcacctctcctggaaggacgtcacaactccaggtgctcagactgcctgtggcagcagaaccagtgcctttggcattttcctcccacaatggggaaggtgactttggcattcttacaaactcgtctctcggcctttctctcctgccttccacagcctctcgtttctcctccatctgtgcttattacttgaggactgtgtctgctccgtgagagctgcgtgggcagggctgcagtggggtccaggtggtgttcagctgtgctgatgcctgccattgggtcctccttaggctctgtaagtcgtgacagccttcatcagtgcaatgtttgcagggtaattcttaaactttttagagggtggcaggtacatcagttctttttgatatgaaaacattcatgtttcagacattgaattgagagcttttaggggaagcataatggttattgtcactatcaacagtctaaaaagaaaaactgaggtctttttaatcttgattacagcactcacggcatgcaccctactcagtgtgggtgtcttcgtttgggggctttttttttttttgcacttctgaggctagatatgtctggctgaagatttgatgtggttcctccttaagctatgcgtcctgttaataataggtactgtactgggctctgtgtaagtgtcgttggggtaggacctatattttaatactgttcctaacatttcattttactagcgagaaatctttgatttcattttattctttgtaattctagacactagattgtagtttagccataactgatgttttttaaaaagggatatattttcttgcacagttgttcaaaaaagagacaagtttcagtcctcaatgctgtcctttgttttacaggtacaagttttctagctcagacaaactatgaaaaactgtagactattctcaaggtattaactcgcagaccctctgggggtaggggctgttttctaagttacaggcagagtgggactgagatggtacagtgtgcacagacaggtactgagctgacagactgggattttctgtactaaaatgttactttgtatcaaaagttaaacaggctttagtacaacaaataaaggtcaatttctgtaa

SEQ ID NO: 8549 - DNA, 4256 bp, Homo sapiens
tacgagcggctgtgaaggaaactgtttaaccggatcccattgtacccagagtgcagagccgcctttccagcatgcaggggctgctcagcgtttagtcacatcaagaaatagaacagaattcagccatggccccaagaaagagaggtggacgaggtatttcattcatcttttgctgtttccgaaataatgatcacccagaaatcacgtatcggctgcgaaatgatagcaactttgcgcttcagaccatggaaccagcattgcccatgccccctgtggaggagctggatgtcatgttcagtgaactggtggatgaactggacctcacagacaaacacagagaagccatgtttgcacttccagctgagaaaaaatggcaaatatactgtagcaagaaaaaggaccaggaagaaaacaagggagctacaagttggcctgaattctacattgatcagctcaattccatggctgctagaaaatctctgctggctttagagaaggaagaagaagaagaaagaagtaaaactatagagagtttaaagacagcactgaggacaaaaccaatgaggtttgtaaccagattcatcgacttggatggcctatcatgtatcctcaactttctaaagaccatggactacgagacctcagagtctcgaatacatacttctctcattggctgtataaaggcgttaatgaacaactctcaaggccgggctcacgtcctggctcattctgagagtattaatgtaattgctcagagtctgagcacagagaacattaaaacgaaggtggccgtgctggaaatcttgggcgccgtgtgcctggttcccgggggccacaagaaggttctgcaggccatgctgcactaccagaagtatgccagcgaaaggacccgctttcagacattaattaacgacttggataaaagcactgggcggtatcgagatgaagtgagtctcaagactgccatcatgtccttcattaatgcagtgctcagccaaggtgcaggagtggagagtttggactttagacttcatcttcgctatgaatttctgatgttaggaattcaacctgtaatagataaattaagggaacacgaaaattcaacattagataggcatttagacttttttgaaatgctccgaaatgaagatgaactagaatttgccaaaagatttgaactggttcacatagacacaaaaagtgcaactcagatgtttgagctgaccaggaagaggctgacacatagtgaagcttacccgcatttcatgtccatcctgcaccactgcctccaaatgccttacaagaggagtggcaacactgttcagtactggctactactagatagaattatacagcagatagttatccagaatgacaaaggacaggaccctgactccacacctttggaaaactttaatattaagaatgtcgtacgaatgttggttaatgaaaatgaagttaagcagtggaaagaacaagcggaaaaaatgagaaaagagcacaatgagctacaacagaaactggaaaagaaagaacgagaatgtgatgctaagactcaagagaaggaagagatgatgcagaccttaaataaaatgaaagagaaacttgaaaaggagactactgagcataagcaagtcaagcagcaggtggcggacctcacagcacagctccatgagctcagcaggagggccgtctgtgcttcaatcccaggtggaccctcgcctggagcaccaggagggccctttccttcctctgtgcctggatctctccttcctcccccaccacccccacctctaccaggtgggatgcttccccctccaccgcctcccctccctccaggtggccctcctcctcccccagggcctcctcccttaggggcaatcatgccacctcctggtgctccaatgggcctagcactgaagaagaaaagcattcctcagcccacaaatgccctgaaatccttcaactggtctaaactgcccgagaacaaactggaaggaacagtatggaccgaaattgatgatacaaaagtcttcaaaattctagatcttgaagacctggaaagaaccttctctgcctatcaaagacagcaggatttctttgtgaacagtaactccaagcagaaagaagcagatgccattgatgacactctgagttccaaacttaaagttaaagagctttcggtgattgatggtcggagagctcagaattgcaacatccttctatcgaggttgaaattatccaatgacgaaatcaaacgggcaattctaacaatggacgaacaggaagatctgcccaaggacatgttggaacagctcttgaaatttgttcctgaaaaaagtgacattgacctattggaggaacataaacacgaactggatcggatggccaaggctgataggttcctttttgagatgagccgaattaatcactatcagcaaaggttgcaatcgctgtacttcaaaaagaagtttgcagagcgtgtggcagaagtgaaacctaaagtggaagcaattcgttctggctcagaagaggtgtttaggagtggtgccctcaagcagttgctggaggtggttttggcatttggaaattatatgaataaaggtcaaagagggaatgcatatggattcaagatatctagcctaaacaaaattgctgacacaaaatccagcatcgacaaaaacattacccttttgcactatctcatcactattgtggaaaataagtaccccagtgttctcaatctaaatgaagaattgcgagatattcctcaagctgcgaaagtaaacatgactgagctggacaaagaaataagtaccttgagaagtggcttgaaagcagtagagacagagctggaatatcagaagtctcagcccccacagcccggagataagtttgtgtctgttgtcagccagttcatcacagtagccagcttcagcttctctgatgttgaagaccttctagcagaagctaaagacctgtttactaaagcagtgaagcactttggggaagaggctggcaaaatacaaccagatgagttctttggcatttttgatcaatttcttcaagctgtgtcagaagccaaacaagaaaacgaaaatatgagaaagaaaaaggaggaagaagaacgtcgagctcgcatggaagctcagctcaaagaacaacgtgaaagggaacgtaaaatgagaaaagctaaagagaatagtgaagaaagcggagagtttgatgaccttgtttcagctttacgctcaggagaagtgtttgacaaagacctttctaaattgaaacggaatcgcaaacgtattaccaaccagatgactgacagcagcagagagagaccaatcacaaaacttaatttctaattttccatgaatacttttttttagaaagctcattagcagccctctaaagtgactagaacgtttcattacactgccttgcaatccaaacagtggcaattttttccttcatctgtgagtgaatgtgtgaacgtgtgtatgtaaatgtatgtgtgtatatattaaaaaatgtatatagatgtctgagtgttgtctggagacctatacgtatggttaaaaagatttatgttaatgtatgtgctccaaaacctttcgtgtatgcattcacattgagtgtggctcattttctttccccgaacgccatgactgttcagaagcacaatactatctcctgaaagagataagagacattccctagattcaaaggcaaaacagaagaaacaaacaaacaaacaaaaaaagcttgcaaaatattttatggtttccaagcttgatatcctttaaaattattttcattgatggaactggagttgttggaaaaacatagatttaaaatgatttttgatagctgacattgtgatgttgatgtatcacatcagtaataggaccagctttgaatttctgacattggtgtggggatacagtctgtaaatgtttattgagaacatcttgcacacaatttgaattatgtagaatgtcaatcaagtttttgtatatttaaaagttggacatcaattttttcccctgatttcatcaagttatctctgccaagtgctcttgataatttcttcagatttttggaaaaaaacactatataaatgcaatccatgctttttttaaagaacaacattgccagagtatgcttgttctaacaatatagatatataaaccttaaaaataataaaatatctcacccaagacttaaaggaagaattctctgaagggataaagattact

SEQ ID NO: 8550 - DNA, 4102 bp, Homo sapiens
tacgagcggctgtgaaggaaactgtttaaccggatcccattgtacccagagtgcagagccgcctttccagcatgcaggggctgctcagcgtttagtcacatcaagaaatagaacagaattcagccatggccccaagaaagagaggtggacgaggtatttcattcatcttttgctgtttccgaaataatgatcacccagaaatcacgtatcggctgcgaaatgatagcaactttgcgcttcagaccatggaaccagcattgcccatgccccctgtggaggagctggatgtcatgttcagtgaactggtggatgaactggacctcacagacaaacacagagaagccatgtttgcacttccagctgagaaaaaatggcaaatatactgtagcaagaaaaaggaccaggaagaaaacaagggagctacaagttggcctgaattctacattgatcagctcaattccatggctgctagaaaatctctgctggctttagagaaggaagaagaagaagaaagaagtaaaactatagagagtttaaagacagcactgaggacaaaaccaatgaggtttgtaaccagattcatcgacttggatggcctatcatgtatcctcaactttctaaagaccatggactacgagacctcagagtctcgaatacatacttctctcattggctgtataaaggcgttaatgaacaactctcaaggccgggctcacgtcctggctcattctgagagtattaatgtaattgctcagagtctgagcacagagaacattaaaacgaaggtggccgtgctggaaatcttgggcgccgtgtgcctggttcccgggggccacaagaaggttctgcaggccatgctgcactaccagaagtatgccagcgaaaggacccgctttcagacattaattaacgacttggataaaagcactgggcggtatcgagatgaagtgagtctcaagactgccatcatgtccttcattaatgcagtgctcagccaaggtgcaggagtggagagtttggactttagacttcatcttcgctatgaatttctgatgttaggaattcaacctgtaatagataaattaagggaacacgaaaattcaacattagataggcatttagacttttttgaaatgctccgaaatgaagatgaactagaatttgccaaaagatttgaactggttcacatagacacaaaaagtgcaactcagatgtttgagctgaccaggaagaggctgacacatagtgaagcttacccgcatttcatgtccatcctgcaccactgcctccaaatgccttacaagaggagtggcaacactgttcagtactggctactactagatagaattatacagcagatagttatccagaatgacaaaggacaggaccctgactccacacctttggaaaactttaatattaagaatgtcgtacgaatgttggttaatgaaaatgaagttaagcagtggaaagaacaagcggaaaaaatgagaaaagagcacaatgagctacaacagaaactggaaaagaaagaacgagaatgtgatgctaagactcaagagaaggaagagatgatgcagaccttaaataaaatgaaagagaaacttgaaaaggagactactgagcataagcaagtcaagcagcaggtggcggacctcacagcacagctccatgagctcagcaggagggccgtctgtgcttcaatcccaggtggaccctcgcctggagcaccaggagggccctttccttcctctgtgcctggatctctccttcctcccccaccacccccacctctaccaggtgggatgcttccccctccaccgcctcccctccctccaggtggccctcctcctcccccagggcctcctcccttaggggcaatcatgccacctcctggtgctccaatgggcctagcactgaagaagaaaagcattcctcagcccacaaatgccctgaaatccttcaactggtctaaactgcccgagaacaaactggaaggaacagtatggaccgaaattgatgatacaaaagtcttcaaaattctagatcttgaagacctggaaagaaccttctctgcctatcaaagacagcaggatttctttgtgaacagtaactccaagcagaaagaagcagatgccattgatgacactctgagttccaaacttaaagttaaagagctttcggtgattgatggtcggagagctcagaattgcaacatccttctatcgaggttgaaattatccaatgacgaaatcaaacgggcaattctaacaatggacgaacaggaagatctgcccaaggacatgttggaacagctcttgaaatttgttcctgaaaaaagtgacattgacctattggaggaacataaacacgaactggatcggatggccaaggctgataggttcctttttgagatgagccgaattaatcactatcagcaaaggttgcaatcgctgtacttcaaaaagaagtttgcagagcgtgtggcatttggaaattatatgaataaaggtcaaagagggaatgcatatggattcaagatatctagcctaaacaaaattgctgacacaaaatccagcatcgacaaaaacattacccttttgcactatctcatcactattgtggaaaataagtaccccagtgttctcaatctaaatgaagaattgcgagatattcctcaagctgcgaaagtaaagagctggaatatcagaagtctcagcccccacagcccggagataagtttgtgtctgttgtcagccagttcatcacagtagccagcttcagcttctctgatgttgaagaccttctagcagaagctaaagacctgtttactaaagcagtgaagcactttggggaagaggctggcaaaatacaaccagatgagttctttggcatttttgatcaatttcttcaagctgtgtcagaagccaaacaagaaaacgaaaatatgagaaagaaaaaggaggaagaagaacgtcgagctcgcatggaagctcagctcaaagaacaacgtgaaagggaacgtaaaatgagaaaagctaaagagaatagtgaagaaagcggagagtttgatgaccttgtttcagctttacgctcaggagaagtgtttgacaaagacctttctaaattgaaacggaatcgcaaacgtattaccaaccagatgactgacagcagcagagagagaccaatcacaaaacttaatttctaattttccatgaatacttttttttagaaagctcattagcagccctctaaagtgactagaacgtttcattacactgccttgcaatccaaacagtggcaattttttccttcatctgtgagtgaatgtgtgaacgtgtgtatgtaaatgtatgtgtgtatatattaaaaaatgtatatagatgtctgagtgttgtctggagacctatacgtatggttaaaaagatttatgttaatgtatgtgctccaaaacctttcgtgtatgcattcacattgagtgtggctcattttctttccccgaacgccatgactgttcagaagcacaatactatctcctgaaagagataagagacattccctagattcaaaggcaaaacagaagaaacaaacaaacaaacaaaaaaagcttgcaaaatattttatggtttccaagcttgatatcctttaaaattattttcattgatggaactggagttgttggaaaaacatagatttaaaatgatttttgatagctgacattgtgatgttgatgtatcacatcagtaataggaccagctttgaatttctgacattggtgtggggatacagtctgtaaatgtttattgagaacatcttgcacacaatttgaattatgtagaatgtcaatcaagtttttgtatatttaaaagttggacatcaattttttcccctgatttcatcaagttatctctgccaagtgctcttgataatttcttcagatttttggaaaaaaacactatataaatgcaatccatgctttttttaaagaacaacattgccagagtatgcttgttctaacaatatagatatataaaccttaaaaataataaaatatctcacccaagacttaaaggaagaattctctgaagggataaagattact

SEQ ID NO: 8551 - DNA, 4227 bp, Homo sapiens
ctacgagcggctgtgaaggaaactgtttaaccggatcccattgtacccagagtgcagagccgcctttccagcatgcaggggctgctcagcgtttagtcacatcaagaaatagaacagaattcagccatggccccaagaaagagaggtggacgaggtatttcattcatcttttgctgtttccgaaataatgatcacccagaaatcacgtatcggctgcgaaatgatagcaactttgcgcttcagaccatggaaccagcattgcccatgccccctgtggaggagctggatgtcatgttcagtgaactggtggatgaactggacctcacagacaaacacagagaagccatgtttgcacttccagctgagaaaaaatggcaaatatactgtagcaagaaaaaggaccaggaagaaaacaagggagctacaagttggcctgaattctacattgatcagctcaattccatggctgctagaaaatctctgctggctttagagaaggaagaagaagaagaaagaagtaaaactatagagagtttaaagacagcactgaggacaaaaccaatgaggtttgtaaccagattcatcgacttggatggcctatcatgtatcctcaactttctaaagaccatggactacgagacctcagagtctcgaatacatacttctctcattggctgtataaaggcgttaatgaacaactctcaaggccgggctcacgtcctggctcattctgagagtattaatgtaattgctcagagtctgagcacagagaacattaaaacgaaggtggccgtgctggaaatcttgggcgccgtgtgcctggttcccgggggccacaagaaggttctgcaggccatgctgcactaccagaagtatgccagcgaaaggacccgctttcagacattaattaacgacttggataaaagcactgggcggtatcgagatgaagtgagtctcaagactgccatcatgtccttcattaatgcagtgctcagccaaggtgcaggagtggagagtttggactttagacttcatcttcgctatgaatttctgatgttaggaattcaacctgtaatagataaattaagggaacacgaaaattcaacattagataggcatttagacttttttgaaatgctccgaaatgaagatgaactagaatttgccaaaagatttgaactggttcacatagacacaaaaagtgcaactcagatgtttgagctgaccaggaagaggctgacacatagtgaagcttacccgcatttcatgtccatcctgcaccactgcctccaaatgccttacaagaggagtggcaacactgttcagtactggctactactagatagaattatacagcagatagttatccagaatgacaaaggacaggaccctgactccacacctttggaaaactttaatattaagaatgtcgtacgaatgttggttaatgaaaatgaagttaagcagtggaaagaacaagcggaaaaaatgagaaaagagcacaatgagctacaacagaaactggaaaagaaagaacgagaatgtgatgctaagactcaagagaaggaagagatgatgcagaccttaaataaaatgaaagagaaacttgaaaaggagactactgagcataagcaagtcaagcagcaggtggcggacctcacagcacagctccatgagctcagcaggagggccgtctgtgcttcaatcccaggtggaccctcgcctggagcaccaggagggccctttccttcctctgtgcctggatctctccttcctcccccaccacccccacctctaccaggtgggatgcttccccctccaccgcctcccctccctccaggtggccctcctcctcccccagggcctcctcccttaggggcaatcatgccacctcctggtgctccaatgggcctagcactgaagaagaaaagcattcctcagcccacaaatgccctgaaatccttcaactggtctaaactgcccgagaacaaactggaaggaacagtatggaccgaaattgatgatacaaaagtcttcaaaattctagatcttgaagacctggaaagaaccttctctgcctatcaaagacagcagaaagaagcagatgccattgatgacactctgagttccaaacttaaagttaaagagctttcggtgattgatggtcggagagctcagaattgcaacatccttctatcgaggttgaaattatccaatgacgaaatcaaacgggcaattctaacaatggacgaacaggaagatctgcccaaggacatgttggaacagctcttgaaatttgttcctgaaaaaagtgacattgacctattggaggaacataaacacgaactggatcggatggccaaggctgataggttcctttttgagatgagccgaattaatcactatcagcaaaggttgcaatcgctgtacttcaaaaagaagtttgcagagcgtgtggcagaagtgaaacctaaagtggaagcaattcgttctggctcagaagaggtgtttaggagtggtgccctcaagcagttgctggaggtggttttggcatttggaaattatatgaataaaggtcaaagagggaatgcatatggattcaagatatctagcctaaacaaaattgctgacacaaaatccagcatcgacaaaaacattacccttttgcactatctcatcactattgtggaaaataagtaccccagtgttctcaatctaaatgaagaattgcgagatattcctcaagctgcgaaagtaaacatgactgagctggacaaagaaataagtaccttgagaagtggcttgaaagcagtagagacagagctggaatatcagaagtctcagcccccacagcccggagataagtttgtgtctgttgtcagccagttcatcacagtagccagcttcagcttctctgatgttgaagaccttctagcagaagctaaagacctgtttactaaagcagtgaagcactttggggaagaggctggcaaaatacaaccagatgagttctttggcatttttgatcaatttcttcaagctgtgtcagaagccaaacaagaaaacgaaaatatgagaaagaaaaaggaggaagaagaacgtcgagctcgcatggaagctcagctcaaagaacaacgtgaaagggaacgtaaaatgagaaaagctaaagagaatagtgaagaaagcggagagtttgatgaccttgtttcagctttacgctcaggagaagtgtttgacaaagacctttctaaattgaaacggaatcgcaaacgtattaccaaccagatgactgacagcagcagagagagaccaatcacaaaacttaatttctaattttccatgaatacttttttttagaaagctcattagcagccctctaaagtgactagaacgtttcattacactgccttgcaatccaaacagtggcaattttttccttcatctgtgagtgaatgtgtgaacgtgtgtatgtaaatgtatgtgtgtatatattaaaaaatgtatatagatgtctgagtgttgtctggagacctatacgtatggttaaaaagatttatgttaatgtatgtgctccaaaacctttcgtgtatgcattcacattgagtgtggctcattttctttccccgaacgccatgactgttcagaagcacaatactatctcctgaaagagataagagacattccctagattcaaaggcaaaacagaagaaacaaacaaacaaacaaaaaaagcttgcaaaatattttatggtttccaagcttgatatcctttaaaattattttcattgatggaactggagttgttggaaaaacatagatttaaaatgatttttgatagctgacattgtgatgttgatgtatcacatcagtaataggaccagctttgaatttctgacattggtgtggggatacagtctgtaaatgtttattgagaacatcttgcacacaatttgaattatgtagaatgtcaatcaagtttttgtatatttaaaagttggacatcaattttttcccctgatttcatcaagttatctctgccaagtgctcttgataatttcttcagatttttggaaaaaaacactatataaatgcaatccatgctttttttaaagaacaacattgccagagtatgcttgttctaacaatatagatatataaaccttaaaaataataaaatatctcacccaagacttaaaggaagaattctctgaagggataaagattact

SEQ ID NO: 8552 - DNA, 5806 bp, Homo sapiens
aagaaatagaacagaattcagccatggccccaagaaagagaggtggacgaggtatttcattcatcttttgctgtttccgaaataatgatcacccagaaatcacgtatcggctgcgaaatgatagcaactttgcgcttcagaccatggaaccagcattgcccatgccccctgtggaggagctggatgtcatgttcagtgaactggtggatgaactggacctcacagacaaacacagagaagccatgtttgcacttccagctgagaaaaaatggcaaatatactgtagcaagaaaaaggaccaggaagaaaacaagggagctacaagttggcctgaattctacattgatcagctcaattccatggctgctagaaaatctctgctggctttagagaaggaagaagaagaagaaagaagtaaaactatagagagtttaaagacagcactgaggacaaaaccaatgaggtttgtaaccagattcatcgacttggatggcctatcatgtatcctcaactttctaaagaccatggactacgagacctcagagtctcgaatacatacttctctcattggctgtataaaggcgttaatgaacaactctcaaggccgggctcacgtcctggctcattctgagagtattaatgtaattgctcagagtctgagcacagagaacattaaaacgaaggtggccgtgctggaaatcttgggcgccgtgtgcctggttcccgggggccacaagaaggttctgcaggccatgctgcactaccagaagtatgccagcgaaaggacccgctttcagacattaattaacgacttggataaaagcactgggcggtatcgagatgaagtgagtctcaagactgccatcatgtccttcattaatgcagtgctcagccaaggtgcaggagtggagagtttggactttagacttcatcttcgctatgaatttctgatgttaggaattcaacctgtaatagataaattaagggaacacgaaaattcaacattagataggcatttagacttttttgaaatgctccgaaatgaagatgaactagaatttgccaaaagatttgaactggttcacatagacacaaaaagtgcaactcagatgtttgagctgaccaggaagaggctgacacatagtgaagcttacccgcatttcatgtccatcctgcaccactgcctccaaatgccttacaagaggagtggcaacactgttcagtactggctactactagatagaattatacagcagatagttatccagaatgacaaaggacaggaccctgactccacacctttggaaaactttaatattaagaatgtcgtacgaatgttggttaatgaaaatgaagttaagcagtggaaagaacaagcggaaaaaatgagaaaagagcacaatgagctacaacagaaactggaaaagaaagaacgagaatgtgatgctaagactcaagagaaggaagagatgatgcagaccttaaataaaatgaaagagaaacttgaaaaggagactactgagcataagcaagtcaagcagcaggtggcggacctcacagcacagctccatgagctcagcaggagggccgtctgtgcttcaatcccaggtggaccctcgcctggagcaccaggagggccctttccttcctctgtgcctggatctctccttcctcccccaccacccccacctctaccaggtgggatgcttccccctccaccgcctcccctccctccaggtggccctcctcctcccccagggcctcctcccttaggggcaatcatgccacctcctggtgctccaatgggcctagcactgaagaagaaaagcattcctcagcccacaaatgccctgaaatccttcaactggtctaaactgcccgagaacaaactggaaggaacagtatggaccgaaattgatgatacaaaagtcttcaaaattctagatcttgaagacctggaaagaaccttctctgcctatcaaagacagcaggatttctttgtgaacagtaactccaagcagaaagaagcagatgccattgatgacactctgagttccaaacttaaagttaaagagctttcggtgattgatggtcggagagctcagaattgcaacatccttctatcgaggttgaaattatccaatgacgaaatcaaacgggcaattctaacaatggacgaacaggaagatctgcccaaggacatgttggaacagctcttgaaatttgttcctgaaaaaagtgacattgacctattggaggaacataaacacgaactggatcggatggccaaggctgataggttcctttttgagatgagccgaattaatcactatcagcaaaggttgcaatcgctgtacttcaaaaagaagtttgcagagcgtgtggcagaagtgaaacctaaagtggaagcaattcgttctggctcagaagaggtgtttaggagtggtgccctcaagcagttgctggaggtggttttggcatttggaaattatatgaataaaggtcaaagagggaatgcatatggattcaagatatctagcctaaacaaaattgctgacacaaaatccagcatcgacaaaaacattacccttttgcactatctcatcactattgtggaaaataagtaccccagtgttctcaatctaaatgaagaattgcgagatattcctcaagctgcgaaagtaaacatgactgagctggacaaagaaataagtaccttgagaagtggcttgaaagcagtagagacagagctggaatatcagaagtctcagcccccacagcccggagataagtttgtgtctgttgtcagccagttcatcacagtagccagcttcagcttctctgatgttgaagaccttctagcagaagctaaagacctgtttactaaagcagtgaagcactttggggaagaggctggcaaaatacaaccagatgagttctttggcatttttgatcaatttcttcaagctgtgtcagaagccaaacaagaaaacgaaaatatgagaaagaaaaaggaggaagaagaacgtcgagctcgcatggaagctcagctcaaagaacaacgtgaaagggaacgtaaaatgagaaaagctaaagagaatagtgaagaaagcggagagtttgatgaccttgtttcagctttacgctcaggagaagtgtttgacaaagacctttctaaattgaaacggaatcgcaaacgtattaccaaccagatgactgacagcagcagagagagaccaatcacaaaacttaatttctaattttccatgaatacttttttttagaaagctcattagcagccctctaaagtgactagaacgtttcattacactgccttgcaatccaaacagtggcaattttttccttcatctgtgagtgaatgtgtgaacgtgtgtatgtaaatgtatgtgtgtatatattaaaaaatgtatatagatgtctgagtgttgtctggagacctatacgtatggttaaaaagatttatgttaatgtatgtgctccaaaacctttcgtgtatgcattcacattgagtgtggctcattttctttccccgaacgccatgactgttcagaagcacaatactatctcctgaaagagataagagacattccctagattcaaaggcaaaacagaagaaacaaacaaacaaacaaaaaaagcttgcaaaatattttatggtttccaagcttgatatcctttaaaattattttcattgatggaactggagttgttggaaaaacatagatttaaaatgatttttgatagctgacattgtgatgttgatgtatcacatcagtaataggaccagctttgaatttctgacattggtgtggggatacagtctgtaaatgtttattgagaacatcttgcacacaatttgaattatgtagaatgtcaatcaagtttttgtatatttaaaagttggacatcaattttttcccctgatttcatcaagttatctctgccaagtgctcttgataatttcttcagatttttggaaaaaaacactatataaatgcaatccatgctttttttaaagaacaacattgccagagtatgcttgttctaacaatatagatatataaaccttaaaaataataaaatatctcacccaagacttaaaggaagaattctctgaagggataaagattactaaaaaaaaaaaaaaaaaaaaaaaattaatggggtgcctttttgttatagtttctattttctgttttgtaggacaagctgcattttctgtaaatataggtctggactaaaggatacataaagaatgcacaaaatgtcaacatcagcagagatgcccagatctatttatctctaagtatatttgaagtgattgctgtttatatgttgtcattttaaaattgtgtgtcagtaaagctacctgtaaaatttcagtccaaaaaaataaagctctcagggagacatgaataaaatcaatgaacattagaaaataaaatatagatgcttaccattaacctaccaactcttaatatccttaaattatgtgatatataaagaggactgttacttttttacttttttttttttttttttttttttttggctttgctttatttatttgtagttgggggctaacgttttctcttttctttctattgatcctgttgtggttgggtttcctgtggagagagtagtttgtcctgttgcactagaacattatttactcactaaattgagtttttcagtcaattaacaaatatttattaagttcctactatgtaccaggcatagtagggctacaatggtaagcaagacagagtccctgcccccaaagagcttatattctaatggggatattaagggatgaatagaataccaatgtgtgcactgtacaggaatcatactatttaaaaataatttgtataaactataatgcttagcacagatggcgagttatctgtgctatgtgaaagctgtgaaatagtgctctaagagttgtcaagagctgtggttttacatcttttcctcattgcaaatttagtgactttctacacactatatggaaataaatgactagcaaataaaacagtcataaatacaaagcagaggttgcactcccccaatcccgagttaacccaggtctgcaataacaccatgttaaaggtgcagatagagacttggctcaaaaaggcttggagatgaggaagattggaatataatgatggttttgtctgttccttaactaaagtgcctctatgtatattcttttctatttgtagcaggataaatttggtctggctcagttttggaactgtattttgaaaatggctttgtcttacagtttaaggaatagacaggtggagggaaagtcacataaaggagcaagtttgtgtagctgtccctcttgccccttttaatcatcctcctttgatatggccatcctggtgggcctcctttgccatttccatttttggtttctttccctgaaaactgtgtgcaggtaattccatgtgccattgttgaaaagaaaaaaaaaaaacaaaaaaaaaacctactttttagattggtgctggtgtaagtagccacttttctctcttgggtgtgtattttaaactttttttgtttttttaaattaatgccaaaaagaaaatgcataatttgtaaacttaattatatgtcttatatcttattagcttagtagttggaaccacttagtctttaggtgcaagactgttgttagatagtactgagaaaaaaaaagtatgtgttatgagactgtacatgtttttttaaaaatagcaatatgcaataaagagatgaattcattgggtgtaca

SEQ ID NO: 8553 - DNA, 6194 bp, Homo sapiens
gcttcccggggatagcgcggagcacgcagcagcgagcggagcgcgggcggcggcgccgtacctcgggctgcgggagcgcgggcgccctggggtcctcggaatcacaatgaggacctagggcatctgtctgctgacgccccctggcctgcagtgaccatggccccccgcaagaggagccaccatggcctgggcttcctgtgctgcttcgggggcagtgacatccccgaaatcaacctccgggacaaccaccctctgcagttcatggagttctccagccccatcccgaacgcagaggagctcaacatccgctttgcagagctggtggatgaattggatctcactgacaaaaaccgagaggctatgtttgcactgccccctgagaagaaatggcagatctactgcagcaagaagaaggagcaggaggaccccaacaagctggcaaccagctggcctgactattacatcgaccgcatcaattccatggctgcgatgcagagtctgtacgcgtttgatgaggaggagacggagatgaggaaccaagtcgtggaagacctgaagacagccctccggacacagcctatgaggtttgtgacccgcttcattgagctggagggcttgacctgtctgctaaatttcctccggagcatggaccacgccacctgtgagagccgcatccacacctcactcattggctgcatcaaagcattgatgaacaactcccaggggcgggcacatgtgctggcacagcctgaggccattagtaccatagcccagagcctacgcacagagaacagcaagaccaaggtggctgtgctggagatcctgggtgctgtgtgcctcgtgcctggtggccacaagaaggtgctgcaggccatgctgcactaccaggtgtatgcagcagagcgaacccgcttccagaccctgctgaacgagctagaccgaagtctgggccggtaccgggatgaagtgaatctgaaaacagccatcatgtccttcatcaatgctgtcctcaatgctggagctggagaggataatctggagttccgcctacatctacggtatgaattcctgatgctgggtatacagcctgtgattgacaagctccggcaacatgaaaatgccatcctggacaaacatttagacttcttcgagatggtgcggaatgaggatgacctggagctagccaggaggtttgacatggtccacatcgacaccaagagtgcttcccagatgtttgagttgatccacaagaagctgaagtacacggaggcctacccctgcctgctctctgtgctgcaccactgcctgcagatgccctacaaacggaacggtggctacttccagcagtggcagctcctggaccgcatcctccagcagattgtcctccaggatgagcggggtgtggaccctgacctggctcccttggagaacttcaatgtcaagaacatcgtcaacatgctcatcaacgagaatgaagtgaaacagtggcgagaccaggcagagaagttccggaaagaacacatggagcttgtgagccgtctggagaggaaggagcgggaatgcgagacaaagacattggagaaggaagagatgatgcggacgctgaacaaaatgaaggacaagctggcccgggagtcccaggagctgcgccaggctcggggacaagtggcagagctggtagcccagctcagtgaactctcaacaggccctgtatcttccccaccaccccctgggggcccactcaccttgtcttcctcaatgacaaccaatgacctgcctccaccccctcctcctctgccctttgcctgttgtccccctcccccaccaccaccccttcctcccgggggacccccgactcccccaggtgccccaccttgcctcggcatgggcctgcccctccctcaggacccctaccccagcagtgacgtcccactcaggaaaaagcgtgtcccccagccttctcacccactgaagtccttcaactgggtgaagctgaatgaggagcgtgtccctggcaccgtatggaatgagattgatgacatgcaggtatttcggatcctggacctagaggattttgaaaagatgttttcagcctaccagaggcaccagaaagagctgggctccactgaagacatctacctggcttcccgcaaggtcaaagagctgtcggtcattgatggccggagggcccaaaactgcatcatccttctttccaagttgaagctttctaacgaggagatccggcaggccatcttgaagatggatgagcaggaggaccttgctaaggacatgctggagcagctcctcaagttcatcccagagaagagtgacattgacctcctggaggagcacaagcatgaaattgagcggatggcccgtgctgaccgcttcctctatgaaatgagcaggattgaccactaccagcagcgactgcaagccctcttcttcaagaagaaattccaggagcggctggctgaggcaaagcccaaagtggaagccatcctgttggcctcccgggagctggtccgcagcaagcgtcttagacagatgctagaggtcatcctagccataggcaacttcatgaacaaagggcagcgtgggggcgcctacgggttccgggtggccagcctcaacaagatcgctgacaccaagtccagcatcgacagaaacatctctctgctccattacctgatcatgatcctggagaagcattttcctgatattctaaacatgccttcagagctgcaacatcttccagaagctgccaaagtcaacctagcagaactggagaaggaggtgggcaacctcaggaggggcctgagagcggtggaggtggagctggagtatcagaggcgccaggtacgggagcccagtgacaagtttgtccctgtcatgagcgacttcatcacggtgtccagcttcagcttctccgagctggaggaccagctaaatgaggccagggacaagttcgccaaggccttgatgcacttcggggagcatgacagcaagatgcagccagacgaattctttggcatctttgataccttcttgcaggccttctcagaggcccggcaggatctagaggccatgaggaggaggaaggaggaggaggagcggcgggcgcgcatggaagccatgctgaaggagcagagggaacgtgagcggtggcagcggcagcggaaggtcctggctgcaggcagctcgctggaggagggaggagagttcgatgacctggtgtcggccctgcgctctggggaggtcttcgacaaggacttatgcaagctcaagcgcagccgcaagcgatcagggagccaggccctggaagttacccgggagcgggcaataaaccggctaaattattgacctggggaactagccacacaggaggccgggagacagggactggtgagaatggggctgagtggaggaggtggtgatatttaaaccatttggtgcttggtttagagccttgggctgggtcctgggatggggggctgtgtgtggctggaccaggtgtctccccacgcttaccttaaggggctcctcttatctccccttcacatgattccttctgtgccctggccccaggtattattctgaggctgccttggatggcctcaggccaggtaaccccaggctgaaggggccctgctccccatcccctaccatgggcacccatgtgctggcacagaacagttccagatctagactggagaggtccacagccttgtccagagttcctgtgtagcacggggagcaatgatggagggagcccctgagagggaatctggtgagggaatccagactcccttctctcaaggggaggctcaacagaacattgacctgggggcaaactttcctcttgaatgggaacagaggaggcattatatattctagttagatcagctctggtaggttccagagaacagtcaatgttggaaggatgatgcagggaccaaagccatcaggacagagtagcagtgtctgtttcccatgtcacaagtcctctggcctctccctgcatgtcttaagtatctttcccttccttctctaccctcacctccatcctgtctactaatccacagtcctagaagactcaccttgggtttccacagctatggctcactaccaggtgcttgatgaatctggcgaggggctcaagacagacctcatgcatcaccacacctcatgccttttgggcatctcccatgtccccatctcctggacacctggccattgttgtgaagccagacagtgacctcaaatgttgccttggagtcccctacagcccctcagcagagggcagcacttgaatgcttagctccatcccatagttctctacttcatataaattgctcaggccctcccaccccttctctaacactagcttcaaggcagaagccacagcagcctctgtccagcctgcaggtggccacttggaaccatgtgtccactggcgttggggagttggttcctgagaggtctgagggccagagctgccctctacattaacatgctgtctctaagggtggcccctcctctcaggcgttcagatggtgcgaacagcagagcaggcaagggaaactggggagatggggatggaggaggaaggctgatatcctctggggagcacatcacctgaaggtgccaaggaggaaggctgagaggggggccaccccatttctggtacccaatttggttcttcagcccaacttgcaaggggttccttctggtcctcccatccactgccaccttccattttgtccatctcatgctggccttggtggatgggatggctgtatctagacaaaatttttctaaaactccatcaaggctcttattcaataccacgttccgagttggcctttcatcttctttgagactggccctgcctaacctctaccatcaatgagctcttggcccttctgcccttccctgtgtttctcactttccaacctaatccctggctcagggttattgccagtggagactggtgagctgggcctactctcagctgcctatcttctgcctttcacttgcatccaactcctggggctgggaccgtagtagctgcgggggggaagaaacacagggtcggtgagcccagcatgtgcgttggtttgagggggcgggcggtgtgtgtgtgttctggtgggagggatctgagcaagtgcaagcctggctgacacaggtgtgaagaggccatcctggaacccaggtgagggcaagatgaaggcttccaggcagaacagctgcagagagtttggctatatgcatctgcagccccaagagctcccactgcaagacaagtgttggggaagatgggaggttgtgggtgaggcctctaaaggtcctctcccaaactgaccaggctgatgtcaacctaaccccctcaggggcagggaacaggggagggctccacaagcgtgtctggcattcccacccaccatggaagactggatacgcacctggaaacaaaaggactatggaagctgttcaagatacatttgatcttcagaaaagcagaatttggttcaactgttgacagaggacacaaatacgttgttccagagctcagccttctcactctaaaagaaagatatttttctatttattttctacatctggccagtggctctggtgctagatgccactgtagccagatctccaacagtgccttggaccatggactcatactcaactgagtaagaaggggctggtgcccagtcggggtggctgagctggtccttaataggttgtttcttggtcttgctttcttcatgccctccccactgctcctgccacctttagataagtttctctagctaattttgtggccaatgtaaaattcgtcatcaacctaacaaacacaaccttctcagcagcatttctcccctgtgatggaaataaagtgtttagggcagtgggaggagaaaattctccaggtgaatggggaagggtctgttccagcctctccctactcccatcccatttccaccaactggggaactgtgactatctatctcccccgacttctaccagggatgccttcacgccaaggctgttctcaccagctgcctcagatgacaaatgaggctaatggacataatctacagtgtcctttttcacttgcaccttttttataagaatatattgtaatactaaaaaatattaaattcataccatccctaccc

SEQ ID NO: 8554 - DNA, 6220 bp, Homo sapiens
aggaaaggggtccccggactctggggctctcagcacctgcggtcgcaaaccaacctcatgccctgactttaccaggcgtcgggactctgacttaaccggggaatgagggacttggtctggcggcagatcacaatgaggacctagggcatctgtctgctgacgccccctggcctgcagtgaccatggccccccgcaagaggagccaccatggcctgggcttcctgtgctgcttcgggggcagtgacatccccgaaatcaacctccgggacaaccaccctctgcagttcatggagttctccagccccatcccgaacgcagaggagctcaacatccgctttgcagagctggtggatgaattggatctcactgacaaaaaccgagaggctatgtttgcactgccccctgagaagaaatggcagatctactgcagcaagaagaaggagcaggaggaccccaacaagctggcaaccagctggcctgactattacatcgaccgcatcaattccatggctgcgatgcagagtctgtacgcgtttgatgaggaggagacggagatgaggaaccaagtcgtggaagacctgaagacagccctccggacacagcctatgaggtttgtgacccgcttcattgagctggagggcttgacctgtctgctaaatttcctccggagcatggaccacgccacctgtgagagccgcatccacacctcactcattggctgcatcaaagcattgatgaacaactcccaggggcgggcacatgtgctggcacagcctgaggccattagtaccatagcccagagcctacgcacagagaacagcaagaccaaggtggctgtgctggagatcctgggtgctgtgtgcctcgtgcctggtggccacaagaaggtgctgcaggccatgctgcactaccaggtgtatgcagcagagcgaacccgcttccagaccctgctgaacgagctagaccgaagtctgggccggtaccgggatgaagtgaatctgaaaacagccatcatgtccttcatcaatgctgtcctcaatgctggagctggagaggataatctggagttccgcctacatctacggtatgaattcctgatgctgggtatacagcctgtgattgacaagctccggcaacatgaaaatgccatcctggacaaacatttagacttcttcgagatggtgcggaatgaggatgacctggagctagccaggaggtttgacatggtccacatcgacaccaagagtgcttcccagatgtttgagttgatccacaagaagctgaagtacacggaggcctacccctgcctgctctctgtgctgcaccactgcctgcagatgccctacaaacggaacggtggctacttccagcagtggcagctcctggaccgcatcctccagcagattgtcctccaggatgagcggggtgtggaccctgacctggctcccttggagaacttcaatgtcaagaacatcgtcaacatgctcatcaacgagaatgaagtgaaacagtggcgagaccaggcagagaagttccggaaagaacacatggagcttgtgagccgtctggagaggaaggagcgggaatgcgagacaaagacattggagaaggaagagatgatgcggacgctgaacaaaatgaaggacaagctggcccgggagtcccaggagctgcgccaggctcggggacaagtggcagagctggtagcccagctcagtgaactctcaacaggccctgtatcttccccaccaccccctgggggcccactcaccttgtcttcctcaatgacaaccaatgacctgcctccaccccctcctcctctgccctttgcctgttgtccccctcccccaccaccaccccttcctcccgggggacccccgactcccccaggtgccccaccttgcctcggcatgggcctgcccctccctcaggacccctaccccagcagtgacgtcccactcaggaaaaagcgtgtcccccagccttctcacccactgaagtccttcaactgggtgaagctgaatgaggagcgtgtccctggcaccgtatggaatgagattgatgacatgcaggtatttcggatcctggacctagaggattttgaaaagatgttttcagcctaccagaggcaccagaaagagctgggctccactgaagacatctacctggcttcccgcaaggtcaaagagctgtcggtcattgatggccggagggcccaaaactgcatcatccttctttccaagttgaagctttctaacgaggagatccggcaggccatcttgaagatggatgagcaggaggaccttgctaaggacatgctggagcagctcctcaagttcatcccagagaagagtgacattgacctcctggaggagcacaagcatgaaattgagcggatggcccgtgctgaccgcttcctctatgaaatgagcaggattgaccactaccagcagcgactgcaagccctcttcttcaagaagaaattccaggagcggctggctgaggcaaagcccaaagtggaagccatcctgttggcctcccgggagctggtccgcagcaagcgtcttagacagatgctagaggtcatcctagccataggcaacttcatgaacaaagggcagcgtgggggcgcctacgggttccgggtggccagcctcaacaagatcgctgacaccaagtccagcatcgacagaaacatctctctgctccattacctgatcatgatcctggagaagcattttcctgatattctaaacatgccttcagagctgcaacatcttccagaagctgccaaagtcaacctagcagaactggagaaggaggtgggcaacctcaggaggggcctgagagcggtggaggtggagctggagtatcagaggcgccaggtacgggagcccagtgacaagtttgtccctgtcatgagcgacttcatcacggtgtccagcttcagcttctccgagctggaggaccagctaaatgaggccagggacaagttcgccaaggccttgatgcacttcggggagcatgacagcaagatgcagccagacgaattctttggcatctttgataccttcttgcaggccttctcagaggcccggcaggatctagaggccatgaggaggaggaaggaggaggaggagcggcgggcgcgcatggaagccatgctgaaggagcagagggaacgtgagcggtggcagcggcagcggaaggtcctggctgcaggcagctcgctggaggagggaggagagttcgatgacctggtgtcggccctgcgctctggggaggtcttcgacaaggacttatgcaagctcaagcgcagccgcaagcgatcagggagccaggccctggaagttacccgggagcgggcaataaaccggctaaattattgacctggggaactagccacacaggaggccgggagacagggactggtgagaatggggctgagtggaggaggtggtgatatttaaaccatttggtgcttggtttagagccttgggctgggtcctgggatggggggctgtgtgtggctggaccaggtgtctccccacgcttaccttaaggggctcctcttatctccccttcacatgattccttctgtgccctggccccaggtattattctgaggctgccttggatggcctcaggccaggtaaccccaggctgaaggggccctgctccccatcccctaccatgggcacccatgtgctggcacagaacagttccagatctagactggagaggtccacagccttgtccagagttcctgtgtagcacggggagcaatgatggagggagcccctgagagggaatctggtgagggaatccagactcccttctctcaaggggaggctcaacagaacattgacctgggggcaaactttcctcttgaatgggaacagaggaggcattatatattctagttagatcagctctggtaggttccagagaacagtcaatgttggaaggatgatgcagggaccaaagccatcaggacagagtagcagtgtctgtttcccatgtcacaagtcctctggcctctccctgcatgtcttaagtatctttcccttccttctctaccctcacctccatcctgtctactaatccacagtcctagaagactcaccttgggtttccacagctatggctcactaccaggtgcttgatgaatctggcgaggggctcaagacagacctcatgcatcaccacacctcatgccttttgggcatctcccatgtccccatctcctggacacctggccattgttgtgaagccagacagtgacctcaaatgttgccttggagtcccctacagcccctcagcagagggcagcacttgaatgcttagctccatcccatagttctctacttcatataaattgctcaggccctcccaccccttctctaacactagcttcaaggcagaagccacagcagcctctgtccagcctgcaggtggccacttggaaccatgtgtccactggcgttggggagttggttcctgagaggtctgagggccagagctgccctctacattaacatgctgtctctaagggtggcccctcctctcaggcgttcagatggtgcgaacagcagagcaggcaagggaaactggggagatggggatggaggaggaaggctgatatcctctggggagcacatcacctgaaggtgccaaggaggaaggctgagaggggggccaccccatttctggtacccaatttggttcttcagcccaacttgcaaggggttccttctggtcctcccatccactgccaccttccattttgtccatctcatgctggccttggtggatgggatggctgtatctagacaaaatttttctaaaactccatcaaggctcttattcaataccacgttccgagttggcctttcatcttctttgagactggccctgcctaacctctaccatcaatgagctcttggcccttctgcccttccctgtgtttctcactttccaacctaatccctggctcagggttattgccagtggagactggtgagctgggcctactctcagctgcctatcttctgcctttcacttgcatccaactcctggggctgggaccgtagtagctgcgggggggaagaaacacagggtcggtgagcccagcatgtgcgttggtttgagggggcgggcggtgtgtgtgtgttctggtgggagggatctgagcaagtgcaagcctggctgacacaggtgtgaagaggccatcctggaacccaggtgagggcaagatgaaggcttccaggcagaacagctgcagagagtttggctatatgcatctgcagccccaagagctcccactgcaagacaagtgttggggaagatgggaggttgtgggtgaggcctctaaaggtcctctcccaaactgaccaggctgatgtcaacctaaccccctcaggggcagggaacaggggagggctccacaagcgtgtctggcattcccacccaccatggaagactggatacgcacctggaaacaaaaggactatggaagctgttcaagatacatttgatcttcagaaaagcagaatttggttcaactgttgacagaggacacaaatacgttgttccagagctcagccttctcactctaaaagaaagatatttttctatttattttctacatctggccagtggctctggtgctagatgccactgtagccagatctccaacagtgccttggaccatggactcatactcaactgagtaagaaggggctggtgcccagtcggggtggctgagctggtccttaataggttgtttcttggtcttgctttcttcatgccctccccactgctcctgccacctttagataagtttctctagctaattttgtggccaatgtaaaattcgtcatcaacctaacaaacacaaccttctcagcagcatttctcccctgtgatggaaataaagtgtttagggcagtgggaggagaaaattctccaggtgaatggggaagggtctgttccagcctctccctactcccatcccatttccaccaactggggaactgtgactatctatctcccccgacttctaccagggatgccttcacgccaaggctgttctcaccagctgcctcagatgacaaatgaggctaatggacataatctacagtgtcctttttcacttgcaccttttttataagaatatattgtaatactaaaaaatattaaattcataccatccctaccc

SEQ ID NO: 8555 - DNA, 829 bp, Homo sapiens
ctcgggtctcagcgatgccccctgtgtctcccacccctaggcctgcacagaggggactcagaggccgagataatttacttttgctttctttgccttttccagagcatagggggaaaccgtaatttaggcggctgctaagaatagctcccccaatcctggaaagagcgtgtgcttatttttgaaagtgctccttgtctctcccccagccctgcctgaggctcacagtacaagtcagtcaaattgttcagggcagcagtggtgtctggagacctggtttgagttcctaggttcatacctagcgtccttctgagcctcaagtttcttcgtctgtaaaaagagaagatgaaagtttgagataaacctcgaacatgatcacaatgaggacctagggcatctgtctgctgacgccccctggcctgcagtgaccatggccccccgcaagaggagccaccatggcctgggcttcctgtgctgcttcgggggcagtgacatccccgaaatcaacctccgggacaaccaccctctgcagttcatggagttctccagccccatcccgaacgcagaggagctcaacatccgctttgcagagctggtggatgaattggatctcactgacaaaaaccgagaggctatgtttgcactgccccctgagaagaaatggcagatctactgcagcaagaagaaggtgccctctctgacccctctggccacatctcagggttcatggcatggggtggctcttgctgccttggcatgctcatgcattcacctgatgtttattacatgccagccctgttctaggtgttggaggaacaacagtgaataaaat

SEQ ID NO: 8556 - DNA, 6221 bp, Homo sapiens
aggaaaggggtccccggactctggggctctcagcacctgcggtcgcaaaccaacctcatgccctgactttaccaggcgtcgggactctgacttaaccggggaatgagggacttggtctggcggcagatcacaatgaggacctagggcatctgtctgctgacgccccctggcctgcagtgaccatggccccccgcaagaggagccaccatggcctgggcttcctgtgctgcttcgggggcagtgacatccccgaaatcaacctccgggacaaccaccctctgcagttcatggagttctccagccccatcccgaacgcagaggagctcaacatccgctttgcagagctggtggatgaattggatctcactgacaaaaaccgagaggctatgtttgcactgccccctgagaagaaatggcagatctactgcagcaagaagaaggagcaggaggaccccaacaagctggcaaccagctggcctgactattacatcgaccgcatcaattccatggctgcgatgcagagtctgtacgcgtttgatgaggaggagacggagatgaggaaccaagtcgtggaagacctgaagacagccctccggacacagcctatgaggtttgtgacccgcttcattgagctggagggcttgacctgtctgctaaatttcctccggagcatggaccacgccacctgtgagagccgcatccacacctcactcattggctgcatcaaagcattgatgaacaactcccaggggcgggcacatgtgctggcacagcctgaggccattagtaccatagcccagagcctacgcacagagaacagcaagaccaaggtggctgtgctggagatcctgggtgctgtgtgcctcgtgcctggtggccacaagaaggtgctgcaggccatgctgcactaccaggtgtatgcagcagagcgaacccgcttccagaccctgctgaacgagctagaccgaagtctgggccggtaccgggatgaagtgaatctgaaaacagccatcatgtccttcatcaatgctgtcctcaatgctggagctggagaggataatctggagttccgcctacatctacggtatgaattcctgatgctgggtatacagcctgtgattgacaagctccggcaacatgaaaatgccatcctggacaaacatttagacttcttcgagatggtgcggaatgaggatgacctggagctagccaggaggtttgacatggtccacatcgacaccaagagtgcttcccagatgtttgagttgatccacaagaagctgaagtacacggaggcctacccctgcctgctctctgtgctgcaccactgcctgcagatgccctacaaacggaacggtggctacttccagcagtggcagctcctggaccgcatcctccagcagattgtcctccaggatgagcggggtgtggaccctgacctggctcccttggagaacttcaatgtcaagaacatcgtcaacatgctcatcaacgagaatgaagtgaaacagtggcgagaccaggcagagaagttccggaaagaacacatggagcttgtgagccgtctggagaggaaggagcgggaatgcgagacaaagacattggagaaggaagagatgatgcggacgctgaacaaaatgaaggacaagctggcccgggagtcccaggagctgcgccaggctcggggacaagtggcagagctggtagcccagctcagtgaactctcaacaggccctgtatcttccccaccaccccctgggggcccactcaccttgtcttcctcaatgacaaccaatgacctgcctccaccccctcctcctctgccctttgcctgttgtccccctcccccaccaccaccccttcctcccgggggacccccgactcccccaggtgccccaccttgcctcggcatgggcctgcccctccctcaggacccctaccccagcagtgacgtcccactcaggaaaaagcgtgtcccccagccttctcacccactgaagtccttcaactgggtgaagctgaatgaggagcgtgtccctggcaccgtatggaatgagattgatgacatgcaggtatttcggatcctggacctagaggattttgaaaagatgttttcagcctaccagaggcaccagaaagagctgggctccactgaagacatctacctggcttcccgcaaggtcaaagagctgtcggtcattgatggccggagggcccaaaactgcatcatccttctttccaagttgaagctttctaacgaggagatccggcaggccatcttgaagatggatgagcaggaggaccttgctaaggacatgctggagcagctcctcaagttcatcccagagaagagtgacattgacctcctggaggagcacaagcatgaaattgagcggatggcccgtgctgaccgcttcctctatgaaatgagcaggattgaccactaccagcagcgactgcaagccctcttcttcaagaagaaattccaggagcggctggctgaggcaaagcccaaagtggaagccatcctgttggcctcccgggagctggtccgcagcaagcgtcttagacagatgctagaggtcatcctagccataggcaacttcatgaacaaagggcagcgtgggggcgcctacgggttccgggtggccagcctcaacaagatcgctgacaccaagtccagcatcgacagaaacatctctctgctccattacctgatcatgatcctggagaagcattttcctgatattctaaacatgccttcagagctgcaacatcttccagaagctgccaaagtcaacctagcagaactggagaaggaggtgggcaacctcaggaggggcctgagagcggtggaggtgctggagtatcagaggcgccaggtacgggagcccagtgacaagtttgtccctgtcatgagcgacttcatcacggtgtccagcttcagcttctccgagctggaggaccagctaaatgaggccagggacaagttcgccaaggccttgatgcacttcggggagcatgacagcaagatgcagccagacgaattctttggcatctttgataccttcttgcaggccttctcagaggcccggcaggatctagaggccatgaggaggaggaaggaggaggaggagcggcgggcgcgcatggaagccatgctgaaggagcagagggaacgtgagcggtggcagcggcagcggaaggtcctggctgcaggcagctcgctggaggagggaggagagttcgatgacctggtgtcggccctgcgctctggggaggtcttcgacaaggacttatgcaagctcaagcgcagccgcaagcgatcagggagccaggccctggaagttacccgggagcgggcaataaaccggctaaattattgacctggggaactagccacacaggaggccgggagacagggactggtgagaatggggctgagtggaggaggtggtgatatttaaaccatttggtgcttggtttagagccttgggctgggtcctgggatggggggctgtgtgtggctggaccaggtgtctccccacgcttaccttaaggggctcctcttatctccccttcacatgattccttctgtgccctggccccaggtattattctgaggctgccttggatggcctcaggccaggtaaccccaggctgaaggggccctgctccccatcccctaccatgggcacccatgtgctggcacagaacagttccagatctagactggagaggtccacagccttgtccagagttcctgtgtagcacggggagcaatgatggagggagcccctgagagggaatctggtgagggaatccagactcccttctctcaaggggaggctcaacagaacattgacctgggggcaaactttcctcttgaatgggaacagaggaggcattatatattctagttagatcagctctggtaggttccagagaacagtcaatgttggaaggatgatgcagggaccaaagccatcaggacagagtagcagtgtctgtttcccatgtcacaagtcctctggcctctccctgcatgtcttaagtatctttcccttccttctctaccctcacctccatcctgtctactaatccacagtcctagaagactcaccttgggtttccacagctatggctcactaccaggtgcttgatgaatctggcgaggggctcaagacagacctcatgcatcaccacacctcatgccttttgggcatctcccatgtccccatctcctggacacctggccattgttgtgaagccagacagtgacctcaaatgttgccttggagtcccctacagcccctcagcagagggcagcacttgaatgcttagctccatcccatagttctctacttcatataaattgctcaggccctcccaccccttctctaacactagcttcaaggcagaagccacagcagcctctgtccagcctgcaggtggccacttggaaccatgtgtccactggcgttggggagttggttcctgagaggtctgagggccagagctgccctctacattaacatgctgtctctaagggtggcccctcctctcaggcgttcagatggtgcgaacagcagagcaggcaagggaaactggggagatggggatggaggaggaaggctgatatcctctggggagcacatcacctgaaggtgccaaggaggaaggctgagaggggggccaccccatttctggtacccaatttggttcttcagcccaacttgcaaggggttccttctggtcctcccatccactgccaccttccattttgtccatctcatgctggccttggtggatgggatggctgtatctagacaaaatttttctaaaactccatcaaggctcttattcaataccacgttccgagttggcctttcatcttctttgagactggccctgcctaacctctaccatcaatgagctcttggcccttctgcccttccctgtgtttctcactttccaacctaatccctggctcagggttattgccagtggagactggtgagctgggcctactctcagctgcctatcttctgcctttcacttgcatccaactcctggggctgggaccgtagtagctgcgggggggaagaaacacagggtcggtgagcccagcatgtgcgttggtttgagggggcgggcggtgtgtgtgtgttctggtgggagggatctgagcaagtgcaagcctggctgacacaggtgtgaagaggccatcctggaacccaggtgagggcaagatgaaggcttccaggcagaacagctgcagagagtttggctatatgcatctgcagccccaagagctcccactgcaagacaagtgttggggaagatgggaggttgtgggtgaggcctctaaaggtcctctcccaaactgaccaggctgatgtcaacctaaccccctcaggggcagggaacaggggagggctccacaagcgtgtctggcattcccacccaccatggaagactggatacgcacctggaaacaaaaggactatggaagctgttcaagatacatttgatcttcagaaaagcagaatttggttcaactgttgacagaggacacaaatacgttgttccagagctcagccttctcactctaaaagaaagatatttttctatttattttctacatctggccagtggctctggtgctagatgccactgtagccagatctccaacagtgccttggaccatggactcatactcaactgagtaagaaggggctggtgcccagtcggggtggctgagctggtccttaataggttgtttcttggtcttgctttcttcatgccctccccactgctcctgccacctttagataagtttctctagctaattttgtggccaatgtaaaattcgtcatcaacctaacaaacacaaccttctcagcagcatttctcccctgtgatggaaataaagtgtttagggcagtgggaggagaaaattctccaggtgaatggggaagggtctgttccagcctctccctactcccatcccatttccaccaactggggaactgtgactatctatctcccccgacttctaccagggatgccttcacgccaaggctgttctcaccagctgcctcagatgacaaatgaggctaatggacataatctacagtgtcctttttcacttgcaccttttttataagaatatattgtaatactaaaaaatattaaattcataccatccctacccagtc

SEQ ID NO: 8557 - DNA, 2141 bp, Homo sapiens
aacggcgcggcccgaggggcgcaggcgggagggcggcggggctgtggccgctgacggccgcatcgagcccggcgacatgttgctgcaggtgaatgacgtgaactttgagaacatgagcaatgacgatgccgtgcgggtgctgcgggagatcgtttcccagacggggtgagggctgggggcgctggagcgggaggggccaggcagggaggtgggaccatgggggccttgctgtgtgaccaccgttcctgcaggcccatcagcctcactgtggccaagtgctgggacccaacgccccgaagctacttcaccgtcccacgggctgacccggtgcggcccatcgaccccgccgcctggctgtcccacacggcggcactgacaggagccctgccccgctacgagctggaagaggcgccgctgacggtgaagagtgacatgagcgccgtcgtccgggtcatgcagctgccagactcgggactggagatccgcgaccgcatgtggctcaagatcaccatcgccaatgccgtcatcggggcggacgtggtggactggctgtacacacacgtggagggcttcaaggagcggcgggaggcccggaagtacgccagcagcttgctgaagcacggcttcctgcggcacacggtcaacaagatcaccttctccgagcagtgctactacgtcttcggggatctctgcagcaatctcgccaccctgaacctcaacagtggctccagtgggacttcggatcaggacacgctggccccgctgccccacccggctgccccctggcctctgggtcagggctacccctaccagtacccgggacccccaccctgcttcccgcctgcctaccaggacccgggctttagctatggcagcggcagcaccgggagtcagcagagtgaagggagcaaaagcagtgggtccacccggagcagccgccgggccccgggccgtgagaaggagcgtcgggcggcgggagctgggggcagtggcagtgaatcggatcacacggcaccgagtggggtggggagcagctggcgagagcgtccggccggccagctcagccgtggcagcagcccacgcagtcaggcctcggctaccgccccggggctccccccgccccaccccacgaccaaggcctatacagtggtgggggggccacccgggggaccccctgtccgggagctggctgccgtccccccggaattgacaggcagccgccagtccttccagaaggctatggggaacccctgcgagttcttcgtggacatcatgtgactcgtggcgcatgccccagccctgcctgaggtggggagctggcggtcctgccgcatgcagagctcgcgtgggcttgccttcgtgggggccaggacgggaggcagggtggggggcaggctggaccaccaccatctgccctggcagcctggctgctccagctcctgacagcacctgtgtctgagcagccgtgttgggggcgctccctctctgcccctcagcgagagcctcggacctcccaaccccttgtgtctggtggggatccctcctgggatgaggaagaccccctcgggctctcggctgacccccacctcctgcacagctgtgcccaggcccccagggtggtccatgcggggcaaccccctgcggtgcacaggccccctgtctggagtagggatctaatttatttatttattgcctggccggtgactcgggggaggaggcgaccctgtcatctgtcccacctgctgctgccccttggagcagcctgcaccttctctcctcccatccggcaacagtctgaaagtacgtggaggacgggaccggaagacgagagagggctggacatcctgcccaccgtgtcccagccagggcagggagggaccatggcccgcagggtcaaggggccccgatgtgcacagctgccacagggagggaggtcttggggagatgggcagtcaggtggcccgtccttggtgagtgcacacactgcgcgcacacatcgcggccttcctggcttctctggcccccacgtgtctgtgctgtagatactgtatcaaagtcccagcgtttagatggttaacatagagctgcttctgtgtaaatgctgcttattttaaacactaaaaagcgtttaattttatggg

SEQ ID NO: 8558 - DNA, 2268 bp, Homo sapiens
gcgggtagcgccccgcgtccgagccccgggccgggccctgagcgcgcgggctccgcgccgccgccgcgccatggcggagaccaagattatctaccacatggacgaggaggagacgccgtacctggtcaagctgcccgtggcccccgagcgcgtcacgctggccgacttcaagaacgtgctcagcaaccggcccgtgcacgcctacaaattcttctttaagtccatggaccaggacttcggggtggtgaaggaggagatctttgatgacaatgccaagcttccctgcttcaacggccgcgtggtctcctggctggtcctggctgagggtgctcactcggatgcggggtcccagggcacggacagccacacagacctgcccccgcctcttgagcggacaggcggcatcggggactcccggcccccctccttccacccaaatgtggccagcagccgtgacgggatggacaacgagacaggcacggagtccatggtcagtcaccggcgggagcgtgcccgacgccggaaccgcgaggaggccgcccggaccaatgggcacccaaggggagaccgacggcgggatgtggggctgcccccagacagcgcgtccaccgccctcagcagcgagcttgagtccagcagctttgtggactcggacgaggatggcagcacgagcaggctcagcagctccacggagcagagcacctcatccagactcatccggaagtacgccagcagcttgctgaagcacggcttcctgcggcacacggtcaacaagatcaccttctccgagcagtgctactacgtcttcggggatctctgcagcaatctcgccaccctgaacctcaacagtggctccagtgggacttcggatcaggacacgctggccccgctgccccacccggctgccccctggcctctgggtcagggctacccctaccagtacccgggacccccaccctgcttcccgcctgcctaccaggacccgggctttagctatggcagcggcagcaccgggagtcagcagagtgaagggagcaaaagcagtgggtccacccggagcagccgccgggccccgggccgtgagaaggagcgtcgggcggcgggagctgggggcagtggcagtgaatcggatcacacggcaccgagtggggtggggagcagctggcgagagcgtccggccggccagctcagccgtggcagcagcccacgcagtcaggcctcggctaccgccccggggctccccccgccccaccccacgaccaaggcctatacagtggtgggggggccacccgggggaccccctgtccgggagctggctgccgtccccccggaattgacaggcagccgccagtccttccagaaggctatggggaacccctgcgagttcttcgtggacatcatgtgactcgtggcgcatgccccagccctgcctgaggtggggagctggcggtcctgccgcatgcagagctcgcgtgggcttgccttcgtgggggccaggacgggaggcagggtggggggcaggctggaccaccaccatctgccctggcagcctggctgctccagctcctgacagcacctgtgtctgagcagccgtgttgggggcgctccctctctgcccctcagcgagagcctcggacctcccaaccccttgtgtctggtggggatccctcctgggatgaggaagaccccctcgggctctcggctgacccccacctcctgcacagctgtgcccaggcccccagggtggtccatgcggggcaaccccctgcggtgcacaggccccctgtctggagtagggatctaatttatttatttattgcctggccggtgactcgggggaggaggcgaccctgtcatctgtcccacctgctgctgccccttggagcagcctgcaccttctctcctcccatccggcaacagtctgaaagtacgtggaggacgggaccggaagacgagagagggctggacatcctgcccaccgtgtcccagccagggcagggagggaccatggcccgcagggtcaaggggccccgatgtgcacagctgccacagggagggaggtcttggggagatgggcagtcaggtggcccgtccttggtgagtgcacacactgcgcgcacacatcgcggccttcctggcttctctggcccccacgtgtctgtgctgtagatactgtatcaaagtcccagcgtttagatggttaacatagagctgcttctgtgtaaatgctgcttattttaaacactaaaaagcgtttaattttatggg

SEQ ID NO: 8559 - DNA, 3239 bp, Homo sapiens
gggcggcggggctgagcgcgccctccgtgctgcgtccctcgcgccgctcccgggccgggggcggatgggcggccgcgggccgcggggcagcagtcgggacgcgcgcgggagccgggggcggcggccggggcctgggcggtcgggcgggggcgcccgggggcctcggagcgtcggggccgagagcggtgcgggccgggcggggcgcaggcgggcgggcgggtagcgccccgcgtccgagccccgggccgggccctgagcgcgcgggctccgcgccgccgccgcgccatggcggagaccaagattatctaccacatggacgaggaggagacgccgtacctggtcaagctgcccgtggcccccgagcgcgtcacgctggccgacttcaagaacgtgctcagcaaccggcccgtgcacgcctacaaattcttctttaagtccatggaccaggacttcggggtggtgaaggaggagatctttgatgacaatgccaagcttccctgcttcaacggccgcgtggtctcctggctggtcctggctgagggtgctcactcggatgcggggtcccagggcacggacagccacacagacctgcccccgcctcttgagcggacaggcggcatcggggactcccggcccccctccttccacccaaatgtggccagcagccgtgacgggatggacaacgagacaggcacggagtccatggtcagtcaccggcgggagcgtgcccgacgccggaaccgcgaggaggccgcccggaccaatgggcacccaaggggagaccgacggcgggatgtggggctgcccccagacagcgcgtccaccgccctcagcagcgagcttgagtccagcagctttgtggactcggacgaggatggcagcacgagcaggctcagcagctccacggagcagagcacctcatccagactcatccggaagcacaaacgccggcggaggaagcagcgccttcggcaggcggaccgggcctcctccttcagcagcataaccgactccaccatgtccctcaacatcgtcactgtcacgctcaacatggaaagacatcactttctgggcatcagcatcgtggggcagagcaacgaccgtggagacggcggcatctacattggctccatcatgaagggcggggctgtggccgctgacggccgcatcgagcccggcgacatgttgctgcaggtgaatgacgtgaactttgagaacatgagcaatgacgatgccgtgcgggtgctgcgggagatcgtttcccagacggggcccatcagcctcactgtggccaagtgctgggacccaacgccccgaagctacttcaccgtcccacgggctgacccggtgcggcccatcgaccccgccgcctggctgtcccacacggcggcactgacaggagccctgccccgctacggtacgagtccctgctccagcgccgtcacgcgcaccagctcctcctcactaaccagctccgtgcctggtgctccacagctggaagaggcgccgctgacggtgaagagtgacatgagcgccgtcgtccgggtcatgcagctgccagactcgggactggagatccgcgaccgcatgtggctcaagatcaccatcgccaatgccgtcatcggggcggacgtggtggactggctgtacacacacgtggagggcttcaaggagcggcgggaggcccggaagtacgccagcagcttgctgaagcacggcttcctgcggcacacggtcaacaagatcaccttctccgagcagtgctactacgtcttcggggatctctgcagcaatctcgccaccctgaacctcaacagtggctccagtgggacttcggatcaggacacgctggccccgctgccccacccggctgccccctggcctctgggtcagggctacccctaccagtacccgggacccccaccctgcttcccgcctgcctaccaggacccgggctttagctatggcagcggcagcaccgggagtcagcagagtgaagggagcaaaagcagtgggtccacccggagcagccgccgggccccgggccgtgagaaggagcgtcgggcggcgggagctgggggcagtggcagtgaatcggatcacacggcaccgagtggggtggggagcagctggcgagagcgtccggccggccagctcagccgtggcagcagcccacgcagtcaggcctcggctaccgccccggggctccccccgccccaccccacgaccaaggcctatacagtggtgggggggccacccgggggaccccctgtccgggagctggctgccgtccccccggaattgacaggcagccgccagtccttccagaaggctatggggaacccctgcgagttcttcgtggacatcatgtgactcgtggcgcatgccccagccctgcctgaggtggggagctggcggtcctgccgcatgcagagctcgcgtgggcttgccttcgtgggggccaggacgggaggcagggtggggggcaggctggaccaccaccatctgccctggcagcctggctgctccagctcctgacagcacctgtgtctgagcagccgtgttgggggcgctccctctctgcccctcagcgagagcctcggacctcccaaccccttgtgtctggtggggatccctcctgggatgaggaagaccccctcgggctctcggctgacccccacctcctgcacagctgtgcccaggcccccagggtggtccatgcggggcaaccccctgcggtgcacaggccccctgtctggagtagggatctaatttatttatttattgcctggccggtgactcgggggaggaggcgaccctgtcatctgtcccacctgctgctgccccttggagcagcctgcaccttctctcctcccatccggcaacagtctgaaagtacgtggaggacgggaccggaagacgagagagggctggacatcctgcccaccgtgtcccagccagggcagggagggaccatggcccgcagggtcaaggggccccgatgtgcacagctgccacagggagggaggtcttggggagatgggcagtcaggtggcccgtccttggtgagtgcacacactgcgcgcacacatcgcggccttcctggcttctctggcccccacgtgtctgtgctgtagatactgtatcaaagtcccagcgtttagatggttaacatagagctgcttctgtgtaaatgctgcttattttaaacactaaaaagcgtttaattttatgggaca

SEQ ID NO: 8560 - DNA, 2926 bp, Homo sapiens
ccccgggccgggccctgagcgcgcgggctccgcgccgccgccgcgccatggcggagaccaagattatctaccacatggacgaggaggagacgccgtacctggtcaagctgcccgtggcccccgagcgcgtcacgctggccgacttcaagaacgtgctcagcaaccggcccgtgcacgcctacaaattcttctttaagtccatggaccaggacttcggggtggtgaaggaggagatctttgatgacaatgccaagcttccctgcttcaacggccgcgtggtctcctggctggtcctggctgagggtgctcactcggatgcggggtcccagggcacggacagccacacagacctgcccccgcctcttgagcggacaggcggcatcggggactcccggcccccctccttccacccaaatgtggccagcagccgtgacgggatggacaacgagacaggcacggagtccatggtcagtcaccggcgggagcgtgcccgacgccggaaccgcgaggaggccgcccggaccaatgggcacccaaggggagaccgacggcgggatgtggggctgcccccagacagcgcgtccaccgccctcagcagcgagcttgagtccagcagctttgtggactcggacgaggatggcagcacgagcaggctcagcagctccacggagcagagcacctcatccagactcatccggaagcacaaacgccggcggaggaagcagcgccttcggcaggcggaccgggcctcctccttcagcagcataaccgactccaccatgtccctcaacatcgtcactgtcacgctcaacatggaaagacatcactttctgggcatcagcatcgtggggcagagcaacgaccgtggagacggcggcatctacattggctccatcatgaagggcggggctgtggccgctgacggccgcatcgagcccggcgacatgttgctgcaggtgaatgacgtgaactttgagaacatgagcaatgacgatgccgtgcgggtgctgcgggagatcgtttcccagacggggcccatcagcctcactgtggccaagtgctgggacccaacgccccgaagctacttcaccgtcccacgggctgacccggtgcggcccatcgaccccgccgcctggctgtcccacacggcggcactgacaggagccctgccccgctacgagctggaagaggcgccgctgacggtgaagagtgacatgagcgccgtcgtccgggtcatgcagctgccagactcgggactggagatccgcgaccgcatgtggctcaagatcaccatcgccaatgccgtcatcggggcggacgtggtggactggctgtacacacacgtggagggcttcaaggagcggcgggaggcccggaagtacgccagcagcttgctgaagcacggcttcctgcggcacacggtcaacaagatcaccttctccgagcagtgctactacgtcttcggggatctctgcagcaatctcgccaccctgaacctcaacagtggctccagtgggacttcggatcaggacacgctggccccgctgccccacccggctgccccctggcctctgggtcagggctacccctaccagtacccgggacccccaccctgcttcccgcctgcctaccaggacccgggctttagctatggcagcggcagcaccgggagtcagcagagtgaagggagcaaaagcagtgggtccacccggagcagccgccgggccccgggccgtgagaaggagcgtcgggcggcgggagctgggggcagtggcagtgaatcggatcacacggcaccgagtggggtggggagcagctggcgagagcgtccggccggccagctcagccgtggcagcagcccacgcagtcaggcctcggctaccgccccggggctccccccgccccaccccacgaccaaggcctatacagtggtgggggggccacccgggggaccccctgtccgggagctggctgccgtccccccggaattgacaggcagccgccagtccttccagaaggctatggggaacccctgcgagttcttcgtggacatcatgtgactcgtggcgcatgccccagccctgcctgaggtggggagctggcggtcctgccgcatgcagagctcgcgtgggcttgccttcgtgggggccaggacgggaggcagggtggggggcaggctggaccaccaccatctgccctggcagcctggctgctccagctcctgacagcacctgtgtctgagcagccgtgttgggggcgctccctctctgcccctcagcgagagcctcggacctcccaaccccttgtgtctggtggggatccctcctgggatgaggaagaccccctcgggctctcggctgacccccacctcctgcacagctgtgcccaggcccccagggtggtccatgcggggcaaccccctgcggtgcacaggccccctgtctggagtagggatctaatttatttatttattgcctggccggtgactcgggggaggaggcgaccctgtcatctgtcccacctgctgctgccccttggagcagcctgcaccttctctcctcccatccggcaacagtctgaaagtacgtggaggacgggaccggaagacgagagagggctggacatcctgcccaccgtgtcccagccagggcagggagggaccatggcccgcagggtcaaggggccccgatgtgcacagctgccacagggagggaggtcttggggagatgggcagtcaggtggcccgtccttggtgagtgcacacactgcgcgcacacatcgcggccttcctggcttctctggcccccacgtgtctgtgctgtagatactgtatcaaagtcccagcgtttagatggttaacatagagctgcttctgtgtaaatgctgcttattttaaacactaaaaagcgtttaattttatgggaca

SEQ ID NO: 8561 - DNA, 5254 bp, Homo sapiens
gccgcggccaccggaagagtcgcggtcgccagtccagtcgggagagtggggagcggaagcggcggccgcggcggcggcgggcggcgctgggacccggtagcggccggagaacaagggagctggcgccgccagcagccgccgagctgggttgagccgctgggccgcgccgcgcgccgccgccgtctgggaggctcggcccggccgcccgagcaggccgcgcgcgggccgccgggcccgaggccagagccatgggcgagaccaagatcatctaccacttggatgggcaggagacgccgtaccttgtgaagctgcccctgcccgccgagcgcgtcaccttggcggactttaagggcgttttgcagcgacccagctataagttcttcttcaagtctatggacgacgatttcggagtggtgaaggaggagatctcggatgacaatgccaagctaccatgcttcaatggccgggtggtgtcctggctggtgtcagctgagggctcacacccagacccagcccccttctgtgctgataacccatcggagctgccaccacctatggagcgcacgggaggcatcggggactcccgacccccatccttccaccctcatgctggtgggggcagccaggagaacctggacaatgacacagagacggactctttggtgtctgcccagcgagagcggccacgccggagggatggcccagagcatgcaacccggctaaatggaactgcgaagggggaacggcggcgagaaccagggggttatgatagctcatccacccttatgagcagtgagctggagaccaccagcttctttgactcagatgaggatgactccaccagcaggttcagcagctccacagaacagagcagtgcctcacgcctgatgagaagacacaagcggcggcggcggaagcagaaggtttctcggattgagcggtcctcgtccttcagcagcatcacggactccaccatgtcactcaacatcatcacggtcactctcaacatggaaaaatataacttcttgggcatctccattgtgggccaaagcaacgagcgtggtgacggcggcatctacattggctctatcatgaagggtggggccgtggctgctgatggacgcatcgagccaggagatatgttgttacaggtaaacgagatcaactttgagaacatgagtaatgacgatgcagtccgggtactgcgggagattgtgcacaaaccggggcccatcaccctgactgtagccaagtgctgggacccaagtccacgtggttgcttcacattgcccaggagcgagcccatccggcccattgaccctgcggcctgggtctcccacactgcagccatgaccggcaccttccctgcatacggcatgagcccctccctgagcaccatcacctccaccagctcctccatcaccagttccatccctgacacagagcgcctagacgacttccacttgtccatccacagtgacatggctgccatcgtaaaagccatggcctcccctgaatcagggttggaggtccgtgaccgcatgtggctcaagattaccatccctaatgctttcatcggctcagatgtggtggactggctgtaccacaatgtggaaggcttcacggaccggagggaggcccgcaagtatgccagcaacctgctgaaagctggcttcatccgccataccgtcaacaagatcaccttctccgagcagtgctactacatcttcggtgacctctgcggcaacatggccaacctgtctctccacgatcacgatggctccagtggcgcctctgaccaggacacactggcccctttgccgcacccgggggccgccccttggcccatggctttcccgtaccagtacccgccacccccgcacccatacaacccgcacccgggcttcccggagctgggctacagctacggcgggggcagcgccagcagtcagcacagcgaaggcagtcggagcagtggctccaaccgtagcggcagcgatcggaggaaggagaaggacccgaaggccggggactccaagtccgggggcagcggcagcgaatcggaccacaccacacgcagcagcctgcgggggccgcgggagcgggcgcccagcgagcgctcagggccggcggccagcgagcacagccaccgcagccaccattccctggccagcagccttcgcagccaccacacacacccgagctacggtcctcccggagtgccccctctctacggcccccccatgctgatgatgcccccgccgcccgcggccatggggcccccaggagcccctccgggccgcgacctggcctcagtgcccccggaactgaccgccagcagacagtccttccgcatggccatgggaaaccccagtgagttctttgtggatgtgatgtgagcagggcccctcccccagctccattccgctcccaccccagccggctgcgttcctctctccatccgtccgtcttttttactttgtctggtacctgaaagggaaataaaaggaactaaatccaggtgcgctaactgctcgcagggtgctgcgagggtggggtgcacctaccgattggctctgcagccccctaacctgcctctggccccagttcgtttcctctgcccactaatccctgcgcaggacttcccaggaccccttttgtctctgggaccagacttgttggtgctaccccttactcccctctgcaacccccattttgggagttgaccccagcaatgaccttggtggcacgctcactccctcattctctcgtttcccctttagctccctttcaccatttattcagctacatcatccctctattaaccccaccccatcaggcacgtgtgcaaacctcttgactttaccccacattactgaaaccaaaatatatttgcttcatctgcccctactaaccatccccctgcctgctgcctcagtcctgcaacctaaagctgtagtcgcctccaatagccatccatgccatccctgcctgtgcctagatcagaggcccagagggccccctcagttgcctgagcagctggtggcttccagggagcatctctgctctacccctgccccatgcctgccctgcgtgctggttccttcagacccctaaccctactaaccagcaggctcatctcacctccaggcctgaaacatttcttttctttcttttttcctcccccaatttaccctgggcctggagcagccaagaatttcgggctgtttgactttctgtgagcccccagcgaggggaggcccagcctccgaggagaccaggaaccctgcttcagcagcccctcagggcttcccaaggatgtccagcccccacacccacacgttaacataatgagtcactaggcttctggggagggcccaacttcacccatgcatgagagactctcctcctttccagagagaatcggatcgcaccacgtgtggcagcctgcggcggggggaggggggcctctttagctctctttatctttctctctcactcatgtatgcatacatgcacagagatgcatacacaggtgcctatgcaagttcatttaagcctcagggctggtccctgcccaaagggctggaccctcctaatcctctcctaggttgtggggctggtcccctgacacccttctccccttcctggtagaccttaaacctcgcacacatgtccccagcattttctcacctggataaagcccataagctgggtctcaggctgggctcagcaaaggactcgccttgcaaccgacaggccattcccacccccacacacaacctcccctgttttcacattcaccatggcatcccagagcaaggacacaggagcccacaggccagttgaggttgggcaaggagacttccaggacttccagacagagtaccaggttttatttttcaccttattctctactttaaacaaatcataactttctctttaagcctctgctataaattctcctggctctcctgggcttccatattttgggggctggggtgtcaaaagtgagatgaagttcttagctccaggttttggggtaaaccaaggtaggaacattttggcatttatttcaattaacaatacttccttggacgggtgcggtggctcacgtctgtaatcccagcactttgggaggctgagacaggtggatcacttgaggtcgggagttcgagaccagcctggccaacatagcaaaaccctgtctctactaaaaatacaaaaattagatgggtgttttggcacctgcctgtaatctcagctactcaggaggctgaggcacaagaatcgcttgaatccaggaagcaagcggaggttgcagtgagttgagatcgcactccagcctgggtgacagagtgagattctgtctcaaaagcaaactaacaaagaaaaacaatacttcctggggttttggtgtgcagagggctttgttggaagtgtgactcaatcttgcctgccttctgggagctctagaattgttcccaacccagtccatggcttctagccaccactacagggctgtttcatgtacttctctctctgactctgtcttgtccgactctcttgagaatttctcaacgattgctcatgcctgtcagtatcagtgcttccatcgttccatctttgattcacttctctttcctttctatttactcccaaaatggagtcattcatcctgatgtcctcaattgctgctgatatgctggtgattcccaaatacatagctccaacccccaacttcccccagactttagatctgtattggtattacctactggacatctctatggacagttccgtatagactcaactcatctgcccaaccaagtatgttcctcctgaattcctctcctggttacttcatcacaatctacataggctcaccagctagaaacatttatgagcttacattccttcttcccatatcttatcagcatatcatatccatttcactccaacactctgtcttgaatttggccctccctctcccctctctactttaattcattggagcatgggatttggagttaggtggttttgggtttgaattccagctctactatttttggttgtgtgatagagttatttaacctctctgagcctcagttccctcgtatgtaaaatgatgataataatacctacctcacagggttgttgtgaggatttaaattagatattgtacgaaaagtgcctagcacagtgcctggcacacagtagagtaggtgctcaataaatggtagctattattatt

SEQ ID NO: 8562 - DNA, 2309 bp, Homo sapiens
gaacaagggagctggcgccgccagcagccgccgagctgggttgagccgctgggccgcgccgcgcgccgccgccgtctgggaggctcggcccggccgcccgagcaggccgcgcgcgggccgccgggcccgaggccagagccatgggcgagaccaagatcatctaccacttggatgggcaggagacgccgtaccttgtgaagctgcccctgcccgccgagcgcgtcaccttggcggactttaagggcgttttgcagcgacccagctataagttcttcttcaagtctatggacgacgatttcggagtggtgaaggaggagatctcggatgacaatgccaagctaccatgcttcaatggccgggtggtgtcctggctggtgtcagctgagggctcacacccagacccagcccccttctgtgctgataacccatcggagctgccaccacctatggagcgcacgggaggcatcggggactcccgacccccatccttccaccctcatgctggtgggggcagccaggagaacctggacaatgacacagagacggactctttggtgtctgcccagcgagagcggccacgccggagggatggcccagagcatgcaacccggctaaatggaactgcgaagggggaacggcggcgagaaccagggggttatgatagctcatccacccttatgagcagtgagctggagaccaccagcttctttgactcagatgaggatgactccaccagcaggttcagcagctccacagaacagagcagtgcctcacgcctgatgagaagacacaagcggcggcggcggaagcagaaggtttctcggattgagcggtcctcgtccttcagcagcatcacggactccaccatgtcactcaacatcatcacggtcactctcaacatggaaaaatataacttcttgggcatctccattgtgggccaaagcaacgagcgtggtgacggcggcatctacattggctctatcatgaagggtggggccgtggctgctgatggacgcatcgagccaggagatatgttgttacaggtaaacgagatcaactttgagaacatgagtaatgacgatgcagtccgggtactgcgggagattgtgcacaaaccggggcccatcaccctgactgtagccaagtgctgggacccaagtccacgtggttgcttcacattgcccaggagcgagcccatccggcccattgaccctgcggcctgggtctcccacactgcagccatgaccggcaccttccctgcatacggcatgagcccctccctgagcaccatcacctccaccagctcctccatcaccagttccatccctgacacagagcgcctagacgacttccacttgtccatccacagtgacatggctgccatcgtaaaagccatggcctcccctgaatcagggttggaggtccgtgaccgcatgtggctcaagattaccatccctaatgctttcatcggctcagatgtggtggactggctgtaccacaatgtggaaggcttcacggaccggagggaggcccgcaagtatgccagcaacctgctgaaagctggcttcatccgccataccgtcaacaagatcaccttctccgagcagtgctactacatcttcggtgacctctgcggcaacatggccaacctgtctctccacgatcacgatggctccagtggcgcctctgaccaggacacactggcccctttgccgcacccgggggccgccccttggcccatggctttcccgtaccagtacccgccacccccgcacccatacaacccgcacccgggcttcccggagctgggctacagctacggcgggggcagcgccagcagtcagcacagcgaaggcagtcggagcagtggctccaaccgtagcggcagcgatcggaggaaggagaaggacccgaaggccggggactccaagtccgggggcagcggcagcgaatcggaccacaccacacgcagcagcctgcgggggccgcgggagcgggcgcccagcgagcgctcagggccggcggccagcgagcacagccaccgcagccaccattccctggccagcagccttcgcagccaccacacacacccgagctacggtcctcccggagtgccccctctctacggcccccccatgctgatgatgcccccgccgcccgcggccatggggcccccaggagcccctccgggccgcgacctggcctcagtgcccccggaactgaccgccagcagacagtccttccgcatggccatgggaaaccccagtgagttctttgtggatgtgatggtgctgcgagggtggggtgca

SEQ ID NO: 8563 - DNA, 2294 bp, Homo sapiens
gccgccgccgtctgggaggctcggcccggccgcccgagcaggccgcgcgcgggccgccgggcccgaggccagagccatgggcgagaccaagatcatctaccacttggatgggcaggagacgccgtaccttgtgaagctgcccctgcccgccgagcgcgtcaccttggcggactttaagggcgttttgcagcgacccagctataagttcttcttcaagtctatggacgacgatttcggagtggtgaaggaggagatctcggatgacaatgccaagctaccatgcttcaatggccgggtggtgtcctggctggtgtcagctgagggctcacacccagacccagcccccttctgtgctgataacccatcggagctgccaccacctatggagcgcacgggaggcatcggggactcccgacccccatccttccaccctcatgctggtgggggcagccaggagaacctggacaatgacacagagacggactctttggtgtctgcccagcgagagcggccacgccggagggatggcccagagcatgcaacccggctaaatggaactgcgaagggggaacggcggcgagaaccagggggttatgatagctcatccacccttatgagcagtgagctggagaccaccagcttctttgactcagatgaggatgactccaccagcaggttcagcagctccacagaacagagcagtgcctcacgcctgatgagaagacacaagcggcggcggcggaagcagaaggtttctcggattgagcggtcctcgtccttcagcagcatcacggactccaccatgtcactcaacatcatcacggtcactctcaacatggaaaaatataacttcttgggcatctccattgtgggccaaagcaacgagcgtggtgacggcggcatctacattggctctatcatgaagggtggggccgtggctgctgatggacgcatcgagccaggagatatgttgttacaggtaaacgagatcaactttgagaacatgagtaatgacgatgcagtccgggtactgcgggagattgtgcacaaaccggggcccatcaccctgactgtagccaagtgctgggacccaagtccacgtggttgcttcacattgcccaggaccatgaccggcaccttccctgcatacggcatgagcccctccctgagcaccatcacctccaccagctcctccatcaccagttccatccctgacacagagcgcctagacgacttccacttgtccatccacagtgacatggctgccatcgtaaaagccatggcctcccctgaatcagggttggaggtccgtgaccgcatgtggctcaagattaccatccctaatgctttcatcggctcagatgtggtggactggctgtaccacaatgtggaaggcttcacggaccggagggaggcccgcaagtatgccagcaacctgctgaaagctggcttcatccgccataccgtcaacaagatcaccttctccgagcagtgctactacatcttcggtgacctctgcggcaacatggccaacctgtctctccacgatcacgatggctccagtggcgcctctgaccaggacacactggcccctttgccgcacccgggggccgccccttggcccatggctttcccgtaccagtacccgccacccccgcacccatacaacccgcacccgggcttcccggagctgggctacagctacggcgggggcagcgccagcagtcagcacagcgaaggcagtcggagcagtggctccaaccgtagcggcagcgatcggaggaaggagaaggacccgaaggccggggactccaagtccgggggcagcggcagcgaatcggaccacaccacacgcagcagcctgcgggggccgcgggagcgggcgcccagcgagcgctcagggccggcggccagcgagcacagccaccgcagccaccattccctggccagcagccttcgcagccaccacacacacccgagctacggtcctcccggagtgccccctctctacggcccccccatgctgatgatgcccccgccgcccgcggccatggggcccccaggagcccctccgggccgcgacctggcctcagtgcccccggaactgaccgccagcagacagtccttccgcatggccatgggaaaccccagtgagttctttgtggatgtgatgtgagcagggcccctcccccagctccattccgctcccaccccagccggctgcgttcctctctccatccgtccgtcttttttactttgtctggtacctgaaagggaaataaaaggaactaaat

SEQ ID NO: 8564 - DNA, 1037 bp, Homo sapiens
tgacatgggcagagtttctcttgcccttaaagtcttactttccacttctaaataccttccaagatgttttcctccacaaacacaatatcttccttaaaagatagaccctgcatcagttgttaagctaacacatctttctcctcactacaaatgtatcactattgaatttctctccacaagtgtgaagatggctggagtagaaattctggcattgcttctcatcaccagaaggaaaaattcagagaaacagcccgaccacccaccctgacaaatgcctgaggcccacatgcagcctgcaaaactgcaaacatcactgcccaccacagaccacggaagcaagaagcctgtttcctgttacttgccaccactcagcaatgcccaccccatgtgtatagaggtccagaatgctcaaaattgttcttctgctgctgcaacattggagccttccatcatctcagacacatgcttttataaaccaataacaaaggatcaactttcttctaggtctgaattgaatactgtgaggctaaagtgtcttaactcattgagggggtggaaaatattaaaccaactaagccttacctaattacaatgccctgctgctgctcatctccctttattcgtttgtactcatactcaaaagaggttgtgtttttttcccttcattcaataacgattttccttgattcttagataagtccattccataatgtactccttaactgttctgaatttctttcagagaaaaactggaaaagacattaaatcatgttgaaatatttgactgactttcatctaggaaaaaatataaagttaaatctctacactaaaatataaacaaaataaaaagaaatttcagtaagaccaaaacatttacttttaaaaacctatatcatgttatatgtataactgaggaatgtaatcataattttgatttgtagaactgaagacaatatcaagtaaccctcaaaatgtaaattcaagaaacaaggtagttacgttagcctgcattaaaataaaaatatctgtgtgacaat

SEQ ID NO: 8565 - DNA, 3596 bp, Homo sapiens
tttaacttggacacttcctccaaacaccccagggttccttgcccaacctcctcgaatacagcctctctgggagtttccctctccccgactcagccgcgctggtccctgccttttcagcgctacctgccctccgtctgggacctggctcctttcctctcgccggtgtttcctcgccacccgcggaggggagggcggaccccagcctccttgccgcctgccccgcctccccgcctccccgccggcccggctcgggccgcgcaggcgcaccaggcgcggtccggaggccgagggcgaccacagcagcctccgcctcctgctgctcaggactattctgcgctgggctagtcggcggtgacccggactgcgcccggcagtggcttcgcgggcgacgcgtcgccatgggctctcgctggagcagcgaagaggagaggcagccgctgctggggcccgggctcgggcctgggctgggggcctcctggagaagccgggaggcggcggcggcggcgctgcccgcggcggtcccgggtcccgggcgggtatacgggcgccgctggctggtgctgctgctcttctcgctgctggcgttcgttcagggcctggtctggaacacctggggtcccatccagaactcggcgcgccaggcctacggcttctccagctgggacatcgcgctgctcgtgctgtgggggcccatcggcttcctgccctgcttcgcgttcatgtggctcctggacaagagaggtctccggataactgtgctcctgacatccttccttatggttttgggaactggtctaagatgcatacctatatcagacttaatccttaaaagaagattaattcatggaggacagatgttaaatggattggcaggtccaactgtaatgaatgcagcaccatttctctctacgacgtggttttctgcagatgaaagggccacagccacagctattgcatcaatgctcagttatcttgggggagcatgtgcatttttagttggaccacttgttgttccagctcccaatgggacatcacctcttcttgctgcagagagcagcagggcgcatattaaagatcgcatagaggctgtgttatatgcagaatttggagttgtctgcttaatattttctgcaacactagcttatttcccaccccgacctcctcttcctcccagtgttgctgcagctagccagcggctgagttatcggagaagcgtttgtagattattaagcaattttcgatttttgatgattgctttagcatatgccataccacttggtgtatttgctggctggtctggagttctggacttaattttaacaccagcgcatgtcagccaagtagatgctggctggattggattttggtccatagttggaggctgtgttgttggaatagctatggcaaggtttgcagattttatcaggggtatgctgaaactaattcttctcctcctgttttcgggagctacactgtcatccacgtggttcaccctgacctgtttgaacagcatcacacacctacctttaaccacagtgacattgtatgcctcctgtattctcctgggagtgttcttgaatagcagcgtgcctatattttttgagctttttgtggaaactgtctacccagttccagaaggaattacttgtggagttgtcacttttttaagtaatatgtttatgggagtacttttattttttctcacattttatcatacagagttgtcttggttcaactggtgccttcccgggtcgtgtttgctcagtctcctcctcattctgtgcttcagggaatcctatgacagactctatcttgatgtggttgtctccgtttaatagcacagacttgaaggagtttaaaaggaggctggaaatcaatactgcacactgcacatttgctcagaattgcacatctaacaggaaaagagggagaagaaagaaacttcattcagaggttttgttaggttacagattatcacattaatttaattactactaggtaataataatgggagacttgagtgataataggggattttaaaactctacagatggcatacctgtgcctgcttctggggttggaagtgtgacttcttacacataaagcactacctaagtaattctctctctgttttgtgccagtgctaaactactgattacttgtaattatgaaaagaaataaagggtgtctatcatatgaagataacgccttccctaagtcacatatcagaataggaagatatgccactaacttctaaagaagttcaaaccctgtatccaattttaatgataaaatagccaagaggtatatcgatgatggaaattagccacatgtacactacattttttctaataaagccatttcttatatgactccttattttaatcaggtcagaagcccttggccatctttactatggtgatcaggtgctttccagtgacttctgagcataggcactgtgtctccatctcaacttatccttgtttctgtgaaatacaatttcatctactaggcccttaaataattatgtgagggtgtctaaatgtttaatatgattacattaaatattgtatgaaaaaatgtaattccattaggatctagcactttgttacaagtgaaatgacaagtcacatggacatactgtgtcttctgcctgtatatggtggcatgagatgtaatgtccagagccaacaattatttaccagggttagattttattcagtgacccttgtttaaaaataataatttatcacattgaaactttcagctctgtcgaatgatttctgaattacatcctgtgtttcagcttaggttgtaaaatactccgttctctgtggagtcagcatatttgagagggcagcgttttgccagtacctatcttctttctacagaagatagctttttaagaaataagagttccacattgagtggctgtcagacacagatttcactgtgacgtaaaatacactgcagtgagaatatggtatcaccactattcatatttacatcattcccctcacacagaaaaaccaacccttttcccaaaaagtcaagaatactgctatacctttattattctcagcttcctccagcccttcttgtttttcctcacttgaaattgaaccttcattgtcagctaagtatatatacttttgtgttttcctggacagagtgcaagtggctcttatcagccaaggtggtgaaggttcaggaaagctgggcagcactgggccctgctcctctctgcacctgtgtgcgccatgacacacccacatgcagattcccaagtctgtctcccctcccccttagcaagtacaaggctgtgcattaactcacctcggtcctagaggagtatcctagtactgcttggcaacttctaagaccctaacttgtgaaactagggaagtaagaaaccgttcaaatttaacatctgtcttcagtcatctttaaatcgtctctctttataaacactctgctcacttagcagaaggactgaaggaactaaggaacttgctaaagagaagaagaaaacaaaagctagacttagttccagttaattctgttattcttctgaaataaaaatgaaataaaaggaa

SEQ ID NO: 8566 - DNA, 2706 bp, Homo sapiens
ggaaggagcaggaggcagcccaggcggagcgggaggagctggcagcggggcgcatgccaggcgggggtcctcagggcgccccagccgccgccggcggcggcggcgtgagccaccgcgcaggcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggaggtaatatccttaagattaaaacttcagaaacttcaggaagatgcagttgagaatgatgattatgataaagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcaggccagcggagatgacacccacaccccactgagaatggagccgaggctgttggaacccactgctcaggacagcttgcacgtgtccatcacgagacgagactggcttcttcaggaaaagcagcagctacagaaagaaatcgaagctctccaagcaaggatgtttgtgctggaagccaaagatcaacagctgagaagggaaatagaggagcaagagcagcaactccagtggcagggctgcgacctgaccccactggtgggccagctgtccctgggtcagctgcaggaggtcagcaaggccttgcaggacaccctggcctcagccggtcagattcccttccatgcagagccaccggaaaccataaggaggtgtgtatgagtgagaaattctgcagcaccctgaggaagaaagttaacgatattgaaacccaactaccagccttgcttgaagccaaaatgcatgccatatcaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatggtaggtagtgcacaactgttccccggcaagatattgatgatatttgttgtgttttgtggccaggcagaatgttctgtgccttatgtgaacgtcactgtgaagagcgtcatggagcacatggcccttttccttggggacatttttggcaggtgccttggcaaaccgaatggaattacttgtcagcttttgttttcatattcacatgtgacatcttttctttttctgttccctgtctcaacctgtgtttgctaatagccttgttattatttagagcagtctctcccttggcaaggtcttgagcattttctttgtgtgacaattatcttccttttgtcccttggctccgtctccttgtctgcacaatcatagactaaatcaggctgatctgagaaaattgagggaagaccataaagtggctcttctatgtgtggacttttctgagagcttctttccccaggaaggatgatgtagaagatgtgaatgccgccttagccaaagtgtctgcttgtcagaggagttcaagtgttcctgtgttctttccttttccagtcgttaggagtaactgagcttactctgagatttgcacccagagggatggtctcagaagacgctggttcagtgcaaattgagatggtaaaaacttatttcttaaaaaatggttcctaaataaatgtcatttactaaaacaaatgaaagaaatatatatatgaataaatggctatatttt

SEQ ID NO: 8567 - DNA, 2636 bp, Homo sapiens
ggaaggagcaggaggcagcccaggcggagcgggaggagctggcagcggggcgcatgccaggcgggggtcctcagggcgccccagccgccgccggcggcggcggcgtgagccaccgcgcaggcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggagctggaaccaattgctttggatccaccatggaagcctcgacatcctgaaccaaactcctattaatgaaacttcccaaatttaaacaaagcaagacaaatagatatccacacagcgtagatcatgacttctttagacatcatgaaaagaaaaagaggacccacgtggaagaatacgctcatttatgatcagggtagcatcatattcctctcccttttaacattatttcaggatagcagctgtctggatgctggccatgggcttgaaaaaaaccaggtgggcatttctgcccactgtaccgtttctcccatgcgtttcccagtcccctgtcatggcatgaaaaaaccgctattgttctgtgttgggacaattagatttttgtaggggggagaaaccacccaaaagcaaatggaaaaatatgctatgattaatgtcagttacgggaattaaacttcggaggcctttaggacaattatgaaggaatcattttccccttggtggcaatatgtactacagttgtcccttgatatccatgggggattaattccaggacgcctgtggatacagaaatccacgtgtactcaagtcttgttttcagtggatatgaaaagtcggccctccatatctgcaggttttacacttggcgaatgctgtatttttgattcatgttggattaaggatctggaacccctgatacagactgtatttattgaaaaaaaagtctgcctatgagtagactcacatgttaaaacccgtgttgttcaagggtcaaccataactgcaggcagaacatctgggcaggaagctcctgcaggaagacctgtaaactcaggtctgtggaacggcgatgatcttcttcccttgcttccagaattattgctgtgagatcaggtgcactggctacgaccttactctttgtgcagaacttatttctggtctggtttaagtgaacgttattctttctgtgcagtcctgtggttacatcaaaggttaaatttcatatagcatgtctgttatatcagacttctctgatggcctgtccagagcaaacattttaaaatattggtcctattctgtcttataacagtctgctctggtgatttttgtctcatcaattggattatgacactgtcagccactgttagtgttattctcaaattcagtcttccattcatctctccttcccttccctggcagacagacttctgcagccactgggactgttggggtgaggaaaggcaagaaccgatgtttcattctctccctcccttcttcctccctcttttttgttggttgtggggtgggctacatcttcttacccaaacaaccaggagcatttgttggcaagtttattgtgcccagtgccgatgtctggacaattaattccctaggtcagtggctttcacagtttgtgatggtgactccaggaaggaaactcaccatgaccctgtatatacatagaacaaaaatgcagcccactctgatattgtatttgttctattctagttcattaaaagtgaatgttggtcttcatccttt

SEQ ID NO: 8568 - DNA, 2872 bp, Homo sapiens
gtaggattcatgccttccgactgtgaggctgttgtaaggaagtagcgtttgtgggaatgccacccaggagtcaaatctctagcctttgggtgatcaggaggctgacaggaaaacagcgacagagctttgcctctggtggaactcctggtggcctgcagacctgttggcgtctgtacctgcagtccactcagctttccagatgactgaaatgccccaacagggtagagtggctcgcctctccaagaaagagcagttggtgaataatcatgcctgggaaaacaatccgcctggcaaagagatggatggtatccgttggtgaatgtgatggcagcaagcccagtgcaagattctgtggcgattccttgattgacctgctcggcagccgggattgcttaccacctgcagcgtgctttcggaggcggcggctggcacggaggccgggctacatgagaagctcgacagggcctgggatcgggttcctttccccagcaaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggaggtaatatccttaagattaaaacttcagaaacttcaggaagatgcagttgagaatgatgattatgataaagctggaaccaattgctttggatccaccatggaagcctcgacatcctgaaccaaactcctattaatgaaacttcccaaatttaaacaaagcaagacaaatagatatccacacagcgtagatcatgacttctttagacatcatgaaaagaaaaagaggacccacgtggaagaatacgctcatttatgatcagggtagcatcatattcctctcccttttaacattatttcaggatagcagctgtctggatgctggccatgggcttgaaaaaaaccaggtgggcatttctgcccactgtaccgtttctcccatgcgtttcccagtcccctgtcatggcatgaaaaaaccgctattgttctgtgttgggacaattagatttttgtaggggggagaaaccacccaaaagcaaatggaaaaatatgctatgattaatgtcagttacgggaattaaacttcggaggcctttaggacaattatgaaggaatcattttccccttggtggcaatatgtactacagttgtcccttgatatccatgggggattaattccaggacgcctgtggatacagaaatccacgtgtactcaagtcttgttttcagtggatatgaaaagtcggccctccatatctgcaggttttacacttggcgaatgctgtatttttgattcatgttggattaaggatctggaacccctgatacagactgtatttattgaaaaaaaagtctgcctatgagtagactcacatgttaaaacccgtgttgttcaagggtcaaccataactgcaggcagaacatctgggcaggaagctcctgcaggaagacctgtaaactcaggtctgtggaacggcgatgatcttcttcccttgcttccagaattattgctgtgagatcaggtgcactggctacgaccttactctttgtgcagaacttatttctggtctggtttaagtgaacgttattctttctgtgcagtcctgtggttacatcaaaggttaaatttcatatagcatgtctgttatatcagacttctctgatggcctgtccagagcaaacattttaaaatattggtcctattctgtcttataacagtctgctctggtgatttttgtctcatcaattggattatgacactgtcagccactgttagtgttattctcaaattcagtcttccattcatctctccttcccttccctggcagacagacttctgcagccactgggactgttggggtgaggaaaggcaagaaccgatgtttcattctctccctcccttcttcctccctcttttttgttggttgtggggtgggctacatcttcttacccaaacaaccaggagcatttgttggcaagtttattgtgcccagtgccgatgtctggacaattaattccctaggtcagtggctttcacagtttgtgatggtgactccaggaaggaaactcaccatgaccctgtatatacatagaacaaaaatgcagcccactctgatattgtatttgttctattctagttcattaaaagtgaatgttggtcttcatccttt

SEQ ID NO: 8569 - DNA, 2676 bp, Homo sapiens
ggaaggagcaggaggcagcccaggcggagcgggaggagctggcagcggggcgcatgccaggcgggggtcctcagggcgccccagccgccgccggcggcggcggcgtgagccaccgcgcaggcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggaggtaatatccttaagattaaaacttcagaaacttcaggaagatgcagttgagaatgatgattatgataaagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcaggccagcggagatgacacccacaccccactgagaatggagccgaggctgttggaacccactgctcaggacagcttgcacgtgtccatcacgagacgagactggcttcttcaggaaaagcagcagctacagaaagaaatcgaagctctccaagcaaggatgtttgtgctggaagccaaagatcaacagctgagaagggaaatagaggagcaagagcagcaactccagtggcagggctgcgacctgaccccactggtgggccagctgtccctgggtcagctgcaggaggtcagcaaggccttgcaggacaccctggcctcagccggtcagattcccttccatgcagagccaccggaaaccataaggagcctccaggaaagaataaaatccctcaacttgtcacttaaagaaatcactactaaggtgtgtatgagtgagaaattctgcagcaccctgaggaagaaagttaacgatattgaaacccaactaccagccttgcttgaagccaaaatgcatgccatatcaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatgatggagtctcactctgtcgcccagtctggagtgcagtggtacgatcttgctcactgcaacctctgcctcccgagttcaagcaattctcctgcctcagcctccggagtagctgggattacaggtgcccgccaccatgcctggctaattttgtattcttagtagagatggggttttaccatgttgaccagactggtctaaaactcctgacctcaagtgatccaccttcctcagcctcccaaagtgctgggattacagacatgagccactgtgcctggcccctacaataattctttaatgtgaggaaatatcaaatgaaaaataagaaattctaggtaaggaaagaaatttatttagtggaagtataaaagaagtttaaaaagttgaagaaaattttggttttcaatgttgatgcagcgtcctttgtgaatctttaaatttgtgaatgacacttttgaaaacttacaccttattctaagtgtctttgttcactttacactgtactgtaaagaatcacaagagtgtctcataaataactttctatataacatatgtatatttcaaaataacatgttatatatataatacatacaatttttgtcaattaaacagtacattaaaaagacaaaaataactttccataaa

SEQ ID NO: 8570 - DNA, 2224 bp, Homo sapiens
ggaaggagcaggaggcagcccaggcggagcgggaggagctggcagcggggcgcatgccaggcgggggtcctcagggcgccccagccgccgccggcggcggcggcgtgagccaccgcgcaggcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggaggtaatatccttaagattaaaacttcagaaacttcaggaagatgcagttgagaatgatgattatgataaagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcaggccagcggagatgacacccacaccccactgagaatggagccgaggctgttggaacccactgctcaggacagcttgcacgtgtccatcacgagacgagactggcttcttcaggaaaagcagcagctacagaaagaaatcgaagctctccaagcaaggatgtttgtgctggaagccaaagatcaacagctgagaagggaaatagaggagcaagagcagcaactccagtggcagggctgcgacctgaccccactggtgggccagctgtccctgggtcagctgcaggaggtcagcaaggccttgcaggacaccctggcctcagccggtcagattcccttccatgcagagccaccggaaaccataaggagcctccaggaaagaataaaatccctcaacttgtcacttaaagaaatcactactaaggtgtgtatgagtgagaaattctgcagcaccctgaggaagaaagttaacgatattgaaacccaactaccagccttgcttgaagccaaaatgcatgccatatcaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatggatataagtactgtgatgcagagtcctggacacagagaagtcagcaacttgcctgaggacagcctgcaggacacagcactgtgatttgaacccagagagtctgacttcagcccccagcgctcaactactattaattgaaagggcattgaagagacatgatgtcacaataaaaagaaaaaaagaaaagaaa

SEQ ID NO: 8571 - DNA, 6848 bp, Homo sapiens
ggaaggagcaggaggcagcccaggcggagcgggaggagctggcagcggggcgcatgccaggcgggggtcctcagggcgccccagccgccgccggcggcggcggcgtgagccaccgcgcaggcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggaggtaatatccttaagattaaaacttcagaaacttcaggaagatgcagttgagaatgatgattatgataaagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcaggccagcggagatgacacccacaccccactgagaatggagccgaggctgttggaacccactgctcaggacagcttgcacgtgtccatcacgagacgagactggcttcttcaggaaaagcagcagctacagaaagaaatcgaagctctccaagcaaggatgtttgtgctggaagccaaagatcaacagctgagaagggaaatagaggagcaagagcagcaactccagtggcagggctgcgacctgaccccactggtgggccagctgtccctgggtcagctgcaggaggtcagcaaggccttgcaggacaccctggcctcagccggtcagattcccttccatgcagagccaccggaaaccataaggagcctccaggaaagaataaaatccctcaacttgtcacttaaagaaatcactactaaggtgtgtatgagtgagaaattctgcagcaccctgaggaagaaagttaacgatattgaaacccaactaccagccttgcttgaagccaaaatgcatgccatatcaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatgaaacaagtgtgaaggaaaatactatgaagtacatggaaacacttaagaataaactgtgcagctgcaagtgtccactgcttgggaaagtgtgggaagctgacttggaagcttgtcgattgcttatccagagcctacagctccaggaagccaggggaagcctgtctgtagaagatgagaggcagatggatgacttagagggagctgctcctcctattccccccaggctccactccgaggataaaaggaagacccctttgaaggaatcttacatcctttctgcagaacttggagaaaagtgtgaagacataggcaagaagctattgtacttggaagatcaacttcacacagcaatccacagtcatgatgaagatctcattcattctctcaggagggagctccagatggtgaaggaaactctgcaggccatgatcctgcagctccagccagcaaaggaggcgggagaaagagaagctgcagcttcctgcatgacagctggtgtccacgaagcacaagcctgaggagtgacgggatgggggagggaggtgggccaccatgtttggacccggggggctgctcttccctcccccgccatagctaagatgcctgaatcaattacggagatacagagccttgaggtctttcagtggaaaggtggttcatgttcattctcatcagtgtgaaactgaggagtctgcaatttggaatatggagagagagactgatttgctgaatttccttctaaatgtcactcaaaaatttcttttccatgtcattcttgggaatgtcttccacaggatttgagaatagtttcatctcagcccccattagagagaagttggggtgaattctggaaaaatgtctctttttcctgtgccatttgccttctgctgcaacgaaaatatttcctgattcaagattctataaaaaggaaaccaagcataagactctgtcatcatacctgttacacgttcctacaggtgcacaatctaagagagctaattaacctcagagtctggagttaacagcttttcaccttacttctcctgtgatctaatattatcttagaaaaattaatatgcaatttccaaaagatattttggtaagacaacaacctcccagtgatatgccacctttcaattttccttttgtggcaatgattgcatctgaagaaaggatccctgagagtctctgtttcatcaggacattctgaaatttacccacagtgaggctgtggatggatcaggggacctgtataaaatgtttgagcctgttccattttcccgtggaacctgtttcactcaatgccaggcagtgcagcatttaggaaagcagtgcagtactcagtaaggcagtgcagtactcagtaacacaatacagtactcaggcagtgcagtactcagtaagacagtgcagtgctcagtaaggcagtgcaatactcagtaacagtgtagtactcagtaacagtgaagtactcagtaatacagtacagtattcagtaaggcagtgaagtactcagtaatacaatacagtactcagttaggcagtgcagtactcaggaatgcagcacagtactcaggcagtgcaatactcagtgcggtactcagtaacacagtgcagtactcagtaacagtgcagtactcagtaacagtgcagtactcagtaaggcagtgcagtactcagtaacacagtgcagtactcagtaatacagtacagtactcagtaaggcagtatggtactcagtaaagcaatgcaatgctcagtaacacagtgcagtgctcaataaggcagtgcagtgctcagtaaggcagtgaattgcttagtaacacagtgtagtgctcagtaggacagcatagtactcagtaacacagggcagctagtactcagtactataagtactgagtacttatataggcaatgtagtactcagtaaatcagtgcagtactcagtaatgcaagggcatttcaggctcctgctgggctgcttctttggcccagctgggactcctattgagacagctgcaaaacaggctgatttcaattaggcagcacttcccaaagtgcactgaggaaggtggccccaagagaagctctctaaacaaaggagtaccctctctggtcaagtacctttggtaaatacaccataccataatatctgcttggagaaccacaatgcacattagcatattagtctgagagagaacttatagtaaggaaactcacttgattttatctaacctcaaactttccaagtttaatggatcgtgaatttttttcatgtaactcctattcatatcccatagatctagtattgtacagcactgcattctctgaggaagtcccagtccaaactctgatttacatcactttagaaaccacactcacacttttgcagagtgttgagcttaataactacctgccacagattggtaaatttaatccagtggttgttctgtttgtgcttctgttctcatttatgtgtttagggatagtgaggttcctgccttcactaggatccacggatatgagaccatttttgtcatttcctgaagtcacactggcgtttccagaaggcatctggtgctttgctcagccttccatgctgtgcagcacttctgtcctcagtcaaggagatggccatgcttaagccagcaattggctggggtccaggaaacaaagcaaaagcacaatatgtgaatgtgctgattgtgttccctatggctttatctcgagcaaaatacactctacatattttaataataagtataattagcttgttcctggacttcattttcaatgatgaaccaaattcctgaattatttataattgtgtctaaagaaaattatgaactggtcacatggcacttggaatccttgagttaattccagtgaagcaaaacttgggaagagtcaggattggccacattgccaataacaaattcctacttcgacatatgtcttttcaaaaagcctcccagacacaagacatcttaaccgtcactagcccaagtgttttgtattactcagacaccatcatgaaataattctgtgaggtcatgatgtatttgaaaattctgcaagttaataactgccttgaattgtttgaacccgaaataagggttctttggtacctctagtagatagtgtgttcatttccctgctgcaaattttgaagtatttgggcaggtgagtcatgttttaaccacaagccataactcatctgttgtctttgcttggtcttagagtatcattcagaaagtccgctaagggccagcgtgcttcttctggctacacaaccttctcaggacaagcccactgtcttaagccactttgaccctgggagacacaggactgtgtatcctcaatcatactatacagcagtttttgtcaggggaacataaaaatatccaagagaggttagggcttagatttaaaagcatcaaaacaacaacaatggaaatttatgttggcgatagccaagaccacaagcaaaagcacatactggaaatgatgagttagaatctgatttgactgggatgttttatgagaatgtaagtgtgatattatactgtctgccttgctggaatgctggctttcaaatggtcacccatttttctttcactggcctgagttaggacatgctatcagtaatagtcccagttccatccaactttctgaaatttcatttttttttttgagatggagtctctctctgtcacccaagttggagtgcagtggccccgcaatctcggctcactgcaacctctacctcccaggttcaagctattctactgcctcagcctcccaagtagctggggttacaggcatttgccaccgggccctgatgatttttgtatttttagtagagacagggcttcaccatgttggctaggagggtctcaaactcctgacctcaggcgatccacccccacctcggcttcccaaagtgctgagattacaggtgtgagccaccgcacccggccaactttctgaaatttcaaaactgaattgatccttctccaaattagtatatactattggaaacttgtctttccctgcagtaaggctggtttccccaccccagaaacatgtaacggttggtaccatgctaagcccttgccatgctaagccctttacagtcatatcctataatccccatatcaaccttataaggaaggtgtttgtagatgatgcaactgagccttaagaggactaattccctttttctaaggcacagagctggtaaaatgtgaagtaatagtgaacctaacagtcagagacaggcagcatgctcttaactagtgctcttcctaaagttcctttaatgtccttttgagattttgagccatggaacttacttgttcacctggctaagaactcatggccactgtggaaatcttggttagggagtcaaagaaactgagcctggggcaaacgaggcttcccacactgccaggggagcctcactgtgaagtctaggctcagacaggcatcaacaaacctattcaccccaccatcatcctgatctaaccattccccagtcatcccaggaaaaccactcacagcctgacactgggctgactttcttgaagatcctcatccaattggtgtttttcagaagtgttccaatattatgaattctgtgttgtggagaaaagcaaccatgcatttactggtcaatgccttcttgtatatgtaattcaatacttttacttttaatatcctcaccttatctaatctttgaattttgtcatgtaatttattgcttcattaaggttactttttgttatacaaaataaaagctgatatccaaggca

SEQ ID NO: 8572 - DNA, 7151 bp, Homo sapiens
ggaaggagcaggaggcagcccaggcggagcgggaggagctggcagcggggcgcatgccaggcgggggtcctcagggcgccccagccgccgccggcggcggcggcgtgagccaccgcgcaggcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggaggtaatatccttaagattaaaacttcagaaacttcaggaagatgcagttgagaatgatgattatgataaagtagagacggggtttcactatgttggtcaagctggtcttgaactcctgacctcaagcaatccacctgcttcggcctcccaaagtgctgggattacagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcaggccagcggagatgacacccacaccccactgagaatggagccgaggctgttggaacccactgctcaggacagcttgcacgtgtccatcacgagacgagactggcttcttcaggaaaagcagcagctacagaaagaaatcgaagctctccaagcaaggatgtttgtgctggaagccaaagatcaacagctgagaagggaaatagaggagcaagagcagcaactccagtggcagggctgcgacctgaccccactggtgggccagctgtccctgggtcagctgcaggaggtcagcaaggccttgcaggacaccctggcctcagccggtcagattcccttccatgcagagccaccggaaaccataaggagcctccaggaaagaataaaatccctcaacttgtcacttaaagaaatcactactaaggtgtgtatgagtgagaaattctgcagcaccctgaggaagaaagttaacgatattgaaacccaactaccagccttgcttgaagccaaaatgcatgccatatcaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatgaaacaagtgtgaaggaaaatactatgaagtacatggaaacacttaagaataaactgtgcagctgcaagtgtccactgcttgggaaagtgtgggaagctgacttggaagcttgtcgattgcttatccagagcctacagctccaggaagccaggggaagcctgtctgtagaagatgagaggcagatggatgacttagagggagctgctcctcctattccccccaggctccactccgaggataaaaggaagacccctttgaaggtattggaagaatggaagactcacctcatcccctctctgcactgtgctggaggtgaacagaaagaggaatcttacatcctttctgcagaacttggagaaaagtgtgaagacataggcaagaagctattgtacttggaagatcaacttcacacagcaatccacagtcatgatgaagatctcattcattctctcaggagggagctccagatggtgaaggaaactctgcaggccatgatcctgcagctccagccagcaaaggaggcgggagaaagagaagctgcagcttcctgcatgacagctggtgtccacgaagcacaagcctgaggagtgacgggatgggggagggaggtgggccaccatgtttggacccggggggctgctcttccctcccccgccatagctaagatgcctgaatcaattacggagatacagagccttgaggtctttcagtggaaaggtggttcatgttcattctcatcagtgtgaaactgaggagtctgcaatttggaatatggagagagagactgatttgctgaatttccttctaaatgtcactcaaaaatttcttttccatgtcattcttgggaatgtcttccacaggatttgagaatagtttcatctcagcccccattagagagaagttggggtgaattctggaaaaatgtctctttttcctgtgccatttgccttctgctgcaacgaaaatatttcctgattcaagattctataaaaaggaaaccaagcataagactctgtcatcatacctgttacacgttcctacaggtgcacaatctaagagagctaattaacctcagagtctggagttaacagcttttcaccttacttctcctgtgatctaatattatcttagaaaaattaatatgcaatttccaaaagatattttggtaagacaacaacctcccagtgatatgccacctttcaattttccttttgtggcaatgattgcatctgaagaaaggatccctgagagtctctgtttcatcaggacattctgaaatttacccacagtgaggctgtggatggatcaggggacctgtataaaatgtttgagcctgttccattttcccgtggaacctgtttcactcaatgccaggcagtgcagcatttaggaaagcagtgcagtactcagtaaggcagtgcagtactcagtaacacaatacagtactcaggcagtgcagtactcagtaagacagtgcagtgctcagtaaggcagtgcaatactcagtaacagtgtagtactcagtaacagtgaagtactcagtaatacagtacagtattcagtaaggcagtgaagtactcagtaatacaatacagtactcagttaggcagtgcagtactcaggaatgcagcacagtactcaggcagtgcaatactcagtgcggtactcagtaacacagtgcagtactcagtaacagtgcagtactcagtaacagtgcagtactcagtaaggcagtgcagtactcagtaacacagtgcagtactcagtaatacagtacagtactcagtaaggcagtatggtactcagtaaagcaatgcaatgctcagtaacacagtgcagtgctcaataaggcagtgcagtgctcagtaaggcagtgaattgcttagtaacacagtgtagtgctcagtaggacagcatagtactcagtaacacagggcagctagtactcagtactataagtactgagtacttatataggcaatgtagtactcagtaaatcagtgcagtactcagtaatgcaagggcatttcaggctcctgctgggctgcttctttggcccagctgggactcctattgagacagctgcaaaacaggctgatttcaattaggcagcacttcccaaagtgcactgaggaaggtggccccaagagaagctctctaaacaaaggagtaccctctctggtcaagtacctttggtaaatacaccataccataatatctgcttggagaaccacaatgcacattagcatattagtctgagagagaacttatagtaaggaaactcacttgattttatctaacctcaaactttccaagtttaatggatcgtgaatttttttcatgtaactcctattcatatcccatagatctagtattgtacagcactgcattctctgaggaagtcccagtccaaactctgatttacatcactttagaaaccacactcacacttttgcagagtgttgagcttaataactacctgccacagattggtaaatttaatccagtggttgttctgtttgtgcttctgttctcatttatgtgtttagggatagtgaggttcctgccttcactaggatccacggatatgagaccatttttgtcatttcctgaagtcacactggcgtttccagaaggcatctggtgctttgctcagccttccatgctgtgcagcacttctgtcctcagtcaaggagatggccatgcttaagccagcaattggctggggtccaggaaacaaagcaaaagcacaatatgtgaatgtgctgattgtgttccctatggctttatctcgagcaaaatacactctacatattttaataataagtataattagcttgttcctggacttcattttcaatgatgaaccaaattcctgaattatttataattgtgtctaaagaaaattatgaactggtcacatggcacttggaatccttgagttaattccagtgaagcaaaacttgggaagagtcaggattggccacattgccaataacaaattcctacttcgacatatgtcttttcaaaaagcctcccagacacaagacatcttaaccgtcactagcccaagtgttttgtattactcagacaccatcatgaaataattctgtgaggtcatgatgtatttgaaaattctgcaagttaataactgccttgaattgtttgaacccgaaataagggttctttggtacctctagtagatagtgtgttcatttccctgctgcaaattttgaagtatttgggcaggtgagtcatgttttaaccacaagccataactcatctgttgtctttgcttggtcttagagtatcattcagaaagtccgctaagggccagcgtgcttcttctggctacacaaccttctcaggacaagcccactgtcttaagccactttgaccctgggagacacaggactgtgtatcctcaatcatactatacagcagtttttgtcaggggaacataaaaatatccaagagaggttagggcttagatttaaaagcatcaaaacaacaacaatggaaatttatgttggcgatagccaagaccacaagcaaaagcacatactggaaatgatgagttagaatctgatttgactgggatgttttatgagaatgtaagtgtgatattatactgtctgccttgctggaatgctggctttcaaatggtcacccatttttctttcactggcctgagttaggacatgctatcagtaatagtcccagttccatccaactttctgaaatttcatttttttttttgagatggagtctctctctgtcacccaagttggagtgcagtggccccgcaatctcggctcactgcaacctctacctcccaggttcaagctattctactgcctcagcctcccaagtagctggggttacaggcatttgccaccgggccctgatgatttttgtatttttagtagagacagggcttcaccatgttggctaggagggtctcaaactcctgacctcaggcgatccacccccacctcggcttcccaaagtgctgagattacaggtgtgagccaccgcacccggccaactttctgaaatttcaaaactgaattgatccttctccaaattagtatatactattggaaacttgtctttccctgcagtaaggctggtttccccaccccagaaacatgtaacggttggtaccatgctaagcccttgccatgctaagccctttacagtcatatcctataatccccatatcaaccttataaggaaggtgtttgtagatgatgcaactgagccttaagaggactaattccctttttctaaggcacagagctggtaaaatgtgaagtaatagtgaacctaacagtcagagacaggcagcatgctcttaactagtgctcttcctaaagttcctttaatgtccttttgagattttgagccatggaacttacttgttcacctggctaagaactcatggccactgtggaaatcttggttagggagtcaaagaaactgagcctggggcaaacgaggcttcccacactgccaggggagcctcactgtgaagtctaggctcagacaggcatcaacaaacctattcaccccaccatcatcctgatctaaccattccccagtcatcccaggaaaaccactcacagcctgacactgggctgactttcttgaagatcctcatccaattggtgtttttcagaagtgttccaatattatgaattctgtgttgtggagaaaagcaaccatgcatttactggtcaatgccttcttgtatatgtaattcaatacttttacttttaatatcctcaccttatctaatctttgaattttgtcatgtaatttattgcttcattaaggttactttttgttatacaaaataaaagctgatatccaaggcatggtgcatcttgatgattttttgtcctttgaagtatggatgatagaaaaatgtatcaggtttattcatctcatctttctgttacaggatgattaattgtacagttacatcacacgaaacatttataataaagtcatgcttt

SEQ ID NO: 8573 - DNA, 1118 bp, Homo sapiens
gaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatgaaacaagtgtgaaggaaaatactatgaagtacatggaaacacttaagaataaactgtgcagctgcaagtgtccactgcttgggaaagtgtgggaagctgacttggaagcttgtcgattgcttatccagagcctacagctccaggaagccaggggaagcctgtctgtagaagatgagaggcagatggatgacttagagggagctgctcctcctattccccccaggctccactccgaggataaaaggaagacccctttgaaggtattggaagaatggaagactcacctcatcccctctctgcactgtgctggaggtgaacagaaagaggtctgtccttttcacatggcctccagaggggacccttattctaaggggtgctttgggaccatgctccaaatgggaacaataaatattgggaaggcttcccattgagcatataaacttttaaaagtttcaataactcttgaatatgattacaaaataaagtagaatttttgtagaagtttgaaatatagaagagcaaaaaaacccaacttttggcatatttagttccattttcattctaatttagtggctagaattagaatatgcagtctaatatagaattaccatatatagcatacattatatatgtcatatataatatagttattatattcactatagattatatatgccatacatgatatttaacatatatactatacattatgtattgtatgtcatatatgatgtttatatatttagaatctatatattacaatatattattatttatttgaatgaaacattcaaatatatgtatttatcccattaattgtttttaccaaaaccagatcataatgaatgtttataatgttcttctttcataaacacaactaaagtttggcctgagatatatgtattacaaattaaaatatggttttattt

SEQ ID NO: 8574 - DNA, 545 bp, Homo sapiens
gagaaaattgagggaagaccataaagtggctcttctatgtgtggacttttctgagagcttctttccccaggaaggatgatgtagaagatgtgaatgccgccttagccaaagtgtctgcttgtcagaggagttcaagtgttcctgtgttctttccttttccagtcgttaggagtaactgagcttactctgagatttgcacccagagggatggtctcagaagacgctggttcagtgcaaattgagatgaaacaagtgtgaaggaaaatactatgaagtacatggaaacacttaagaataaactgtgcagctgcaagtgtccactgcttgggaaagtgtgggaagctgacttggaagcttgtcgattgcttatccagagcctacagctccaggaagccaggggaagcctgtctgtagaagatgagaggcagatggatgacttagagggagctgctcctcctattccccccaggctccactccgaggataaaaggaagacccctttgaaggtattggaagaatggaagactcacctcatcccctctctg

SEQ ID NO: 8575 - DNA, 7059 bp, Homo sapiens
ggaaggagcaggaggcagcccaggcggagcgggaggagctggcagcggggcgcatgccaggcgggggtcctcagggcgccccagccgccgccggcggcggcggcgtgagccaccgcgcaggcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggaggtaatatccttaagattaaaacttcagaaacttcaggaagatgcagttgagaatgatgattatgataaagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcaggccagcggagatgacacccacaccccactgagaatggagccgaggctgttggaacccactgctcaggacagcttgcacgtgtccatcacgagacgagactggcttcttcaggaaaagcagcagctacagaaagaaatcgaagctctccaagcaaggatgtttgtgctggaagccaaagatcaacagctgagaagggaaatagaggagcaagagcagcaactccagtggcagggctgcgacctgaccccactggtgggccagctgtccctgggtcagctgcaggaggtcagcaaggccttgcaggacaccctggcctcagccggtcagattcccttccatgcagagccaccggaaaccataaggagcctccaggaaagaataaaatccctcaacttgtcacttaaagaaatcactactaaggtgtgtatgagtgagaaattctgcagcaccctgaggaagaaagttaacgatattgaaacccaactaccagccttgcttgaagccaaaatgcatgccatatcaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatgaaacaagtgtgaaggaaaatactatgaagtacatggaaacacttaagaataaactgtgcagctgcaagtgtccactgcttgggaaagtgtgggaagctgacttggaagcttgtcgattgcttatccagagcctacagctccaggaagccaggggaagcctgtctgtagaagatgagaggcagatggatgacttagagggagctgctcctcctattccccccaggctccactccgaggataaaaggaagacccctttgaaggtattggaagaatggaagactcacctcatcccctctctgcactgtgctggaggtgaacagaaagaggaatcttacatcctttctgcagaacttggagaaaagtgtgaagacataggcaagaagctattgtacttggaagatcaacttcacacagcaatccacagtcatgatgaagatctcattcattctctcaggagggagctccagatggtgaaggaaactctgcaggccatgatcctgcagctccagccagcaaaggaggcgggagaaagagaagctgcagcttcctgcatgacagctggtgtccacgaagcacaagcctgaggagtgacgggatgggggagggaggtgggccaccatgtttggacccggggggctgctcttccctcccccgccatagctaagatgcctgaatcaattacggagatacagagccttgaggtctttcagtggaaaggtggttcatgttcattctcatcagtgtgaaactgaggagtctgcaatttggaatatggagagagagactgatttgctgaatttccttctaaatgtcactcaaaaatttcttttccatgtcattcttgggaatgtcttccacaggatttgagaatagtttcatctcagcccccattagagagaagttggggtgaattctggaaaaatgtctctttttcctgtgccatttgccttctgctgcaacgaaaatatttcctgattcaagattctataaaaaggaaaccaagcataagactctgtcatcatacctgttacacgttcctacaggtgcacaatctaagagagctaattaacctcagagtctggagttaacagcttttcaccttacttctcctgtgatctaatattatcttagaaaaattaatatgcaatttccaaaagatattttggtaagacaacaacctcccagtgatatgccacctttcaattttccttttgtggcaatgattgcatctgaagaaaggatccctgagagtctctgtttcatcaggacattctgaaatttacccacagtgaggctgtggatggatcaggggacctgtataaaatgtttgagcctgttccattttcccgtggaacctgtttcactcaatgccaggcagtgcagcatttaggaaagcagtgcagtactcagtaaggcagtgcagtactcagtaacacaatacagtactcaggcagtgcagtactcagtaagacagtgcagtgctcagtaaggcagtgcaatactcagtaacagtgtagtactcagtaacagtgaagtactcagtaatacagtacagtattcagtaaggcagtgaagtactcagtaatacaatacagtactcagttaggcagtgcagtactcaggaatgcagcacagtactcaggcagtgcaatactcagtgcggtactcagtaacacagtgcagtactcagtaacagtgcagtactcagtaacagtgcagtactcagtaaggcagtgcagtactcagtaacacagtgcagtactcagtaatacagtacagtactcagtaaggcagtatggtactcagtaaagcaatgcaatgctcagtaacacagtgcagtgctcaataaggcagtgcagtgctcagtaaggcagtgaattgcttagtaacacagtgtagtgctcagtaggacagcatagtactcagtaacacagggcagctagtactcagtactataagtactgagtacttatataggcaatgtagtactcagtaaatcagtgcagtactcagtaatgcaagggcatttcaggctcctgctgggctgcttctttggcccagctgggactcctattgagacagctgcaaaacaggctgatttcaattaggcagcacttcccaaagtgcactgaggaaggtggccccaagagaagctctctaaacaaaggagtaccctctctggtcaagtacctttggtaaatacaccataccataatatctgcttggagaaccacaatgcacattagcatattagtctgagagagaacttatagtaaggaaactcacttgattttatctaacctcaaactttccaagtttaatggatcgtgaatttttttcatgtaactcctattcatatcccatagatctagtattgtacagcactgcattctctgaggaagtcccagtccaaactctgatttacatcactttagaaaccacactcacacttttgcagagtgttgagcttaataactacctgccacagattggtaaatttaatccagtggttgttctgtttgtgcttctgttctcatttatgtgtttagggatagtgaggttcctgccttcactaggatccacggatatgagaccatttttgtcatttcctgaagtcacactggcgtttccagaaggcatctggtgctttgctcagccttccatgctgtgcagcacttctgtcctcagtcaaggagatggccatgcttaagccagcaattggctggggtccaggaaacaaagcaaaagcacaatatgtgaatgtgctgattgtgttccctatggctttatctcgagcaaaatacactctacatattttaataataagtataattagcttgttcctggacttcattttcaatgatgaaccaaattcctgaattatttataattgtgtctaaagaaaattatgaactggtcacatggcacttggaatccttgagttaattccagtgaagcaaaacttgggaagagtcaggattggccacattgccaataacaaattcctacttcgacatatgtcttttcaaaaagcctcccagacacaagacatcttaaccgtcactagcccaagtgttttgtattactcagacaccatcatgaaataattctgtgaggtcatgatgtatttgaaaattctgcaagttaataactgccttgaattgtttgaacccgaaataagggttctttggtacctctagtagatagtgtgttcatttccctgctgcaaattttgaagtatttgggcaggtgagtcatgttttaaccacaagccataactcatctgttgtctttgcttggtcttagagtatcattcagaaagtccgctaagggccagcgtgcttcttctggctacacaaccttctcaggacaagcccactgtcttaagccactttgaccctgggagacacaggactgtgtatcctcaatcatactatacagcagtttttgtcaggggaacataaaaatatccaagagaggttagggcttagatttaaaagcatcaaaacaacaacaatggaaatttatgttggcgatagccaagaccacaagcaaaagcacatactggaaatgatgagttagaatctgatttgactgggatgttttatgagaatgtaagtgtgatattatactgtctgccttgctggaatgctggctttcaaatggtcacccatttttctttcactggcctgagttaggacatgctatcagtaatagtcccagttccatccaactttctgaaatttcatttttttttttgagatggagtctctctctgtcacccaagttggagtgcagtggccccgcaatctcggctcactgcaacctctacctcccaggttcaagctattctactgcctcagcctcccaagtagctggggttacaggcatttgccaccgggccctgatgatttttgtatttttagtagagacagggcttcaccatgttggctaggagggtctcaaactcctgacctcaggcgatccacccccacctcggcttcccaaagtgctgagattacaggtgtgagccaccgcacccggccaactttctgaaatttcaaaactgaattgatccttctccaaattagtatatactattggaaacttgtctttccctgcagtaaggctggtttccccaccccagaaacatgtaacggttggtaccatgctaagcccttgccatgctaagccctttacagtcatatcctataatccccatatcaaccttataaggaaggtgtttgtagatgatgcaactgagccttaagaggactaattccctttttctaaggcacagagctggtaaaatgtgaagtaatagtgaacctaacagtcagagacaggcagcatgctcttaactagtgctcttcctaaagttcctttaatgtccttttgagattttgagccatggaacttacttgttcacctggctaagaactcatggccactgtggaaatcttggttagggagtcaaagaaactgagcctggggcaaacgaggcttcccacactgccaggggagcctcactgtgaagtctaggctcagacaggcatcaacaaacctattcaccccaccatcatcctgatctaaccattccccagtcatcccaggaaaaccactcacagcctgacactgggctgactttcttgaagatcctcatccaattggtgtttttcagaagtgttccaatattatgaattctgtgttgtggagaaaagcaaccatgcatttactggtcaatgccttcttgtatatgtaattcaatacttttacttttaatatcctcaccttatctaatctttgaattttgtcatgtaatttattgcttcattaaggttactttttgttatacaaaataaaagctgatatccaaggcatggtgcatcttgatgattttttgtcctttgaagtatggatgatagaaaaatgtatcaggtttattcatctcatctttctgttacaggatgattaattgtacagttacatcacacgaaacatttataataaagtcatgctttagaa

SEQ ID NO: 8576 - DNA, 6689 bp, Homo sapiens
ggaaggagcaggaggcagcccaggcggagcgggaggagctggcagcggggcgcatgccaggcgggggtcctcagggcgccccagccgccgccggcggcggcggcgtgagccaccgcgcaggcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggaggtaatatccttaagattaaaacttcagaaacttcaggaagatgcagttgagaatgatgattatgataaagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcacctccaggaaagaataaaatccctcaacttgtcacttaaagaaatcactactaaggtgtgtatgagtgagaaattctgcagcaccctgaggaagaaagttaacgatattgaaacccaactaccagccttgcttgaagccaaaatgcatgccatatcaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatgaaacaagtgtgaaggaaaatactatgaagtacatggaaacacttaagaataaactgtgcagctgcaagtgtccactgcttgggaaagtgtgggaagctgacttggaagcttgtcgattgcttatccagagcctacagctccaggaagccaggggaagcctgtctgtagaagatgagaggcagatggatgacttagagggagctgctcctcctattccccccaggctccactccgaggataaaaggaagacccctttgaaggtattggaagaatggaagactcacctcatcccctctctgcactgtgctggaggtgaacagaaagaggaatcttacatcctttctgcagaacttggagaaaagtgtgaagacataggcaagaagctattgtacttggaagatcaacttcacacagcaatccacagtcatgatgaagatctcattcattctctcaggagggagctccagatggtgaaggaaactctgcaggccatgatcctgcagctccagccagcaaaggaggcgggagaaagagaagctgcagcttcctgcatgacagctggtgtccacgaagcacaagcctgaggagtgacgggatgggggagggaggtgggccaccatgtttggacccggggggctgctcttccctcccccgccatagctaagatgcctgaatcaattacggagatacagagccttgaggtctttcagtggaaaggtggttcatgttcattctcatcagtgtgaaactgaggagtctgcaatttggaatatggagagagagactgatttgctgaatttccttctaaatgtcactcaaaaatttcttttccatgtcattcttgggaatgtcttccacaggatttgagaatagtttcatctcagcccccattagagagaagttggggtgaattctggaaaaatgtctctttttcctgtgccatttgccttctgctgcaacgaaaatatttcctgattcaagattctataaaaaggaaaccaagcataagactctgtcatcatacctgttacacgttcctacaggtgcacaatctaagagagctaattaacctcagagtctggagttaacagcttttcaccttacttctcctgtgatctaatattatcttagaaaaattaatatgcaatttccaaaagatattttggtaagacaacaacctcccagtgatatgccacctttcaattttccttttgtggcaatgattgcatctgaagaaaggatccctgagagtctctgtttcatcaggacattctgaaatttacccacagtgaggctgtggatggatcaggggacctgtataaaatgtttgagcctgttccattttcccgtggaacctgtttcactcaatgccaggcagtgcagcatttaggaaagcagtgcagtactcagtaaggcagtgcagtactcagtaacacaatacagtactcaggcagtgcagtactcagtaagacagtgcagtgctcagtaaggcagtgcaatactcagtaacagtgtagtactcagtaacagtgaagtactcagtaatacagtacagtattcagtaaggcagtgaagtactcagtaatacaatacagtactcagttaggcagtgcagtactcaggaatgcagcacagtactcaggcagtgcaatactcagtgcggtactcagtaacacagtgcagtactcagtaacagtgcagtactcagtaacagtgcagtactcagtaaggcagtgcagtactcagtaacacagtgcagtactcagtaatacagtacagtactcagtaaggcagtatggtactcagtaaagcaatgcaatgctcagtaacacagtgcagtgctcaataaggcagtgcagtgctcagtaaggcagtgaattgcttagtaacacagtgtagtgctcagtaggacagcatagtactcagtaacacagggcagctagtactcagtactataagtactgagtacttatataggcaatgtagtactcagtaaatcagtgcagtactcagtaatgcaagggcatttcaggctcctgctgggctgcttctttggcccagctgggactcctattgagacagctgcaaaacaggctgatttcaattaggcagcacttcccaaagtgcactgaggaaggtggccccaagagaagctctctaaacaaaggagtaccctctctggtcaagtacctttggtaaatacaccataccataatatctgcttggagaaccacaatgcacattagcatattagtctgagagagaacttatagtaaggaaactcacttgattttatctaacctcaaactttccaagtttaatggatcgtgaatttttttcatgtaactcctattcatatcccatagatctagtattgtacagcactgcattctctgaggaagtcccagtccaaactctgatttacatcactttagaaaccacactcacacttttgcagagtgttgagcttaataactacctgccacagattggtaaatttaatccagtggttgttctgtttgtgcttctgttctcatttatgtgtttagggatagtgaggttcctgccttcactaggatccacggatatgagaccatttttgtcatttcctgaagtcacactggcgtttccagaaggcatctggtgctttgctcagccttccatgctgtgcagcacttctgtcctcagtcaaggagatggccatgcttaagccagcaattggctggggtccaggaaacaaagcaaaagcacaatatgtgaatgtgctgattgtgttccctatggctttatctcgagcaaaatacactctacatattttaataataagtataattagcttgttcctggacttcattttcaatgatgaaccaaattcctgaattatttataattgtgtctaaagaaaattatgaactggtcacatggcacttggaatccttgagttaattccagtgaagcaaaacttgggaagagtcaggattggccacattgccaataacaaattcctacttcgacatatgtcttttcaaaaagcctcccagacacaagacatcttaaccgtcactagcccaagtgttttgtattactcagacaccatcatgaaataattctgtgaggtcatgatgtatttgaaaattctgcaagttaataactgccttgaattgtttgaacccgaaataagggttctttggtacctctagtagatagtgtgttcatttccctgctgcaaattttgaagtatttgggcaggtgagtcatgttttaaccacaagccataactcatctgttgtctttgcttggtcttagagtatcattcagaaagtccgctaagggccagcgtgcttcttctggctacacaaccttctcaggacaagcccactgtcttaagccactttgaccctgggagacacaggactgtgtatcctcaatcatactatacagcagtttttgtcaggggaacataaaaatatccaagagaggttagggcttagatttaaaagcatcaaaacaacaacaatggaaatttatgttggcgatagccaagaccacaagcaaaagcacatactggaaatgatgagttagaatctgatttgactgggatgttttatgagaatgtaagtgtgatattatactgtctgccttgctggaatgctggctttcaaatggtcacccatttttctttcactggcctgagttaggacatgctatcagtaatagtcccagttccatccaactttctgaaatttcatttttttttttgagatggagtctctctctgtcacccaagttggagtgcagtggccccgcaatctcggctcactgcaacctctacctcccaggttcaagctattctactgcctcagcctcccaagtagctggggttacaggcatttgccaccgggccctgatgatttttgtatttttagtagagacagggcttcaccatgttggctaggagggtctcaaactcctgacctcaggcgatccacccccacctcggcttcccaaagtgctgagattacaggtgtgagccaccgcacccggccaactttctgaaatttcaaaactgaattgatccttctccaaattagtatatactattggaaacttgtctttccctgcagtaaggctggtttccccaccccagaaacatgtaacggttggtaccatgctaagcccttgccatgctaagccctttacagtcatatcctataatccccatatcaaccttataaggaaggtgtttgtagatgatgcaactgagccttaagaggactaattccctttttctaaggcacagagctggtaaaatgtgaagtaatagtgaacctaacagtcagagacaggcagcatgctcttaactagtgctcttcctaaagttcctttaatgtccttttgagattttgagccatggaacttacttgttcacctggctaagaactcatggccactgtggaaatcttggttagggagtcaaagaaactgagcctggggcaaacgaggcttcccacactgccaggggagcctcactgtgaagtctaggctcagacaggcatcaacaaacctattcaccccaccatcatcctgatctaaccattccccagtcatcccaggaaaaccactcacagcctgacactgggctgactttcttgaagatcctcatccaattggtgtttttcagaagtgttccaatattatgaattctgtgttgtggagaaaagcaaccatgcatttactggtcaatgccttcttgtatatgtaattcaatacttttacttttaatatcctcaccttatctaatctttgaattttgtcatgtaatttattgcttcattaaggttactttttgttatacaaaataaaagctgatatccaaggcatggtgcatcttgatgattttttgtcctttgaagtatggatgatagaaaaatgtatcaggtttattcatctcatctttctgttacaggatgattaattgtacagttacatcacacgaaacatttataataaagtcatgcttt

SEQ ID NO: 8577 - DNA, 2940 bp, Homo sapiens
ggaaggagcaggaggcagcccaggcggagcgggaggagctggcagcggggcgcatgccaggcgggggtcctcagggcgccccagccgccgccggcggcggcggcgtgagccaccgcgcaggcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggaggtaatatccttaagattaaaacttcagaaacttcaggaagatgcagttgagaatgatgattatgataaagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcaggccagcggagatgacacccacaccccactgagaatggagccgaggctgttggaacccactgctcaggacagcttgcacgtgtccatcacgagacgagactggcttcttcaggaaaagcagcagctacagaaagaaatcgaagctctccaagcaaggatgtttgtgctggaagccaaagatcaacagctgagaagggaaatagaggagcaagagcagcaactccagtggcagggctgcgacctgaccccactggtgggccagctgtccctgggtcagctgcaggaggtcagcaaggccttgcaggacaccctggcctcagccggtcagattcccttccatgcagagccaccggaaaccataaggagggaggtgaggcatcagactgctccctgccgtaaccatcaactagagaaacccgtcatcaatatttgggctttccatttgagaaggaagatatgtcttttccaagctgatgggctgcagcatggatctgcagaagtgaagcatttgaaagaaaccagtgtagaaccagctggctcaacagcctccaggaaagaataaaatccctcaacttgtcacttaaagaaatcactactaaggtgtgtatgagtgagaaattctgcagcaccctgaggaagaaagttaacgatattgaaacccaactaccagccttgcttgaagccaaaatgcatgccatatcaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatggtaggtagtgcacaactgttccccggcaagatattgatgatatttgttgtgttttgtggccaggcagaatgttctgtgccttatgtgaacgtcactgtgaagagcgtcatggagcacatggcccttttccttggggacatttttggcaggtgccttggcaaaccgaatggaattacttgtcagcttttgttttcatattcacatgtgacatcttttctttttctgttccctgtctcaacctgtgtttgctaatagccttgttattatttagagcagtctctcccttggcaaggtcttgagcattttctttgtgtgacaattatcttccttttgtcccttggctccgtctccttgtctgcacaatcatagactaaatcaggctgatctgagaaaattgagggaagaccataaagtggctcttctatgtgtggacttttctgagagcttctttccccaggaaggatgatgtagaagatgtgaatgccgccttagccaaagtgtctgcttgtcagaggagttcaagtgttcctgtgttctttccttttccagtcgttaggagtaactgagcttactctgagatttgcacccagagggatggtctcagaagacgctggttcagtgcaaattgagatggtaaaaacttatttcttaaaaaatggttcctaaataaatgtcatttactaaaacaaatgaaagaaatatatatatgaataaatggctatatttt

SEQ ID NO: 8578 - DNA, 2902 bp, Homo sapiens
ggaaggagcaggaggcagcccaggcggagcgggaggagctggcagcggggcgcatgccaggcgggggtcctcagggcgccccagccgccgccggcggcggcggcgtgagccaccgcgcaggcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggaggtaatatccttaagattaaaacttcagaaacttcaggaagatgcagttgagaatgatgattatgataaagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcaggccagcggagatgacacccacaccccactgagaatggagccgaggctgttggaacccactgctcaggacagcttgcacgtgtccatcacgagacgagactggcttcttcaggaaaagcagcagctacagaaagaaatcgaagctctccaagcaaggatgtttgtgctggaagccaaagatcaacagctgagaagggaaatagaggagcaagagcagcaactccagtggcagggctgcgacctgaccccactggtgggccagctgtccctgggtcagctgcaggaggtcagcaaggccttgcaggacaccctggcctcagccggtcagattcccttccatgcagagccaccggaaaccataaggagcctccaggaaagaataaaatccctcaacttgtcacttaaagaaatcactactaaggtgtgtatgagtgagaaattctgcagcaccctgaggaagaaagttaacgatattgaaacccaactaccagccttgcttgaagccaaaatgcatgccatatcaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatgctgcaagtgtccactgcttgggaaagtgtgggaagctgacttggaagcttgtcgattgcttatccagagcctacagctccaggaagccaggggaagcctgtctgtagaagatgagaggcagatggatgacttagagggagctgctcctcctattccccccaggctccactccgaggataaaaggaagacccctttgaaggtattggaagaatggaagactcacctcatcccctctctgcactgtgctggaggtgaacagaaagaggtctgtccttttcacatggcctccagaggggacccttattctaaggggtgctttgggaccatgctccaaatgggaacaataaatattgggaaggcttcccattgagcatataaacttttaaaagtttcaataactcttgaatatgattacaaaataaagtagaatttttgtagaagtttgaaatatagaagagcaaaaaaacccaacttttggcatatttagttccattttcattctaatttagtggctagaattagaatatgcagtctaatatagaattaccatatatagcatacattatatatgtcatatataatatagttattatattcactatagattatatatgccatacatgatatttaacatatatactatacattatgtattgtatgtcatatatgatgtttatatatttagaatctatatattacaatatattattatttatttgaatgaaacattcaaatatatgtatttatcccattaattgtttttaccaaaaccagatcataatgaatgtttataatgttcttctttcataaacacaactaaagtttggcctgagatatatgtattacaaattaaaatatggttttattt

SEQ ID NO: 8579 - DNA, 2616 bp, Homo sapiens
ggaaggagcaggaggcagcccaggcggagcgggaggagctggcagcggggcgcatgccaggcgggggtcctcagggcgccccagccgccgccggcggcggcggcgtgagccaccgcgcaggcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggaggtaatatccttaagattaaaacttcagaaacttcaggaagatgcagttgagaatgatgattatgataaagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcaggccagcggagatgacacccacaccccactgagaatggagccgaggctgttggaacccactgctcaggacagcttgcacgtgtccatcacgagacgagactggcttcttcaggaaaagcagcagctacagaaagaaatcgaagctctccaagcaaggatgtttgtgctggaagccaaagatcaacagctgagaagggaaatagaggagcaagagcagcaactccagtggcagggctgcgacctgaccccactggtgggccagctgtccctgggtcagctgcaggaggtcagcaaggccttgcaggacaccctggcctcagccggtcagattcccttccatgcagagccaccggaaaccataaggagaaacaagtgtgaaggaaaatactatgaagtacatggaaacacttaagaataaactgtgcagctgcaagtgtccactgcttgggaaagtgtgggaagctgacttggaagcttgtcgattgcttatccagagcctacagctccaggaagccaggggaagcctgtctgtagaagatgagaggcagatggatgacttagagggagctgctcctcctattccccccaggctccactccgaggataaaaggaagacccctttgaaggtattggaagaatggaagactcacctcatcccctctctgcactgtgctggaggtgaacagaaagaggtctgtccttttcacatggcctccagaggggacccttattctaaggggtgctttgggaccatgctccaaatgggaacaataaatattgggaaggcttcccattgagcatataaacttttaaaagtttcaataactcttgaatatgattacaaaataaagtagaatttttgtagaagtttgaaatatagaagagcaaaaaaacccaacttttggcatatttagttccattttcattctaatttagtggctagaattagaatatgcagtctaatatagaattaccatatatagcatacattatatatgtcatatataatatagttattatattcactatagattatatatgccatacatgatatttaacatatatactatacattatgtattgtatgtcatatatgatgtttatatatttagaatctatatattacaatatattattatttatttgaatgaaacattcaaatatatgtatttatcccattaattgtttttaccaaaaccagatcataatgaatgtttataatgttcttctttcataaacacaactaaagtttggcctgagatatatgtattacaaattaaaatatggttttattt

SEQ ID NO: 8580 - DNA, 2658 bp, Homo sapiens
ggaaggagcaggaggcagcccaggcggagcgggaggagctggcagcggggcgcatgccaggcgggggtcctcagggcgccccagccgccgccggcggcggcggcgtgagccaccgcgcaggcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggaggtaatatccttaagattaaaacttcagaaacttcaggaagatgcagttgagaatgatgattatgataaagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcaggccagcggagatgacacccacaccccactgagaatggagccgaggctgttggaacccactgctcaggacagcttgcacgtgtccatcacgagacgagactggcttcttcaggaaaagcagcagctacagaaagaaatcgaagctctccaagcaaggatgtttgtgctggaagccaaagatcaacagctgagaagggaaatagaggagcaagagcagcaactccagtggcagggctgcgacctgaccccactggtgggccagctgtccctgggtcagctgcaggaggtcagcaaggccttgcaggacaccctggcctcagccggtcagattcccttccatgcagagccaccggaaaccataaggagcctccaggaaagaataaaatccctcaacttgtcacttaaagaaatcactactaaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatggtaggtagtgcacaactgttccccggcaagatattgatgatatttgttgtgttttgtggccaggcagaatgttctgtgccttatgtgaacgtcactgtgaagagcgtcatggagcacatggcccttttccttggggacatttttggcaggtgccttggcaaaccgaatggaattacttgtcagcttttgttttcatattcacatgtgacatcttttctttttctgttccctgtctcaacctgtgtttgctaatagccttgttattatttagagcagtctctcccttggcaaggtcttgagcattttctttgtgtgacaattatcttccttttgtcccttggctccgtctccttgtctgcacaatcatagactaaatcaggctgatctgagaaaattgagggaagaccataaagtggctcttctatgtgtggacttttctgagagcttctttccccaggaaggatgatgtagaagatgtgaatgccgccttagccaaagtgtctgcttgtcagaggagttcaagtgttcctgtgttctttccttttccagtcgttaggagtaactgagcttactctgagatttgcacccagagggatggtctcagaagacgctggttcagtgcaaattgagatggtaaaaacttatttcttaaaaaatggttcctaaataaatgtcatttactaaaacaaatgaaagaaatatatatatgaataaatggctatatttt

SEQ ID NO: 8581 - DNA, 2130 bp, Homo sapiens
gacaaactccattttcttatgaatggaaagtgaaaacccctgttccgcttaaattgggttccttcctgtcctgagaaacatagagacccccaaaagggaagcagaggagagaaagtcccacacccagaccccgcgagaagagatgaccatgaccaccatgccagaaagtctcaacagccccgtgtcgggcaaggcggtgtttatggagtttgggccgcccaaccagcaaatgtctccttctcccatgtcccacgggcactactccatgcactgtttacactcggcgggccattcgcagcccgacggcgcctacagctcagcctcgtccttctcccgaccgctgggctacccctacgtcaactcggtcagcagccacgcatccagcccctacatcagttcggtgcagtcctacccgggcagcgccagcctcgcccagagccgcctggaggacccaggtcaagatctggttccaaaacaagcgatccaagttcaagaagctgatgaagcagggtggggcggctctggagggtagtgcgttggccaacggtcgggccctgtctgctggctccccacccgtgccgcccggctggaaccctaactcttcatccgggaagggctcaggaggaaacgcgggctcctatatccccagctacacatcgtggtacccttcagcgcaccaagaagctatgcagcaaccccaacttatgtgaggttgcccgcccgtctccttcttgtctccccggcccaggtccctcccgcctccaggtccatccatcccgtccggaaaagaaggacccagagggaagaaggaacagtggaggcgggacgccctccatctcctcggagccccgcgaggtccggcccagcaacttcccggcatccgcgctctagcctgaaccctggcctgggccgagcagtggcagcagagagtggcctcggagggaagccactgccacctgagacagcccaagcagcaagataaacccgctccacccgacccgccgaccttcagctttgtgggactatcaggaaaaaacaaaacaaaaacaaaatgtagaaaaagcaaaagctcttttctgtcctgtcagtctcctgtctccttttgctctgtctgtgcgctggtaaagtccaggtcctcatccgtccgctgtcctcattctgcggcctcagcaaaaagccacaaggtctgagcggcccgggtcctgccgggctgaccatctccggatcctgggacactctgcctgaccatctgtgtagctggtgtgggaatctgggggcattggagggagggggttttatttattgagaaatggacttcgcctgaggctgtttgccaattcagggttctgctgggcgcaaggaacgcactgttcaaacgcactgtttactttaagcgcacggggagaaacgaataaggaggacgtggtgatttttaatttatacagtaacttttgtacttctctggtatggagagtttggagccgaatgatttgcattttttacatgtccgacattatttaataaataatttttaaaagaaaagaacgataaatgaagccaacatgattttctcatttcgggaggaactctgttgcttcgcctggacaagaaggaaaatgctgatttcctccttgggtagaaagagggagcgagggcaaatggggagtagagagaaaacaggcgagaacaagcactctaattccagtgggctttaaaataagacaaaatcagctttacaacaatccctagaggctcgaccacagaataatgccagtcaccaccctgaacgcacaatctccagtgcaggatctaatgactgtacatattattgttattattattattgttattattgttgttctgtaaacatgttgcacaagcttagcctttttgcgttctgttgtgtgtggctgtaaaaccccatgctttgtgaaatgagaatcttgacatttttcttgtgaaatttggaaaatgtgatcaattgaaatcaactgtgttttgtgttctctatgtcaaagtttagttttatattgagaatgttaacttattgctttgtatcttgggaaaaaaactttgtaaataagttataaagtttctttgagacagtaaaattatgatttcttgaaagaa

SEQ ID NO: 8582 - DNA, 1022 bp, Homo sapiens
gggaggagaagcgcgggttcctggctctccacgcgcactgctttaatcagacccgtgcagcctcgagctggagtggccagctgggcctggagcaatgcgagcgggccccagggagcgacagcggcgttggcgcagcggccgaaggagccccggccgggaagtgtggatgcgtcttacccgaggccgggccgcctcgcccgctctagtccagcggagcccgagcgcctcggaccaatccccagtgattatgcaagacagcggaccaatcagctccgccagctcatgaatatttatgaccttcgctgagtcaaagctttgaaccgagtttggggagctcagcagcatcatgcttagacttttcaaagagacaaactccattttcttatgaatggaaagtgaaaacccctgttccgcttaaattgggttccttcctgtcctgagaaacatagagacccccaaaagggaagcagaggagagaaagtcccacacccagaccccgcgagaagagatgaccatgaccaccatgccagaaagtctcaacagccccgtgtcgggcaaggcggtgtttatggagtttgggccgcccaaccagcaaatgtctccttctcccatgtcccacgggcactactccatgcactgtttacactcggcgggccattcgcagcccgacggcgcctacagctcagcctcgtccttctcccgaccgctgggctacccctacgtcaactcggtcagcagccacgcatccagcccctacatcagttcggtgcagtcctacccgggcagcgccagcctcgcccagagccgcctggaggacccaggggcggactcggagaagagcacggtggtggaaggcggtgaagtgcgcttcaatggcaagggaaaaaagatccgtaaacccaggacgatttattccagtttgcagttgcaggctttgaaccggaggttccagcaaactcagtacctagctctgccggagagggcggagctcgcggcctctttgggactcacacagactcagg

SEQ ID NO: 8583 - DNA, 2640 bp, Homo sapiens
gggaggccgatgagccgcgggccgcaggggccccggcgcagacgccgcagcccattgtgcttcctgcccggcgcgctctgttgcagaggagccccggccgggaagtgtggatgcgtcttacccgaggccgggccgcctcgcccgctctagtccagcggagcccgagcgcctcggaccaatccccagtgattatgcaagacagcggaccaatcagctccgccagctcatgaatatttatgaccttcgctgagtcaaagctttgaaccgagtttggggagctcagcagcatcatgcttagacttttcaaagagacaaactccattttcttatgaatggaaagtgaaaacccctgttccgcttaaattgggttccttcctgtcctgagaaacatagagacccccaaaagggaagcagaggagagaaagtcccacacccagaccccgcgagaagagatgaccatgaccaccatgccagaaagtctcaacagccccgtgtcgggcaaggcggtgtttatggagtttgggccgcccaaccagcaaatgtctccttctcccatgtcccacgggcactactccatgcactgtttacactcggcgggccattcgcagcccgacggcgcctacagctcagcctcgtccttctcccgaccgctgggctacccctacgtcaactcggtcagcagccacgcatccagcccctacatcagttcggtgcagtcctacccgggcagcgccagcctcgcccagagccgcctggaggacccaggggcggactcggagaagagcacggtggtggaaggcggtgaagtgcgcttcaatggcaagggaaaaaagatccgtaaacccaggacgatttattccagtttgcagttgcaggctttgaaccggaggttccagcaaactcagtacctagctctgccggagagggcggagctcgcggcctctttgggactcacacagactcaggtcaagatctggttccaaaacaagcgatccaagttcaagaagctgatgaagcagggtggggcggctctggagggtagtgcgttggccaacggtcgggccctgtctgctggctccccacccgtgccgcccggctggaaccctaactcttcatccgggaagggctcaggaggaaacgcgggctcctatatccccagctacacatcgtggtacccttcagcgcaccaagaagctatgcagcaaccccaacttatgtgaggttgcccgcccgtctccttcttgtctccccggcccaggtccctcccgcctccaggtccatccatcccgtccggaaaagaaggacccagagggaagaaggaacagtggaggcgggacgccctccatctcctcggagccccgcgaggtccggcccagcaacttcccggcatccgcgctctagcctgaaccctggcctgggccgagcagtggcagcagagagtggcctcggagggaagccactgccacctgagacagcccaagcagcaagataaacccgctccacccgacccgccgaccttcagctttgtgggactatcaggaaaaaacaaaacaaaaacaaaatgtagaaaaagcaaaagctcttttctgtcctgtcagtctcctgtctccttttgctctgtctgtgcgctggtaaagtccaggtcctcatccgtccgctgtcctcattctgcggcctcagcaaaaagccacaaggtctgagcggcccgggtcctgccgggctgaccatctccggatcctgggacactctgcctgaccatctgtgtagctggtgtgggaatctgggggcattggagggagggggttttatttattgagaaatggacttcgcctgaggctgtttgccaattcagggttctgctgggcgcaaggaacgcactgttcaaacgcactgtttactttaagcgcacggggagaaacgaataaggaggacgtggtgatttttaatttatacagtaacttttgtacttctctggtatggagagtttggagccgaatgatttgcattttttacatgtccgacattatttaataaataatttttaaaagaaaagaacgataaatgaagccaacatgattttctcatttcgggaggaactctgttgcttcgcctggacaagaaggaaaatgctgatttcctccttgggtagaaagagggagcgagggcaaatggggagtagagagaaaacaggcgagaacaagcactctaattccagtgggctttaaaataagacaaaatcagctttacaacaatccctagaggctcgaccacagaataatgccagtcaccaccctgaacgcacaatctccagtgcaggatctaatgactgtacatattattgttattattattattgttattattgttgttctgtaaacatgttgcacaagcttagcctttttgcgttctgttgtgtgtggctgtaaaaccccatgctttgtgaaatgagaatcttgacatttttcttgtgaaatttggaaaatgtgatcaattgaaatcaactgtgttttgtgttctctatgtcaaagtttagttttatattgagaatgttaacttattgctttgtatcttgggaaaaaaactttgtaaataagttataaagtttctttgagacagtaaaattatgatttcttgaaagaa

SEQ ID NO: 8584 - DNA, 762 bp, Homo sapiens
agcgcgggttcctggctctccacgcgcactgctttaatcagacccgtgcagcctcgagctggagtggccagctgggcctggagcaatgcgagcgggccccagggagcgacagcggcgttggcgcagcggccgaaaacatagagacccccaaaagggaagcagaggagagaaagtcccacacccagaccccgcgagaagagatgaccatgaccaccatgccagaaagtctcaacagccccgtgtcgggcaaggcggtgtttatggagtttgggccgcccaaccagcaaatgtctccttctcccatgtcccacgggcactactccatgcactgtttacactcggcgggccattcgcagcccgacggcgcctacagctcagcctcgtccttctcccgaccgctgggctacccctacgtcaactcggtcagcagccacgcatccagcccctacatcagttcggtgcagtcctacccgggcagcgccagcctcgcccagagccgcctggaggacccaggggcggactcggagaagagcacggtggtggaaggcggtgaagtgcgcttcaatggcaagggaaaaaagatccgtaaacccaggacgatttattccagtttgcagttgcaggctttgaaccggaggttccagcaaactcagtacctagctctgccggagagggcggagctcgcggcctctttgggactcacacagactcaggtcaagatctggttccaaaacaagcgatccaagttcaagaagctgatga

SEQ ID NO: 8585 - DNA, 2453 bp, Homo sapiens
agacaatcgtaaagccgctcggggccgctcacctgctcccgcctcccagagccccgacccggcccagccacccctgccccctccactgcccgccccccgccagagcccgcgctcgcgctgggcaaggagccgagcgggcccagaggccgaaagaggatgcgaccagaggcagctgtcccgagcagcgcacggtgatcgcctcccccggaggaggaggcgcctagacggttgcctcctttcttgtttccccaccaccacccccgtaattacattggctgctggaggggaccgggagagacagaggaggcgcctggcttcccccgcacgcccgccacctctgctctttcccgtctcgggccaggatgactggagtctttgacagtctagtggctgatatgcactcgacccagatcgccgcctccagcacgtaccaccagcaccagcagcccccgagcggcggcggcgccggcccgggtggcaacagcagcagcagcagcagcctccacaagccccaggagtcgcccacccttccggtgtccaccgccaccgacagcagctactacaccaaccagcagcacccggcgggcggcggcggcggcgggggctcgccctacgcgcacatgggttcctaccagtaccaagccagcggcctcaacaacgtcccttactccgccaagagcagctatgacctgggctacaccgccgcctacacctcctacgctccctatggaaccagttcgtccccagccaacaacgagcctgagaaggaggaccttgagcctgaaattcggatagtgaacgggaagccaaagaaagtccggaaaccccgcaccatctactccagtttccagctggcggctcttcagcggcgtttccaaaagactcaatacttggccttgccggagcgagccgagctggcggcctctctgggcctcacccagactcaggtcaaaatctggttccagaaccgccggtccaagttcaagaagatgtggaaaagtggtgagatcccctcggagcagcaccctggggccagcgcttctccaccttgtgcttcgccgccagtctcagcgccggcctcctgggactttggtgtgccgcagcggatggcgggcggcggtggtccgggcagtggcggcagcggcgccggcagctcgggctccagcccgagcagcgcggcctcggcttttctgggcaactacccctggtaccaccagacctcgggatccgcctcacacctgcaggccacggcgccgctgctgcaccccactcagaccccgcagccgcatcaccaccaccaccatcacggcggcgggggcgccccggtgagcgcggggacgattttctaaccccagggagaactcgccagagactgagagcagagaccacttatcctcattgcttaccccgagccggggttccctcctcccggcccgctgccgccacccacctctcctgcaggctgcgacctgcagtggcccgtctcaggccctgctcactcccggggccaccaaacgggcccctctctcgggggaaccggacagcagcttggcaaaggcctccctaaaaggccgcatttctgacctgagccccgggtctcggctgtttcgagccccgcctcggacttgccttccctcccctccgggtgagcctgtctggcgccttcctcgccccgggctgagagctgggtcccgggagatggaagcctcccaggcgcgcgaggcttcccgggcgctctgaggcttctttctcctcgcccgctcccctgggctcagctcggacgctgcagttattgacctcccggtcccgcctgcccgccctcccccacgtggccccttgacccgggcggccccgccgcttctttccttcctgcagttcccagccctcggagcccccatcccttatcttacccccaccgcgctcccccaggagcgctccctcagctctctcctcatccatcaccagtggagtttttttatttgttatttttttaaaagtttaggtgcctttgcggatgacctcattttgacgttgaaaaaatgattttttaatatgtgaacactgcaaaaatgtgtttaaattatcttttttaaaacctattcaggattattagcctggacttggacacagagtttgtaaataaaggtgtctgtgcagattttcccactgatttatttgtataaaaatactcatcttttcagacttttttgtaaacccccagttgtgaaaactgcagtttagcagtgacctcagcaacccctcctttttattttttcctttaaaaacatttcagttaaattaagctactgatttggatttgttttatcgtatcctaaagtctttgttgttgaaatgaaaggtattttggggttatttattatgaaaacaacatgctcttaatgttgattttacaatatgaagagattatttaaataaattattgttttcattgg

SEQ ID NO: 8586 - DNA, 1852 bp, Homo sapiens
agacaatcgtaaagccgctcggggccgctcacctgctcccgcctcccagagccccgacccggcccagccacccctgccccctccactgcccgccccccgccagagcccgcgctcgcgctgggcaaggagccgagcgggcccagaggccgaaagaggatgcgaccagaggcagctgtcccgagcagcgcacggtgatcgcctcccccggaggaggaggcgcctagacggttgcctcctttcttgtttccccaccaccacccccgtaattacattggctgctggaggggaccgggagagacagaggaggcgcctggcttcccccgcacgcccgccacctctgctctttcccgtctcgggccaggatgactggagtctttgacagtctagtggctgatatgcactcgacccagatcgccgcctccagcacgtaccaccagcaccagcagcccccgagcggcggcggcgccggcccgggtggcaacagcagcagcagcagcagcctccacaagccccaggagtcgcccacccttccggtgtccaccgccaccgacagcagctactacaccaaccagcagcacccggcgggcggcggcggcggcgggggctcgccctacgcgcacatgggttcctaccagtaccaagccagcggcctcaacaacgtcccttactccgccaagagcagctatgacctgggctacaccgccgcctacacctcctacgctccctatggaaccagttcgtccccagccaacaacgagcctgagaaggaggaccttgagcctgaaattcggatagtgaacgggaagccaaagaaagtccggaaaccccgcaccatctactccagtttccagctggcggctcttcagcggcgtttccaaaagactcaatacttggccttgccggagcgagccgagctggcggcctctctgggcctcacccagactcaggtggggctcgcgccctgcaggggcgaggagagcgcgggcctgagatggctgggaagcaggcgggtttaggacaatgctttttaaagttcattttaagtacttttaaggatttccaggcctgcgcctcgagcggccctaagtaagcttctaggcccaaagctggaaacccccaaggggccgccgtgggagggaaggaaagggaccgggtggacagaaatcccgtacctctcgctactgattaagcgggtgaaataactggccctcctcaccctcccgctgtcaccatcatcacagtgcacgtacaccagcagtcctggccttttggcaattacctccccagggagcaggaaccggcagagcctcgaaggccgccgcccgtgatcctcttatctccccagggcgctcgctgcccaccgctagccagcggtttttctctgccttcttttttctcctcttcgaacccctactgccccaagactaggttcctccactaatgctcaggtctttttcctcaaaggtcaaaatctggttccagaaccgccggtccaagttcaagaagatgtggaaaagtggtgagatcccctcggagcagcaccctggggccagcgcttctccaccttgtgcttcgccgccagtctcagcgccggcctcctgggactttggtgtgccgcagcggatggcgggcggcggtggtccgggcagtggcggcagcggcgccggcagctcgggctccagcccgagcagcgcggcctcggcttttctgggcaactacccctggtaccaccagacctcgggatccgcctcacacctgcaggccacggcgccgctgctgcaccccactcagaccccgcagccgcatcaccaccaccaccatcacggcggcgggggcgccccggtgagcgcgg

SEQ ID NO: 8587 - DNA, 2602 bp, Homo sapiens
agcatttgattgtggcttgggacgcgaggagaggcgcgcagcgaccgcctgacggcaggcaatggtgtaagcgcctctcggcctccccctccccccagacgcggccgggtcctcccttcgccttctggacacacacccctgcctcgtctcttccgcctctctcgcactccggtccgttcctgtcctctgcggaggccagccctggggaggtgcagcgcccgccaggatgagtggctccttcgatcgcaagctcagcagcatcctcaccgacatctccagctcccttagctgccatgcgggctccaaggactcgcctaccctgcccgagtcttctgtcactgacctgggctactacagcgctccccagcacgattactactcgggccagccctatggccagacggtgaacccctacacctaccaccaccaattcaatctcaatgggcttgcaggcacgggcgcttactcgcccaagtcggaatatacctacggagcctcctaccggcaatacggggcgtatcgggagcagccgctgccagcccaggacccagtgtcggtgaaggaggagccggaagcagaggtgcgcatggtgaatgggaagcccaagaaggtccgaaagccgcgtacgatctactccagctaccagctggccgccctgcagcgccgcttccagaaggcccagtacctggcgctgcccgagcgcgccgagctggccgcgcagctgggcctcacgcagacacaggtgaaaatctggttccagaaccgccgttccaagttcaagaaactctacaagaacggggaggtgccgctggagcacagtcccaataacagtgattccatggcctgcaactcaccaccatcacccgccctctgggacacctcttcccactccactccggcccctgcccgcagtcagctgcccccgccgctcccatacagtgcctcccccagctacctggacgaccccaccaactcctggtatcacgcacagaacctgagtggaccccacttacagcagcagccgcctcagccagccaccctgcaccatgcctctcccgggcccccgcccaaccctggggctgtgtactgagcacccatctggcctgcacccttgacaaaggaccccaggaccaggcagaaggcgcctccgtcctagccactcaggaatcatcgaggagcacagggaaaaggaactccctttccccctcccttgccccttcctccagggacccaagcgcttccagatgacaattgcatggaccaaggatgccccctgaacctccctccctctgcctagacactggggtacccctccagatgtggggacattccaccccagtggggacagccattcccctacctgctccaggagcctggattggctttaaatggctcatcatcttccagcttcttaaacttagtgcctgttcccagactggagaccttgggatgggggagagtgtggagggtttgcgggtcctgcctgtgctggggcacctggcaccgtggatcttaaaacttgccaggcctagttcctcctgagcctctggtggtctccccctgctcgagcggcccctcggccaataagacagtggacatcatgacgaggactccgggtggggacctgaactggtcaccgccctgcacttctagccctcatttaagatttgagggtgaaaccaaagaaaaccccctaagtgagggaatcttttaatatttgtggctttagaggaaagaactaaaggagccatctctctcccctctcctccgttccgagaggaggggtgggtctcagacgtttttcctatggacttatttcttccatgtccaggactttgcacaactttggttttaaaagctgttgaaaaataggaaaacaaagggcattgttcacagatagggccaagtctccccttgcaagggtgcctctgttctgtccctgcccccacctcaccttctctactcctccagtaagttggcagttttggtgccaaaccccaaatctccaaagagacataccaggcaagacaaacccccaaacacctcctttccggtggccttggaaacagattgctccgagctggagaatgtcgggtgaggtgtatgggagaggaggggagagttagaacttgtgcctttgggagtaaggggtaactgcctggagggctggtggcactgcccctccctgacccagacatcccaccaaagctaactttcccccacccctgatgcagtaaaacattgaaaaaaaaaaaaaaggagaggtagaagactgtagctatatatataaatatatagtaagttttttttttttaagagcaacagagagaagcagcctcctccctgctgcggtttcctatttatgtggccatgttcctcctggacggatctccctgtgtgtttcaagctgagagatgtgggctccggctggatttgggttttgtgggaggtgcaggggccaagagagacgtggtaggtctccaagagtcccacccgggggggaagaagcaaagccatctcccaccccctcccagccttctcatttctgctttcttactggactcatctttatatataatgttaataaaaaagacgaaaataa

SEQ ID NO: 8588 - DNA, 2032 bp, Homo sapiens
agagggcggggcccccgtcgggtcccgggaaccgaacccgatggagaggagggggcccccatggatttagggggggaggggaaagtcatggggggcacccccccggaacccctttcccaggcgcgcgttctccgctgaaagaggctcagagagacactttctccgggatcttaagtgtgggggctgctggctggggggcccgtccggcccaacgccggaggcttggaaaagagagttggcagcgggagcggactacgtgccgggccatggcccttctgcccgggccctggccacaatgacctctttgccctgccccctccccggccgggacgcctccaaagctgtcttcccagacctcgcccctgtcccgtcggtagcggctgcctacccgcttggcttgtcccctacaaccgcagcctcccccaatttgtcctactccaggccgtatggccacctcctgtcttacccctacaccgagccagcgaaccccggagactcctacctgtcctgccagcaacccgcggcgctctctcagcccctctgcggacctgcagagcaccctcaggaactcgaggcagactcggagaagccgcggctgtccccggaaccctccgagcggcgccctcaggcccccgccaaaaagctccgcaagccgaggaccatctactccagcctgcagctgcagcacctaaaccagcgtttccagcacacgcagtacctggcgctgcccgagagggcccagctggcagcgcagctcggcctcacccagacccaggtaaagatctggtttcagaacaaacgctccaagtataagaagctcctgaagcagaattctggggggcaggaaggggacttccctgggaggaccttctctgtgtctccctgctccccacccctcccctccctctgggatctacccaaggcagggaccctgcccaccagtggctatggcaacagctttggagcctggtatcagcatcactcctcagatgtcctggcttcgcctcagatgatgtgaatctggggaagggcgggtcaggcccacagccttcctgcaaagcccaggacccaggcagtccacctgcaccccttctgggctgggaggaaaccagctccagatgggttttctctggaggacaagcagttagaggagaaaaaggaatggagcagagcctgtacccctaaccctaacagctaaatcaaggacctcagccttatataatcattgtccccaccactaccatggactggacaccttcactccagctggacaaagactctggagagagagccattggctggagttgagactgtccccagaacccttggtcttgccactcccccactccttcttccctctctccctttctcctctccctgctttcttgaaaaggactgaatcgccactacagcctgggtgcaaaatcagcaagaaacattgagtatttttttttctttgtatgcctttggccttgcacaacccatttgtgagcaaaagcagaagtggaccaccatcagctcccacccacccagcgatttttccttggaggtcagcccgttacccccataactgatttacctacttaccatactgggaggtagaagagatgcagagaaatgtggaatttgtggacctatgggtaatttatgctttcctcctaaaaaaaaaaaaaaagccctctttcccaccccctccccatctcccctttttgaatagataatggatccaattatccatataattcaataggtatttattgagaggctcccttctattccccatccctaatccctaacgaacccacgggcacacacttttggaaacctggtaaagtaacacttagggggaaatggggacaaactggctctctggattagtgcgggtatagacacccccaaataggtgggtaggcccattgattcagctccttgcagctgtctctgttcaaaggaactgtgcagatttagaacgaattggagcttgagcttcacaccaccagcttccagagattaaagtttgtacaaaacattg

SEQ ID NO: 8589 - DNA, 1399 bp, Homo sapiens
ccgcaggcgccgcggtaccctggctgtggccctcggcgctttcttcctagggtcacaggacccatacgagtgggagctccctgggagcagaactgcgtcttgtatcacctggcgcggtgaacgtgggggttgaaacgctccacgcggaaggtagagggcaggggccaagggggcgatcctggtggctgcgctttttgctatttgctgccgacggcatgcagacgagatgcaaataagcttatgaaactgtccgtcctaccccctcgctccctcctcgccccctacaccgtgttgtgctgcccaccagactcggagaagccgcggctgtccccggaaccctccgagcggcgccctcaggcccccgccaaaaagctccgcaagccgaggaccatctactccagcctgcagctgcagcacctaaaccagcgtttccagcacacgcagtacctggcgctgcccgagagggcccagctggcagcgcagctcggcctcacccagacccaggtaaagatctggtttcagaacaaacgctccaagtataagaagctcctgaagcagaattctggggggcaggaaggggacttccctgggaggaccttctctgtgtctccctgctccccacccctcccctccctctgggatctacccaaggcagggaccctgcccaccagtggctatggcaacagctttggagcctggtatcagcatcactcctcagatgtcctggcttcgcctcagatgatgtgaatctggggaagggcgggtcaggcccacagccttcctgcaaagcccaggacccaggcagtccacctgcaccccttctgggctgggaggaaaccagctccagatgggttttctctggaggacaagcagttagaggagaaaaaggaatggagcagagcctgtacccctaaccctaacagctaaatcaaggacctcagccttatataatcattgtccccaccactaccatggactggacaccttcactccagctggacaaagactctggagagagagccattggctggagttgagactgtccccagaacccttggtcttgccactcccccactccttcttccctctctccctttctcctctccctgctttcttgaaaaggactgaatcgccactacagcctgggtgcaaaatcagcaagaaacattgagtatttttttttctttgtatgcctttggccttgcacaacccatttgtgagcaaaagcagaagtggaccaccatcagctcccacccacccagcgatttttccttggaggtcagcccgttacccccataactgatttacctacttaccatactgggaggtagaagagatgcagagaaatgtggaatttgtggacctatgggtaatttatgctttcctcctaaaaaaaaaa

SEQ ID NO: 8590 - DNA, 1688 bp, Homo sapiens
actaaaaacagatagactaagacccctccccactccacaacaagcaaaaacacacacaagcgcgcgggcgcgcacacacacaaacacacacaccccctcagtaccccccaccccctttttaagcaatgctttgttgtgctaaaactagttggacgagttagggtgttactgttgctcccgaggccctggccaatagaaccagatccaccccgctgtgcgtaagcgcgcaattaaggatttaaccaaggctgtgctgcgcctcagccagcagtcagccggccggagacagagacttcacgactcccagtctcctcctcgccgcggccgccgcctcctccttctctcctcctcctcttcctcctcctccctcgctcccacagccatgtctgcttagaccagagcagccccacagccaactagggcagctgccgccgccacaacagcaaggacagccgctgccgccgcccgtgagcgatgacaggagtgtttgacagaagggtccccagcatccgatccggcgacttccaagctccgttccagacgtccgcagctatgcaccatccgtctcaggaatcgccaactttgcccgagtcttcagctaccgattctgactactacagccctacggggggagccccgcacggctactgctctcctacctcggcttcctatggcaaagctctcaacccctaccagtatcagtatcacggcgtgaacggctccgccgggagctacccagccaaagcttatgccgactatagctacgctagctcctaccaccagtacggcggcgcctacaaccgcgtcccaagcgccaccaaccagccagagaaagaagtgaccgagcccgaggtgagaatggtgaatggcaaaccaaagaaagttcgtaaacccaggactatttattccagctttcagctggccgcattacagagaaggtttcagaagactcagtacctcgccttgccggaacgcgccgagctggccgcctcgctgggattgacacaaacacaggtgaaaatctggtttcagaacaaaagatccaagatcaagaagatcatgaaaaacggggagatgcccccggagcacagtcccagctccagcgacccaatggcgtgtaactcgccgcagtctccagcggtgtgggagccccagggctcgtcccgctcgctcagccaccaccctcatgcccaccctccgacctccaaccagtccccagcgtccagctacctggagaactctgcatcctggtacacaagtgcagccagctcaatcaattcccacctgccgccgccgggctccttacagcacccgctggcgctggcctccgggacactctattagatgggctgctctctcttactctcttttttgggactactgtgttttgctgttctagaaaatcataaagaaaggaattcatatggggaagttcggaaaactgaaaaagattcatgtgtaaagcttttttttgcatgtaagttattgcatttcaaaagaccccccctttttttacagaggactttttttgcgcaactgtggacactttcaatggtgccttgaaatctatgacctcaacttttcaaaagacttttttcaatgttattttagccatgtaaataagtgtagatagaggaattaaactgtatattctggataaataaaattatttcgaccatgaaaagcgg

SEQ ID NO: 8591 - DNA, 1790 bp, Homo sapiens
atgatgaccatgactacgatggctgacggcttggaaggccaggactcgtccaaatccgccttcatggagttcgggcagcagcagcagcagcagcactccccggccatggcaggcgcgcactaccctctgcactgcctgcactcggcggcggcggcggcagcggccggctcgcaccaccaccaccaccaccagcaccaccaccacggctcgccctacgcgtcgggcggagggaactcctacaaccaccgctcgctcgccgcctacccctacatgagccactcgcagcacagcccttacctccagtcctaccacaacagcagcgcagccgcccagacgcgaggggacgacacagatcaacaaaaaactacagtgattgaaaacggggaaatcaggttcaatggaaaagggaaaaagattcggaagcctcggaccatttattccagcctgcagctccaggctttaaaccatcgctttcagcagacacagtatctggcccttccagagagagccgaactggcagcttccttaggactgacacaaacacaggtgaagatatggtttcagaacaaacgctctaagtttaagaaactgctgaagcagggcagtaatcctcatgagagcgaccccctccagggctcggcggccctgtcgccacgctcgccagcgctgcctccagtctgggacgtttctgcctcggccaagggtgtcagtatgccccccaacagctacatgcctggctattctcactggtactcctctccacaccaggacacgatgcagagaccacagatgatgtgagttgcccaagggaacaccctagggaaacgtctgaacaaggaaaagaggatccgggacctgcttgtatctgcgaaaaggagccaaaggagcaggcttaggagagctcataagtgtggcaagaagccgactaggctcattctctctccctctctctctctctccctctcctttctttttacttcttcctttcctccattccttctttctttccttttcctttctacctttcttttctttttgcctttcaccttttttctcatttaccttctctcttgagcaacgtcagtaattgatcttgcatctcagagagagagaaagagcatgtgtgagagagaaactggtttctatgccagcactcctgaaaccccttactgtaaggatattttctcttaccccttgggatccaggctctgagtctcttctctttgggagtatccatcaaaatgactttttttaaaaacagattttcccccaaccagaagaatctgcacaaacttggcagcgtttttacttgtttaatgagtttaagacattacatggtgaaagagaagcattttggactcctgcatttttatttaccattcccagactgacgagaaaaagaaaattcctcacataacagcccttctctaaagaaaaaggaaaaagtggctgtaagattagaacattgctacaaagggaatgctgcatgttttatcaaaatgcaatgaccaggaatgatggttgattaaaaaaaaacaaaacaaaaaccactctttccccaccccacccccccaaaccctgaactggaatcaggaaagacggaggaaacaatcaaaatcaccattctattgctttgacacctttactaggtgaattggtggcattcacaaagctaatagggacgtttatatcaagaaacatttctgtatatattgttgaattttagttgtacatatactttgtatgtttttgtcttctttcatatatggagtaaaagccacaaaacgctg

SEQ ID NO: 8592 - DNA, 2304 bp, Homo sapiens
aaaccattcgactcgtggcgtctgcatcaagtctgaaagcagacgcgcaactttcgcagaatccaccttaaaatctctgccttaaactgcaccagcccccaaaaaatccaaggggggaaagcaggcggggggagagcagattcccccctccccctctcctctcccatccctcctccttcctcctccctttgagttaacaaggccccgctcactatatctctttatattaaatatatatatatattagagaagagcgagggagagggagaaccacctccacccccctctttaaattcttttttttttttttttttttttttgcaaggatccaaagagctaaggtggctgcagaggggagagcggcgcgagccaagtgggggagggtggaggaaacccgggagaaggctttctccagcccccaaagtttttgatgatgaccatgactacgatggctgacggcttggaaggccaggactcgtccaaatccgccttcatggagttcgggcagcagcagcagcagcagcagcaacagcagcagcagcagcagcagcaacagcaacagccgccgccgccgccgccgccgccgccgcagccgcactcgcagcagagctccccggccatggcaggcgcgcactaccctctgcactgcctgcactcggcggcggcggcggcagcggccggctcgcaccaccaccaccaccaccagcaccaccaccacggctcgccctacgcgtcgggcggagggaactcctacaaccaccgctcgctcgccgcctacccctacatgagccactcgcagcacagcccttacctccagtcctaccacaacagcagcgcagccgcccagacgcgaggggacgacacagatcaacaaaaaactacagtgattgaaaacggggaaatcaggttcaatggaaaagggaaaaagattcggaagcctcggaccatttattccagcctgcagctccaggctttaaaccatcgctttcagcagacacagtatctggcccttccagagagagccgaactggcagcttccttaggactgacacaaacacaggtgaagatatggtttcagaacaaacgctctaagtttaagaaactgctgaagcagggcagtaatcctcatgagagcgaccccctccagggctcggcggccctgtcgccacgctcgccagcgctgcctccagtctgggacgtttctgcctcggccaagggtgtcagtatgccccccaacagctacatgcctggctattctcactggtactcctctccacaccaggacacgatgcagagaccacagatgatgtgagttgcccaagggaacaccctagggaaacgtctgaacaaggaaaagaggatccgggacctgcttgtatctgcgaaaaggagccaaaggagcaggcttaggagagctcataagtgtggcaagaagccgactaggctcattctctctccctctctctctctctccctctcctttctttttacttcttcctttcctccattccttctttctttccttttcctttctacctttcttttctttttgcctttcaccttttttctcatttaccttctctcttgagcaacgtcagtaattgatcttgcatctcagagagagagaaagagcatgtgtgagagagaaactggtttctatgccagcactcctgaaaccccttactgtaaggatattttctcttaccccttgggatccaggctctgagtctcttctctttgggagtatccatcaaaatgactttttttaaaaacagattttcccccaaccagaagaatctgcacaaacttggcagcgtttttacttgtttaatgagtttaagacattacatggtgaaagagaagcattttggactcctgcatttttatttaccattcccagactgacgagaaaaagaaaattcctcacataacagcccttctctaaagaaaaaggaaaaagtggctgtaagattagaacattgctacaaagggaatgctgcatgttttatcaaaatgcaatgaccaggaatgatggttgattaaaaaaaaacaaaacaaaaaccactctttccccaccccacccccccaaaccctgaactggaatcaggaaagacggaggaaacaatcaaaatcaccattctattgctttgacacctttactaggtgaattggtggcattcacaaagctaatagggacgtttatatcaagaaacatttctgtatatattgttgaattttagttgtacatatactttgtatgtttttgtcttctttcatatatggagtaaaagccacaaaacgctg

SEQ ID NO: 8593 - DNA, 11072 bp, Homo sapiens
gagggaaggagggagggaagcagccgctgacccgtggcatgagctggatgcggtgtccgttgcaggactagggcgccgacatgaacctgcaccaggtgctgaccggggctgtgaaccctggcgaccactgcttctccgtgggcagcattggcgaccagcgcttcacggcttatgcatctggatgtgacattgtaatactgggaagcgattttgaaagattacagataatcccaggagctaaacatggaaatattcaagtgggatgtgtagactgttcaatgcaacaaggcaagattgcagcgtcttatggaaatgttatctccatttttgaaccagttaacctaccaaaacaaaagaaaaatttggaattatatagtcagtggcagaaaagtggccaattttttctggaatcaatagcacacaatataacctgggatcccacaggcagtcgtcttttaactggttccagctatttgcaactctggtccaatactaacttggagaagccaactgaagatgaaaatttaaataaaacagatcttaactttggagattggaaatgcatttggcattgcaaaactgcttcccaagttcatttaatgaaattttcaccagatggagaattttttgccactgctgggaaggatgactgtcttttgaaggtttggtataatgtagaaaactggcggacagctgttacttctccagatggaagttcagaaaaacaatcccaaggagaaattgacttttcttttgtgtatctggcccatcctcgagcagtaaatggattttcctggcgtaaaacaagcaaatatatgcctagggcttctgtatgtaatgtactgttgacttgctgcaaagataatgtgtgtcgtctttgggtagagacatttttaccaaatgattgtttgctatacggaggtgactgcagccattggactgaatcaattaatttaacaaataacttcaagagaaatgcttccagtaaagaacgagttcaaaatgctttagaagtaaatctgagacattttcgtagaggtcggaggagatcacttgctcttgtagcacatacgggatatctaccacatcagcaggatcctcatcatgttcacaggaacactccactgcatgccaatgcactttgccactttcatattgcagccagcatcaacccagccacagacattccacttcttccatctattacatctctgagtctaaatgaaaatgaagagaagaccggaccttttgttgtacactggctaaacaataaagaactgcattttactttgtccatggaagtttttttacagcaacttagaaaaagttttgaacaaccatcttctgaggccagtgtagaagattctaatcaggcagatgtaaaatctgatgaagaaactgatgatggtgttgatgatctgaaaataaatcccgaaaagaaggaattaggctgtgataaaatggtaccaaactcaagttttacatcattatcgtcagctgccattgatcatcagattgaagtacttctgtctgaatggagtaaaaatgcagatatgctatttagtattcatcccatggatggttctttgctagtttggcatgtggattggctggatgaataccagcctggtatgtttcgtcaagtacaggtgtcctttgtttccagaattccagtagctttccccacaggtgatgcaaactctctctgtaaaagcataatgatgtatgcctgtaccaagaatgttgacttggctattcagcaggggaaacaaaaaccttctggcctcacccgttccacatcaatgcttatttcttctggtcacaataaatcatctaatagtttaaaattaagtatttttacgcctaatgttatgatgatatcaaaacatgctgatggttctctgaatcagtggctggtcagttttgccgaggaatctgctttttctactgttctcagtatttcccacaaatccagatattgtggtcatcgttttcatcttaatgatttagcttgccactcagtattaccattattgctgacaacatcacaccataatgcattaaggacaccagatgttgataacccagagcaaccttttgatgctctaaatattgaagaatgctctttgacacaacaaaataaaagcactgttgacgtggcatttcaggatcccagtgcagtttacagtgagcttattctgtggagggttgacccagttgggccattgtctttttctggaggagtttctgagcttgcccggattaattctcttcatgtttctgccttttccaatgtggcatggctgcccactcttatacccagttattgtctgggtgcatactgcaactctcctagtgcatgctttgtagccagtgatggacaatatctgagattatatgaagcagttattgatgctaagaaacttttatctgagctttctaaccctgaaatttctaaatatgttggtgaagtctttaacatcgtcagtcaacaatcaacagccaggccaggatgcattattgcattagatcccattaccaaacttcatggcagaaaaacccaactgcttcatgtttttgaagaagacttcattttgaataaccttgagaagaaaagccttggcaaagacagcattttatctaatgcaggcagctcacctaatggattttctgagaagttctacctaattgtaatagaatgcactcaagacaaccgttcactgttacacatgtggaatttacatctaaagtcaattcctgtctcattagatgaaaaagtagatacaaaattatccgaagcggtttggcagccagaagaacattattcttcttctccagagaagatcctatctcctttttcacaaaagtatcaggcttgcagagcaaatctccagagtaccagcaggttgactctgttttcagaaatggtttatagccaagaattgcatttaccagaaggagttgagataataagtattaagccatcagcaggacatctgagttcatcttctatatatcctgcatgcagtgctccttatttattggcaacttcatgttcagatgagaaagtaagattctggagatgcagagtaacagatggagaatctgccacgtcaaagaatggaaaaattgatcttgcatacatttgggaagaatggccattacttattgaagatggacttcagagcaatagtagtataactgtacctggtaggcctgtagaagttagctgtgcacatacaaatcgtttagcagtagcttataagcagcctgcatctaatagtagatcttcccaggactttgtgatgcatgtaagtatttttgaatgtgagtcaacaggaggttcatgttgggtccttgagcagacaattcatttagatgagttaagcacagtattggattctggcattagtgttgatagcaatttagtggcctataataaacaagacatgtatttatctagtaaagagaatatcacatcaaacacaaagcatttagttcacttagattggatgtctagagaagacggttctcatatcctgactgtaggaattggatcaaaactttttatgtatggacccctggctggcaaggtacaagaccaaactggtaaggaaaccctggcatttcctctctgggagagtaccaaagttgtgcccctttctaaatttgtactattacgaagtgtggacctagtttcttctgtagatggctccccaccttttcctgtttctttatcgtgggtccgggatggcatccttgtggtaggaatggactgtgaaatgcatgtgtattgccaatggcaaccatcttctaaacaagaacctgttataacagattcgtacagtgggagcactccatctataacaagtttaataaaacagagtaactccagttctgggttacatcctccaaagaaaactctgactcgatccatgaccagtcttgcacagaaaatctgtggaaagaaaactgcattcgatccttcagtggatatggaagattcaggtctttttgaagcagctcatgtactttccccgactctacctcagtatcatcccttgcagcttttggaactcatggatcttggtaaagttcggagagccaaggccatcttgtcccatcttgttaagtgcattgctggggaagttgtggctctgaatgaagctgaatctaatcatgaacgccgccttaggtctctcacaatcagtgctagtggaagcactaccagagacccccaggcattcaacaaggctgaaaatacagattacacagaaatagattctgttcctccacttcctttatatgccttacttgcagcagatgatgatagctgttactcatctttggagaaatctagtaatgagagtacgttaagtaaatcaaaccaattatctaaagaaagttatgatgagctttttcagactcaacttctaatgactgatactcatatgttagagacagatgaagaaaatacaaagcctagagttattgacctttcacagtacagtccgacttactttggacctgagcatgctcaggttctttctggccacttacttcattctagtttaccaggactcagccggatggagcagatgtctttgatggccttagcagatacaattgcaactacaagcactgatattggagaaagccgagacagaagccaaggtggagaaactcttgatgaatgtgggttaaaatttcttttggctgttcgactccatacctttcttacaacttcccttccagcctatcgagctcaactccttcaccaaggcctgtctacaagtcattttgcttgggcatttcactcagtagcagaagaagaactgctgaacatgttgccagccatgcagaaagatgatcccacttggtctgaactaagagctatgggtgtggggtggtgggtccggaatacccgcatcttacgcaaatgcatagaaaaagtagctaaagcagccttttatagaaagaatgatcctttagatgctgccattttttaccttgcaatgaaaaagaaagctgtgatttggggattatatagagctgaaaaaaacaccaggatgacacagttttttggacacaattttgaggatgagaggtggcgtaaagcagctttaaagaatgctttttctttgctaggcaaacaaagatttgaacattctgcagcattttttcttttagctggttgcctcagagatgcaattgaggtatgtcttgagaaattgaatgacattcagttggctcttgtaatagcaagactctatgagtctgaatttgatacatctgcagcatataaatctattttacgtaaaaaagttttgggaatcgattctcctgtcagtgaactgtgttcattgaacataaatatgcatcatgatccttttcttcggagcatggcatattggattttggaagattatagtggtgctctggaaacattaataaagcaacctatcagagagaatgatgatcaagttttatcagccagtaatcctacagtttttaatttctacaattatctaagaacacatcctcttttgctgagacgtcattttggatcatctgatacattttccacacatatgagcctaacaggaaaaagtggactggcaggaacaattaatttaagtgaaagacgtttattttttaccactgccagtgctcatttaaaagctggctgcccaatgttggctttggaagtattatcaaagatgcctaaagtcatcaagaaaacaagacctttttatagggcttctagttttctggatactagtaaagactgttctccttcttctccattaaagttggatgcaagggaagataagtcttctgctgttgattggtcacagtcactgataaatggttttggatcttcttcagagggttcctcagagaagcaatcaaactccactctttcttttgactggagccaaccaagtgttgtgtttcaggatgactctttagagttaaaatgggacagtgataatgatgaagaaaatgaggatgtccctatttcaatgaaagaactaaaacctttacagagaaaaacagataaaaagttggatgacataagttctaactacacagaatctttcagcacactagatgaaaatgaccttttaaatccatcagaagatataattgcagttcagttaaaatttagagcatgtttaaagattctcacagtagaacttcgtactttatctactggctatgaaatagatggtggaaaattgcgttaccaactataccactggcttgaaaaagaggtgatagctcttcagaggacttgtgacttttgctcagatgctgaagaactacagtctgcatttggcagaaatgaagatgaatttggattaaatgaggatgctgaagatttgcctcaccaaacaaaagtgaaacaactgagagaaaattttcaggaaaaaagacagtggctcttgaagtatcagtcacttttgagaatgtttcttagttactgcatacttcatggatcccatggtgggggtcttgcatctgtaagaatggaattgattttgcttttgcaagaatctcagcaggaaacatcagaaccactattttctagccctctgtcagagcaaacctcagtgcctctcctctttgcttgtacagccaatgccaaaacagtagttgccaatccattattgcaccttagtaatctgacacatgatattctccatgccataataaactttgattcaccaccccaccctgatatccaaagcaataaagtgtatgtaatgcatactttagcagcttcactttctgcttgtatttatcagtgcctttgtggtagtcataactacagttcatttcagacgaatcagtttactggaatggtatatcagacagtactgcttcctcatcgaccttctttgaaaacaggaagcttagatgaagcattaactcccaatacgtcaccagctcaatggccaggaataacttgtctaattcgacttttgaattcttctggcgaggaagcccagtcagggcttacagtcttgctctgtgagattctcacagcagtgtatcttagtctcttcatccatggcctggccacacattcaagtaatgagctatttcggattgtggcccatcctctaaatgagaaaatgtggtctgctgtgtttggtggaggtgcacatgttcctagcaaagaacagacacattcaaaaactttacctgtttcttcactagttgaagaaggagaaaaacagaacaaacgttttaggccgtcaaaaatgtcttgcagagaatctgccccactgaccccttcctcggcaccagtaagccaggagtcactggcggttaaagaaaagttcatcccacctgagctcagtatctgggactatttcatagctaagccttttctaccctcttctcaaagtagagccgaatatgattcagaggagagtctgggaagtgatgatgatgacaatgatgatgatgatgatgttttagcatcagatttccatctccaggaacattctaattcaaattcatatagttggtccttgatgcggttggcgatggtgcaattggtgctcaacaatttgaagactttttatcccttcgcaggtcatgatcttgcagagcttccagttagttcacctctttgtcatgcggttctaaaaactcttcaatgttgggaacaagttcttctccgacgacttgaaatccatggtgggccacctcaaaattatatcgcaagtcataccgccgaagagagtttgtctgcaggtcctgcaattcttcgccacaaagctttactggaacctacaaacactcctttcaaatccaaacaccatctggcactgtctgtgaagaggctttggcagtatttggtgaagcaggaagaaattcaggaaacctttatcaaaaatatattcacaaagaaacggtgtctaaatgagatagaagcagatttgggatatcctggaggtaaagcaagaattattcataaggaatctgatatcattactgcgtttgctgttaataaggcaaatagaaactgcatagcaatcgcttccagtcatgatgttcaagaactggatgtttctggaattctggccacacaggtctacacttgggtagatgatgatatagaagtggaaaccaaaggatcagaagatttcttggttatacatgctcgtgatgatttaacagctgttcaaggtacaactccatatacacatagcaatcctggcactccaatcaacatgccatggcttggtagtacacagactggcagaggagcatctgtgatgattaagaaagccattaataatgttagaagaatgacttctcatccaactcttccttactatctgacaggagctcaagatggaagtgtcagaatgtttgaatggggccattctcaacaaataacctgttttcgatctggtggcaattcaagagttacaagaatgagatttaactatcagggaaataagtttggaatagttgatgctgatggatatttaagtttgtatcaaacaaactggaaatgttgtccagttactggaagcatgcctaagccatacctgacttggcagtgtcataacaaaacagccaatgattttgtcttcgttagttcctcctctctgatagctacagctggtctttcaactgacaatagaaacgtatgtttgtgggatactcttgtagcacctgccaatagtttagtccatgcatttacctgccatgacagtggagccacagttttagcatatgctccaaaacatcagctactaatatcaggtggcagaaaaggttttacatatgtatttgacctttgtcaacgacaacagaggcagcttttccagagccatgattctcctgttaaagccgttgctgttgatccaactgaagagtactttgttacaggatctgccgaaggcaatataaagatttggagtctctctacctttggtcttctccatacttttgtcagtgaacatgctcggcagtccatttttagaaatattggaactggagtgatgcaaattgagacagggcctgcaaatcacattttctcctgtggagctgatggaacaatgaaaatgagaatactgccagatcagtttagccctttaaatgaagtgttgaaaaatgatgtgaaatttatgctataacatttttacaataagatgtacaatttattacctatatggaagtggccaacagatataatatacagtgatcattctctatgccacaaattagctaatgctttcttgtttttatatttattttatggagctttgcccttgatgcactgatgccttaaaaattaacaaggtcattcagaagtagattacattgcctaaagtagaatgtgtaagtaatgctgtaataatacatatcatagtatattataatcagtatgtcatagtgttaaaggtgttttgttttcttattgatacttttccacaggcatctctgcatgaatttcttccacagtaaaaatacgttttttgtaaaggcaattgtacataatactcatcacttaattcaccacactctcacttcctttattagccttatacatctcaaactcttctcttaattaatgataggtatttgagtaagaatgaaaaaaataatgaacatcttcattaaaattgtcattgagacgtcagtgataaatgagctagatggctcaatatgtaaggttttcagtagtttaccctccggaacccaagttgtatgtatgtatacgtgtgtgtgtgtgtgtgtgtgtgtatcttacacatcttatttgaacttagttgtatatattagcgaaaactggtttttcatgtgtttttgtgccataacaactattgccaccagaataactttttttttgcaactgtgcttttcatttttaaaaaatttttgaattcccatcctaattttcaaataagtttcaaggagactatcaggattattattttaaagattagatttagtcaaataagtcttagcaggcaataaagtttctgtggtggcatatatcatgtaagacacttaaagtaagtttgtgaatttgtcaactttcgagcatcaaacaaatattttacttaaattttattttatcttatttttaggtgcttttaatctcaaaattctgaaaagcgaatagcagtgttttcagaaacaaatgtgaaagcagtcaaattaagtagatactatttagaaatgtaaaatactctccagatctaccattaatagaaaataaactaaaccttatattttatttttgccaaaatattttattataaaatatgaccaaaatatttaaaatgcacaatgcttttaacttaaatgtgctaaccctgtttctgtctgttttgtgctgtaccttttctgattcagaattatagaaaacttgataaatacttgattttaaccaatgagactacaggcagatgggactaagtgtttatgggacaattatgtactatttaacttaaatatattttgtttaataggaaatatataataatagcattttatgtaataaaatatgggcaacgattatcttggaaattaaagagtcaaagcaaagaaatgaagggctggtaaaatgaattttgtaatatcctcaggatacttttatcttaaaagtatgttgttaaagattttgtaaattgtatttcaacaattttaaatgtgttgagcaagttgcagtgcaaacactgtcattatgtagagagtttatatgcacataataacctgtacctataaatcgtgcaataaccatatgcgactattttgccatggagaaatctgacagcattgcaaacaatagtattgtttgatgtagttaaccttaagttatttttcagtaatttcttcacaaatcaagattcaaacagctttaaacacttccaatgagataaaatatttactattatgcttattagaacaaaaggtgtttaaggatgaactaaatattttaattgagcatttatatggataatcatacattatgtaagcccatatgtatttacatccagagtcataatattttaaataaacaatcatgcagaaacttt

SEQ ID NO: 8594 - DNA, 1835 bp, Homo sapiens
gcggctgcccgaggtccagaggaagtgtgtggacagcgcggccttcctggccggactagggcgccgacatgaacctgcaccaggtgctgaccggggctgtgaaccctggcgaccactgcttctccgtgggcagcattggcgaccagcgcttcacggcttatgcatctggatgtgacattgtaatactgggaagcgattttgaaagattacagataatcccaggagctaaacatggaaatattcaagtgggatgtgtagactgttcaatgcaacaaggcaagattgcagcgtcttatggaaatgttatctccatttttgaaccagttaacctaccaaaacaaaagaaaaatttggaattatatagtcagtggcagaaaagtggccaattttttctggaatcaatagcacacaatataacctgggatcccacaggcagtcgtcttttaactggttccagctatttgcaactctggtccaatactaacttggagaagccaactgaagatgaaaatttaaataaaacagatcttaactttggagattggaaatgcatttggcattgcaaaactgcttcccaagttcatttaatgaaattttcaccagatggagaattttttgccactgctgggaaggatgactgtcttttgaaggtttggtataatgtagaaaactggcggacagctgttacttctccagatggaagttcagaaaaacaatcccaaggagaaattgacttttcttttgtgtatctggcccatcctcgagcagtaaatggattttcctggcgtaaaacaagcaaatatatgcctagggcttctgtatgtaatgtactgttgacttgctgcaaagataatgtgtgtcgtctttgggtagagacatttttaccaaatgattgtttgctatacggaggtgactgcagccattggactgaatcaattaatttaacaaataacttcaagagaaatgcttccagtaaagaacgagttcaaaatgctttagaagtaaatctgagacattttcgtagaggtcggaggagatcacttgctcttgtagcacatacgggatatctaccacatcagcaggatcctcatcatgttcacaggaacactccactgcatgccaatgcactttgccactttcatattgcagccagcatcaacccagccacagacattccacttcttccatctattacatctctgagtctaaatgaaaatgaagagaagaccggaccttttgttgtacactggctaaacaataaagaactgcattttactttgtccatggaagtttttttacagcaacttagaaaaagttttgaacaaccatcttctgaggccagtgtagaagattctaatcaggcagatgtaaaatctgatgaagaaactgatgatggtgttgatgatctgaaaataaatcccgaaaagaaggaattaggctgtgataaaatggtaccaaactcaagttttacatcattatcgtcagctgccattgatcatcagattgaagtacttctgtctgaatggagtaaaaatgcagatatgctatttagtattcatcccatggatggttctttgctagtttggcatgtggattggctggatgaataccagcctggtatgtttcgtcaagtacaggtgtcctttgtttccagaattccagtagctttccccacaggtgatgcaaactctctctgtaaaagcataatgatgtatgcctgtaccaagaatgttgacttggctattcagcaggggaaacaaaaaccttctggcctcacccgttccacatcaatgcttatttcttctggtcacaataaatcatctaatagtttaaaa

SEQ ID NO: 8595 - DNA, 9319 bp, Homo sapiens
gtccgttgcaggactagggcgccgacatgaacctgcaccaggtgctgaccggggctgtgaaccctggcgaccactgcttctccgtgggcagcattggcgaccagcgcttcacggcttatgcatctggatgtgacattgtaatactgggaagcgattttgaaagattacagataatcccaggagctaaacatggaaatattcaagtgggatgtgtagactgttcaatgcaacaaggcaagattgcagcgtcttatggaaatgttatctccatttttgaaccagttaacctaccaaaacaaaagaaaaatttggaattatatagtcagtggcagaaaagtggccaattttttctggaatcaatagcacacaatataacctgggatcccacaggcagtcgtcttttaactggttccagctatttgcaactctggtccaatactaacttggagaagccaactgaagatgaaaatttaaataaaacagatcttaactttggagattggaaatgcatttggcattgcaaaactgcttcccaagttcatttaatgaaattttcaccagatggagaattttttgccactgctgggaaggatgactgtcttttgaaggtttggtataatgtagaaaactggcggacagctgttacttctccagatggaagttcagaaaaacaatcccaaggagaaattgacttttcttttgtgtatctggcccatcctcgagcagtaaatggattttcctggcgtaaaacaagcaaatatatgcctagggcttctgtatgtaatgtactgttgacttgctgcaaagataatgtgtgtcgtctttgggtagagacatttttaccaaatgattgtttgctatacggaggtgactgcagccattggactgaatcaattaatttaacaaataacttcaagagaaatgcttccagtaaagaacgagttcaaaatgctttagaagtaaatctgagacattttcgtagaggtcggaggagatcacttgctcttgtagcacatacgggatatctaccacatcagcaggatcctcatcatgttcacaggaacactccactgcatgccaatgcactttgccactttcatattgcagccagcatcaacccagccacagacattccacttcttccatctattacatctctgagtctaaatgaaaatgaagagaagaccggaccttttgttgtacactggctaaacaataaagaactgcattttactttgtccatggaagtttttttacagcaacttagaaaaagttttgaacaaccatcttctgaggccagtgtagaagattctaatcaggcagatgtaaaatctgatgaagaaactgatgatggtgttgatgatctgaaaataaatcccgaaaagaaggaattaggctgtgataaaatggtaccaaactcaagttttacatcattatcgtcagctgccattgatcatcagattgaagtacttctgtctgaatggagtaaaaatgcagatatgctatttagtattcatcccatggatggttctttgctagtttggcatgtggattggctggatgaataccagcctggtatgtttcgtcaagtacaggtgtcctttgtttccagaattccagtagctttccccacaggtgatgcaaactctctctgtaaaagcataatgatgtatgcctgtaccaagaatgttgacttggctattcagcaggggaaacaaaaaccttctggcctcacccgttccacatcaatgcttatttcttctggtcacaataaatcatctaatagtttaaaattaagtatttttacgcctaatgttatgatgatatcaaaacatgctgatggttctctgaatcagtggctggtcagttttgccgaggaatctgctttttctactgttctcagtatttcccacaaatccagatattgtggtcatcgttttcatcttaatgatttagcttgccactcagtattaccattattgctgacaacatcacaccataatgcattaaggacaccagatgttgataacccagagcaaccttttgatgctctaaatattgaagaatgctctttgacacaacaaaataaaagcactgttgacgtggcatttcaggatcccagtgcagtttacagtgagcttattctgtggagggttgacccagttgggccattgtctttttctggaggagtttctgagcttgcccggattaattctcttcatgtttctgccttttccaatgtggcatggctgcccactcttatacccagttattgtctgggtgcatactgcaactctcctagtgcatgctttgtagccagtgatggacaatatctgagattatatgaagcagttattgatgctaagaaacttttatctgagctttctaaccctgaaatttctaaatatgttggtgaagtctttaacatcgtcagtcaacaatcaacagccaggccaggatgcattattgcattagatcccattaccaaacttcatggcagaaaaacccaactgcttcatgtttttgaagaagacttcattttgaataaccttgagaagaaaagccttggcaaagacagcattttatctaatgcaggcagctcacctaatggattttctgagaagttctacctaattgtaatagaatgcactcaagacaaccgttcactgttacacatgtggaatttacatctaaagtcaattcctgtctcattagatgaaaaagtagatacaaaattatccgaagcggtttggcagccagaagaacattattcttcttctccagagaagatcctatctcctttttcacaaaagtatcaggcttgcagagcaaatctccagagtaccagcaggttgactctgttttcagaaatggtttatagccaagaattgcatttaccagaaggagttgagataataagtattaagccatcagcaggacatctgagttcatcttctatatatcctgcatgcagtgctccttatttattggcaacttcatgttcagatgagaaagtaagattctggagatgcagagtaacagatggagaatctgccacgtcaaagaatggaaaaattgatcttgcatacatttgggaagaatggccattacttattgaagatggacttcagagcaatagtagtataactgtacctggtaggcctgtagaagttagctgtgcacatacaaatcgtttagcagtagcttataagcagcctgcatctaatagtagatcttcccaggactttgtgatgcatgtaagtatttttgaatgtgagtcaacaggaggttcatgttgggtccttgagcagacaattcatttagatgagttaagcacagtattggattctggcattagtgttgatagcaatttagtggcctataataaacaagacatgtatttatctagtaaagagaatatcacatcaaacacaaagcatttagttcacttagattggatgtctagagaagacggttctcatatcctgactgtaggaattggatcaaaactttttatgtatggacccctggctggcaaggtacaagaccaaactggtaaggaaaccctggcatttcctctctgggagagtaccaaagttgtgcccctttctaaatttgtactattacgaagtgtggacctagtttcttctgtagatggctccccaccttttcctgtttctttatcgtgggtccgggatggcatccttgtggtaggaatggactgtgaaatgcatgtgtattgccaatggcaaccatcttctaaacaagaacctgttataacagattcgtacagtgggagcactccatctataacaagtttaataaaacagagtaactccagttctgggttacatcctccaaagaaaactctgactcgatccatgaccagtcttgcacagaaaatctgtggaaagaaaactgcattcgatccttcagtggatatggaagattcaggtctttttgaagcagctcatgtactttccccgactctacctcagtatcatcccttgcagcttttggaactcatggatcttggtaaagttcggagagccaaggccatcttgtcccatcttgttaagtgcattgctggggaagttgtggctctgaatgaagctgaatctaatcatgaacgccgccttaggtctctcacaatcagtgctagtggaagcactaccagagacccccaggcattcaacaaggctgaaaatacagattacacagaaatagattctgttcctccacttcctttatatgccttacttgcagcagatgatgatagctgttactcatctttggagaaatctagtaatgagagtacgttaagtaaatcaaaccaattatctaaagaaagttatgatgagctttttcagactcaacttctaatgactgatactcatatgttagagacagatgaagaaaatacaaagcctagagttattgacctttcacagtacagtccgacttactttggacctgagcatgctcaggttctttctggccacttacttcattctagtttaccaggactcagccggatggagcagatgtctttgatggccttagcagatacaattgcaactacaagcactgatattggagaaagccgagacagaagccaaggtggagaaactcttgatgaatgtgggttaaaatttcttttggctgttcgactccatacctttcttacaacttcccttccagcctatcgagctcaactccttcaccaaggcctgtctacaagtcattttgcttgggcatttcactcagtagcagaagaagaactgctgaacatgttgccagccatgcagaaagatgatcccacttggtctgaactaagagctatgggtgtggggtggtgggtccggaatacccgcatcttacgcaaatgcatagaaaaagtagctaaagcagccttttatagaaagaatgatcctttagatgctgccattttttaccttgcaatgaaaaagaaagctgtgatttggggattatatagagctgaaaaaaacaccaggatgacacagttttttggacacaattttgaggatgagaggtggcgtaaagcagctttaaagaatgctttttctttgctaggcaaacaaagatttgaacattctgcagcattttttcttttagctggttgcctcagagatgcaattgaggtatgtcttgagaaattgaatgacattcagttggctcttgtaatagcaagactctatgagtctgaatttgatacatctgcagcatataaatctattttacgtaaaaaagttttgggaatcgattctcctgtcagtgaactgtgttcattgaacataaatatgcatcatgatccttttcttcggagcatggcatattggattttggaagattatagtggtgctctggaaacattaataaagcaacctatcagagagaatgatgatcaagttttatcagccagtaatcctacagtttttaatttctacaattatctaagaacacatcctcttttgctgagacgtcattttggatcatctgatacattttccacacatatgagcctaacaggaaaaagtggactggcaggaacaattaatttaagtgaaagacgtttattttttaccactgccagtgctcatttaaaagctggctgcccaatgttggctttggaagtattatcaaagatgcctaaagtcatcaagaaaacaagacctttttatagggcttctagttttctggatactagtaaagactgttctccttcttctccattaaagttggatgcaagggaagataagtcttctgctgttgattggtcacagtcactgataaatggttttggatcttcttcagagggttcctcagagaagcaatcaaactccactctttcttttgactggagccaaccaagtgttgtgtttcaggatgactctttagagttaaaatgggacagtgataatgatgaagaaaatgaggatgtccctatttcaatgaaagaactaaaacctttacagagaaaaacagataaaaagttggatgacataagttctaactacacagaatctttcagcacactagatgaaaatgaccttttaaatccatcagaagatataattgcagttcagttaaaatttagagcatgtttaaagattctcacagtagaacttcgtactttatctactggctatgaaatagatggtggaaaattgcgttaccaactataccactggcttgaaaaagaggtgatagctcttcagaggacttgtgacttttgctcagatgctgaagaactacagtctgcatttggcagaaatgaagatgaatttggattaaatgaggatgctgaagatttgcctcaccaaacaaaagtgaaacaactgagagaaaattttcaggaaaaaagacagtggctcttgaagtatcagtcacttttgagaatgtttcttagttactgcatacttcatggatcccatggtgggggtcttgcatctgtaagaatggaattgattttgcttttgcaagaatctcagcaggaaacatcagaaccactattttctagccctctgtcagagcaaacctcagtgcctctcctctttgcttgtacagccaatgccaaaacagtagttgccaatccattattgcaccttagtaatctgacacatgatattctccatgccataataaactttgattcaccaccccaccctgatatccaaagcaataaagtgtatgtaatgcatactttagcagcttcactttctgcttgtatttatcagtgcctttgtggtagtcataactacagttcatttcagacgaatcagtttactggaatggtatatcagacagtactgcttcctcatcgaccttctttgaaaacaggaagcttagatgaagcattaactcccaatacgtcaccagctcaatggccaggaataacttgtctaattcgacttttgaattcttctggcgaggaagcccagtcagggcttacagtcttgctctgtgagattctcacagcagtgtatcttagtctcttcatccatggcctggccacacattcaagtaatgagctatttcggattgtggcccatcctctaaatgagaaaatgtggtctgctgtgtttggtggaggtgcacatgttcctagcaaagaacagacacattcaaaaactttacctgtttcttcactagttgaagaaggagaaaaacagaacaaacgttttaggccgtcaaaaatgtcttgcagagaatctgccccactgaccccttcctcggcaccagtaagccaggagtcactggcggttaaagaaaagttcatcccacctgagctcagtatctgggactatttcatagctaagccttttctaccctcttctcaaagtagagccgaatatgattcagaggagagtctgggaagtgatgatgatgacaatgatgatgatgatgatgttttagcatcagatttccatctccaggaacattctaattcaaattcatatagttggtccttgatgcggttggcgatggtgcaattggtgctcaacaatttgaagactttttatcccttcgcaggtcatgatcttgcagagcttccagttagttcacctctttgtcatgcggttctaaaaactcttcaatgttgggaacaagttcttctccgacgacttgaaatccatggtgggccacctcaaaattatatcgcaagtcataccgccgaagagagtttgtctgcaggtcctgcaattcttcgccacaaagctttactggaacctacaaacactcctttcaaatccaaacaccatctggcactgtctgtgaagaggctttggcagtatttggtgaagcaggaagaaattcaggaaacctttatcaaaaatatattcacaaagaaacggtgtctaaatgagtcattagaggacaacagtgaaaccatcaaaaattctatgatggaggagccaaacatcaataagatagaagcagatttgggatatcctggaggtaaagcaagaattattcataaggaatctgatatcattactgcgtttgctgttaataaggcaaatagaaactgcatagcaatcgcttccagtcatgatgttcaagaactggatgtttctggaattctggccacacaggtctacacttgggtagatgatgatatagaagtggaaaccaaaggatcagaagatttcttggttatacatgctcgtgatgatttaacagctgttcaaggtacaactccatatacacatagcaatcctggcactccaatcaacatgccatggcttggtagtacacagactggcagaggagcatctgtgatgattaagaaagccattaataatgttagaagaatgacttctcatccaactcttccttactatctgacaggagctcaagatggaagtgtcagaatgtttgaatggggccattctcaacaaataacctgttttcgatctggtggcaattcaagagttacaagaatgagatttaactatcagggaaataagtttggaatagttgatgctgatggatatttaagtttgtatcaaacaaactggaaatgttgtccagttactggaagcatgcctaagccatacctgacttggcagtgtcataacaaaacagccaatgattttgtcttcgttagttcctcctctctgatagctacagctggtctttcaactgacaatagaaacgtatgtttgtgggatactcttgtagcacctgccaatagtttagtccatgcatttacctgccatgacagtggagccacagttttagcatatgctccaaaacatcagctactaatatcaggtggcagaaaaggttttacatatgtatttgacctttgtcaacgacaacagaggcagcttttccagagccatgattctcctgttaaagccgttgctgttgatccaactgaagagtactttgttacaggatctgccgaaggcaatataaagatttggagtctctctacctttggtcttctccatacttttgtcagtgaacatgctcggcagtccatttttagaaatattggaactggagtgatgcaaattgagacagggcctgcaaatcacattttctcctgtggagctgatggaacaatgaaaatgagaatactgccagatcagtttagccctttaaatgaagtgttgaaaaatgatgtgaaatttatgctataacatttttacaataagatgtacaatttattacctatatggaagtggccaacagatataatatacagtgatcattctctatgccacaaattagctaatgctttcttgtttttatatttattttatggagctttgcccttgatgcactg

SEQ ID NO: 8596 - DNA, 10672 bp, Homo sapiens
acaagcacccttgccctcccgcatttgtgcgccggtgcagcaggcagtgggaacatccgggcatttccgcagctgagcggcgacccgggcggcggcggcggtcgaggagctcccatggcagggacgaggcggagggaaggcgaaaggggggcgaggagttaagccagagcctccgcggggcgggtttccgagggaggcacagagggaaacggctctcgcagcccgaggagggtcaggcgcggagcttgtcgcacctcccgcgcattctgtccagcccgggctccggagatgcatctgcatcaggtcctcaccggagctgtcaaccctggagacaactgctactccgtgggcagcgtcggggatgtccccttcacggcatatggatcaggctgtgatattgttattttggcaaatgactttgaatgtgtacagatcattcctggtgctaagcatggaaacatccaagtcagctgtgtggagtgttctaaccaacaaggaagaattgcagcttcatatggtaatgctgtttgtatatttgagcccttgggcataaattctcataaaagaaattgtcaactcaagtgccagtggcttaaaactgggcagttttttttgagttctgtgacatacaacttagcatgggatcctcaagataatagattgttgacagcaactgattctattcagttgtgggctcctccaggagatgatattctggaagaggaggaagaaattgataatacagttcctcctgttttaaatgattggaagtgtgtctggcagtgcaaaacctcagtatctgtacatttgatggaatggtctcctgatggtgaatattttgctactgctggaaaggatgattgtcttttgaaagtgtggtatcctatgactggttggaagtcttcaattatacctcaggatcatcatgaagtaaaaaggagacagtcctctactcaattttcttttgtttacttggcacatccccgagctgtgacaggtttttcgtggcgcaaaactagcaagtatatgcccaggggttctgtctgtaatgtgttgttaacttcatgtcatgatggtgtgtgccggctctgggcagaaactttattaccagaagactgtcttttgggtgagcagatttgtgagactaccacttccagcattgccagcagcctttctcatgctggaagacacaaagacagaatacagcatgctcttgagacaatacaccatttgaaaaatttaaggaaaggacagaggaggtcatctgttcttgtaactcatgctgaattaatgcccgaccagacagcaatgcatgaagttcaaagacacatttcccaccatgcaaatgcactctgtcattttcatattgcagcaagcatcaaccctgccacagatattccaaatgtcttggttggcactgcatttaatgttgatgatggaaatgggggctttgtagttcattggttaaacaacaaggaatttcattttacatcatctacagaagtatttatgcatcaattacgaaaactttctgataagcaggtagatcatgaaaatgatgatgcagatagagaagatgaggaacattcacaggaggatagagaacggggtttacatatgaaattagaccatgatttatccctggatagagaatctgaggcaggtacaggatcatcagaacatgaagatggagaaagagaaggaagtcctagaacttactcacgacttagtgtaccaatgccactgcctacggttctgcttgatcggaagattgaaacgctgctaactgaatggaataagaatcctgatatgctttttacaatacaccctgtagatggtacctttctagtgtggcatgtgaagtatttggatgaatataatcctggaatatttagacaagttcaggtttctttttcttctcggattcctgttgcatttccctctggtgatgcaagctctcttagtaaaaatatcatgatgtatgcctgtataaatgcgacaaaagattctcaccacacgctgttacaccaggaggggatgtctgtaggcagtcctcacggatcacagccacactctagatcccacagtacacatatgaacatcttagctcccacagtaatgatgatctctaaacacatagatggttctttaaatcagtgggcagtcacttttgctgataagtctgcctttaccactgttctaactgtatctcacaaatttagatattgcggtcatcgatttcacctcaatgacctggcatgtcattcagttttaccactgttattgacatcctctcatcataatgctctattgactcctgaattagattgtcagtgggactcagacaataaattaagtagattaatggaccctgtaaaacatataaaaggttcctcgaaacaacctcttagaaatgcagcaactcgtacatttcatgacccaaatgcaatctacagtgaacttattctgtggcgtgtagacccaataggacctttgtcatacactggaggagtatcagaattggctcgaattaactctttacatacctcagcgttctctaatgtggcttggcttccaactctcattcccagttactgtctaggcacatactgcaattctgcaagtgcttgctttgttgcttctgatggcaaaaatctgagactctatcaagctgtagtggatgcaaggaaattattagatgaattgtcagacccagaatcttcaaaacttattggagaagtgtttaatattgtgagccaacagtctactgctcgacctggctgcattattgaactcgacgcaataaccaaccaatgtggctcaaatacacagttgcttcatgtgtttcaagaagacttcattataggatataaaccacataaggaagatatggagaaaaaggaaacagaaatattttttcagccatcacaaggataccgcccaccaccattttcagaaaagttctttctagtagtaattgagaaggacagcaataataactctattctgcatatgtggcaccttcatcttaaatctgtacaagcatgtttagctaaagcttcagaaggggcttcctctgagagtctactttcagtccctggacagaagaacgtagattcttctccagaaacctctcctagtgtgagccccatgccacattcttcatcaattgccaatcttcaaactgccagtaaacttattctgagttctagactggtgtatagccaaccccttgatctcccagaatcagttgaagtaataagagcaacgccttcagcaggccatctgagttcttcttcaatttatccagtgtgccttgcaccttatttagtggttacaacttgttctgacaataaagtacgcttctggaaatgttgtatggaagccaacccagagtgtaataaaagtgatgagaaagaaatttatcattggaagagatggcctttgatgaatgatgaaggagaagataatagcagtacagtgagcattgtgggaagaccagttgctgttagctgttcatacacaggtcgccttgcagtggcttataagcagcctatccaccataatggttttgtttctaaagaattttccatgcatgtttgtatatttgaatgtgaatctacaggaggatcagagtgggttttagaacaaacaattcatcttgatgatttggttaaggttgggagtgtacttgattcaagggtcagcgtcgacagtaatctgtttgtgtatagcaagtcagatgcactcttgagcaaggatagatatcttattccgaatatcaaacatttagtacatttggactgggtatcaaaagaagatggctcccacattcttacagtgggagtcggtgcgaatatcttcatgtatggaaggctttcaggaattgtgactgagcaaaccaacagtaaggatggagtagctgtcatcactttaccactaggtggtagtatcaagcaaggagttaagtcaagatgggttcttcttagatctatagacttggtatcttctgttgatggtactccttcactgcctgtttctctctcttgggtaagagatgggatattggtggtaggaatggattgtgaaatgcatgtatatgcacagtggaagcatgctgtcaaatttggagacactgaagctgatagttctaatgcagaagaggcagcaatgcaagatcattcgacctttaaatctaatatgctggcaagaaaaagtgttgttgaaggaacagctatttctgatgatgttttttgttcaccaactgtaattcaagatggtggcttatttgaggctgcacatgtactttcccctactcttccacaatatcatccaactcagctgttagaattgatggatttagggaaagtgcgaagggctaaagccattctctctcatttagtaaaatgtattgcaggtgaagtagcaatagttagagatcctgatgctggagaaggaactaagcgacatctctctcgaactattagtgtaagtggcagtacagcaaaggaaacagtcaccgtaggaaaagatggtactcgagattatactgagatagattctatccctccactaccactatatgcattacttgctgcagatcaagatacatcctacagaatttcagaagaaagtacaaagataccacagagctatgaagatcagacagtaagtcaaccagaggatcagtattcagagctgtttcaaatccaggatataccaacggatgatattgatttagagcctgaaaagagagaaaacaaatcaaaagtaataaatctttctcaatatggaccagcttactttggccaagaacatgcaagggtactttcaagtcatcttatgcactcaagtctaccaggccttacccgtttggagcagatgttccttgtagctttggctgatacagtggctactactagtactgagcttgatgaaagcagagataagagttgctcaggaagagatacattagatgagtgtggtttgagatacttgttagctatgcgcctacacacatgccttttgacatcgctgcctcctttataccgagtgcagctacttcatcaaggtgtctctacatgccattttgcctgggcttttcattctgaggctgaagaagaactgattaatatgattccagcaattcagagaggggacccccagtggtctgaattaagagctatgggcataggatggtgggtgaggaacattaacacgcttcgaagatgcattgaaaaggttgccaaagcttcttttcaaaggaacaatgatgccttagatgctgcactattctacctttcaatgaagaagaaagcagtagtgtggggtctgtttaggtcacagcatgatgaaaaaatgacaacatttttcagccacaactttaatgaagatagatggcgaaaagctgctttgaaaaatgctttttccttacttggaaaacaacgctttgaacaatcggctgcttttttcttgctagctggttcattgaaagatgccatagaggtatgtcttgaaaaaatggaagatattcagctagccatggttattgcccgtttatatgaatctgaatttgagacttcatccacttatatatccatcctaaatcagaagattttgggttgccaaaaggatggctcaggattcagttgcaaaagattacatcctgatcctttcctgcgtagtcttgcctattgggtaatgaaagattacacccgagccttggacacattactggaacaaacaccaaaggaggatgatgaacatcaagttatcatcaagtcttgtaacccggtggcatttagtttttataactaccttcgaactcatcctttgctcattcgaagaaatcttgcctcccctgaaggaactttggcaaccttaggtctcaaaactgagaagaactttgttgataaaattaacctcatagaaagaaaattattctttaccactgcaaatgctcattttaaagttggatgccctgttttagccttggaggtactctccaaaattccaaaagtaaccaaaacatctgccttatctgcaaaaaaagatcagcctgacttcatttctcacaggatggatgatgtaccttcacattcaaaagctctgagtgatggcaatggaagttctggcattgaatggtcaaatgtaacttcatcacagtatgactggagtcagccaatagtaaaagttgatgaggaacctcttaatcttgattggggtgaagatcacgacagtgccttagatgaagaggaagacgatgctgttggtttagtgatgaaaagtacagatgccagggaaaaagataaacaatcagatcagaaggcctcagaccctaacatgttattaacacctcaggaagaggatgatcctgaaggtgatactgaagttgatgtgattgctgaacaactaaaattcagagcttgtttaaagatccttatgactgaattaagaacattggctacaggttatgaagtagatggaggaaaactcagatttcaactctataactggcttgaaaaggaaattgctgccttgcatgagatatgtaatcatgaatcagttattaaagagtattccagtaagacatattccaaagtagagagtgatctgctggatcaggaagaaatggtagacaaaccagatattggttcctatgagcgccatcaaatagaaagaagaagattgcaggccaaacgagagcatgcagaaagacgaaagtcgtggttgcagaaaaaccaagatctcctgagagtatttctcagctactgtagccttcatggggcccaaggtggtggtttggcttcagtaaggatggaactcaaatttttgctacaagaatcacaacaggaaactacagtaaagcagctccagtctccactaccactgcctaccaccctacctctgctttcagcaagtattgcgtcaacaaaaacagtcatagctaatcctgtattgtacttaaataatcacatccatgatatactttatactattgttcagatgaaaacaccacctcatcccagtattgaagatgtgaaggtgcacacacttcattcactagcagcatcactttctgcatcaatttaccaagcattatgtgacagtcatagctacagtcaaacagaaggaaatcagtttacaggaatggcttatcaaggacttcttttaagtgatcgtagaagactaaggacagaaagcattgaagaacacgcaacaccaaattcatctcctgctcaatggcctggtgtgagctcacttattaatcttttgagttcagcccaagatgaagaccagccaaaactgaacattttgctatgtgaagctgttgttgctgtttacttaagtttattgatacatgctcttgccacaaattcctccagtgaattatttcggcttgcagcccacccattaaataatcgaatgtgggctgctgtttttggaggcggtgtaaaacttgttgtgaaacctcgaagacaatcagaaaatatttcagcacctcctgtcctttctgaagacatagataaacaccgtaggagatttaacatgagaatgctcgtccctggaaggcctgtaaaagatgctaccccaccaccggtgcctgcagaaagaccatcttacaaagaaaaatttattcctcccgaacttagtatgtgggattattttgttgcaaagccatttcttcctttgtctgatagtggtgttatatatgattctgatgaaagcattcatagtgatgaagaagatgatgcctttttttcagatacacaaatacaggagcaccaagatccaaattcctatagctgggctcttctacatttgacaatggttaaactagcacttcacaatgtcaagaatttctttcctattgctggactggaattctctgagctgcctgtaacatcaccattaggtattgctgtgattaaaaacttggagaactgggaacagatcttgcaagagaaaatggatcagtttgaaggtccaccccctaactatatcaacacatatccaactgacctttcagtgggagctggaccagctattcttcgaaataaagcaatgctagaacctgaaaataccccattcaagtcccgggattcttctgcatttccagtcaaacgactttggcatttccttgttaaacaagaggtccttcaagagacatttattagatatattttcactaagaaaagaaagcagagtgaggttgaagctgatctgggctatccaggtggaaaggcgaaagtcatccataaggaatctgatatgatcatggcattttctgttaataaggcaaattgtaatgaaattgttttggcttcaacacatgatgttcaagaacttgatgttacttctctactggcctgtcagtcatacatatggatcggagaagaatatgacagagaatccaaaagttcagatgatgttgattatcgtggttccactacaactctttatcaacccagtgcaacatcctattcagcaagtcaggtgcatccaccttcatctctgccatggctgggcactggacagactagcactggagctagtgtgcttatgaaaaggaatctacataatgttaagagaatgacttcacacccagtccatcaatactatcttacaggtgctcaggacggcagtgtacgaatgtttgaatggacgcggcctcagcaacttgtctgctttcgtcaagctggcaatgcaagagttactagattatattttaattcacaaggcaacaagtgtggtgttgcggatggagagggttttctgagtatctggcaagttaaccaaactgcatcaaatcctaaaccttatatgagttggcagtgccacagtaaagccacaagtgactttgcatttattacctcttcaagtctagttgccacatctggacactccaatgacaatagaaatgtttgcctctgggacacattaatatcacccggaaacagcctcattcatggtttcacgtgccacgatcatggtgccacggtactgcagtatgcacccaaacagcaactcctaatctcggggggtaggaaaggacacgtctgcatttttgacatcaggcaaaggcagctcattcacacgttccaggcccatgactcagctattaaggctctggccttggatccctatgaggaatattttaccacaggttcagcagaaggtaacataaaggtttggagattgacaggccatggcctaattcattcatttaaaagtgaacatgctaagcagtccatatttcgaaacattggggctggagtcatgcagattgacatcatccagggcaatcggctcttctcctgtggtgcagatggcacgctgaaaaccagggttttgcccaatgcttttaacatccctaacagaattcttgacattctataaagattggggttttatttttatatacatttcagttaaaaggcacactacagtcatcactaggcaattctgctttctaagcagttgtattgaaaacagagaatctctgtgtagaatttgaatatgacccaagctgagtattatctaaacaggttggtggaatgaatgcgcatgtaccttattatgctgacatactaaaaaaaataaaacctagtattgtatgaaggatagctattctttacagcatttagcaaacctgattcagaaaacatttgagattagcaaattagtaacttgaaataatgaaaaggacgtttataccaaattaaggaagaaaatgttgctgatttgggtttttcttcctgttcttaccactgactgaagcatgcctgcagtctcctcctctgttgaatgaaggataatcataaggtgtttgttaggagcgctagaccacctggaaaactttcttagctgtggagcagtgcgcagtgaccagttctctgctgtgagaggccgtttccattctttcctgctgaatatttttcctgttagtgtttatactgagctagtactgtaacttgcaaatgagtgcaaatttaaatgcaatgttttactcacaatttgcacattcacattttttggactgctagtttttctatttaaatatttgccttcatgttaggaatgtactatgtgaacatgacatatttgtagttaaccaaacacaccttcttagtccagtttagtactttttcttttcgtgtattcaaggttaaacacccaaacatttaaggatatgttgaaactacaccaatagagcatttcatatcataattaaaatgaatgttaggcttcttgtggccagttaatagttgatgagattggtgacattatttattgccacagcctattgtataaactatgcagagttaaatatttgcttgtaaaatattagccaatgttgtcattattttgatgtatttccttggttatgaccaaaaatatgttgagatactgaaactaatgtctgtgtgtttaaatgtttaccagcaaattgtcttatcatgttaatgagaatgttcaatgcctgtgtggtaaatagtaaatacaatggcataaaagtaactttctctgaagatgtgatgttcaggctgtgaaatatatatgtaaaagaaaaataaatgttatttgttagagtttttagtttgatactgtttttgaccattgagatttttaatttgataaaatgtttaactgttagagaatttgcaagcta

SEQ ID NO: 8597 - DNA, 10659 bp, Homo sapiens
tttccgcagctgagcggcgacccgggcggcggcggcggtcgaggagctcccatggcagggacgaggcggagggaaggcgaaaggggggcgaggagttaagccagagcctccgcggggcgggtttccgagggaggcacagagggaaacggctctcgcagcccgaggagggtcaggcgcggagcttgtcgcacctcccgcgcattctgtccagcccgggctccggagatgcatctgcatcaggtcctcaccggagctgtcaaccctggagacaactgctactccgtgggcagcgtcggggatgtccccttcacggcatatggatcaggctgtgatattgttattttggcaaatgactttgaatgtgtacagatcattcctggtgctaagcatggaaacatccaagtcagctgtgtggagtgttctaaccaacaaggaagaattgcagcttcatatggtaatgctgtttgtatatttgagcccttgggcataaattctcataaaagaaattgtcaactcaagtgccagtggcttaaaactgggcagttttttttgagttctgtgacatacaacttagcatgggatcctcaagataatagattgttgacagcaactgattctattcagttgtgggctcctccaggagatgatattctggaagaggaggaagaaattgataatacagttcctcctgttttaaatgattggaagtgtgtctggcagtgcaaaacctcagtatctgtacatttgatggaatggtctcctgatggtgaatattttgctactgctggaaaggatgattgtcttttgaaagtgtggtatcctatgactggttggaagtcttcaattatacctcaggatcatcatgaagtaaaaaggagacagtcctctactcaattttcttttgtttacttggcacatccccgagctgtgacaggtttttcgtggcgcaaaactagcaagtatatgcccaggggttctgtctgtaatgtgttgttaacttcatgtcatgatggtgtgtgccggctctgggcagaaactttattaccagaagactgtcttttgggtgagcagatttgtgagactaccacttccagcattgccagcagcctttctcatgctggaagacacaaagacagaatacagcatgctcttgagacaatacaccatttgaaaaatttaaggaaaggacagaggaggtcatctgttcttgtaactcatgctgaattaatgcccgaccagacagcaatgcatgaagttcaaagacacatttcccaccatgcaaatgcactctgtcattttcatattgcagcaagcatcaaccctgccacagatattccaaatgtcttggttggcactgcatttaatgttgatgatggaaatgggggctttgtagttcattggttaaacaacaaggaatttcattttacatcatctacagaagtatttatgcatcaattacgaaaactttctgataagcaggtagatcatgaaaatgatgatgcagatagagaagatgaggaacattcacaggaggatagagaacggggtttacatatgaaattagaccatgatttatccctggatagagaatctgaggcaggtacaggatcatcagaacatgaagatggagaaagagaaggaagtcctagaacttactcacgacttagtgtaccaatgccactgcctacggttctgcttgatcggaagattgaaacgctgctaactgaatggaataagaatcctgatatgctttttacaatacaccctgtagatggtacctttctagtgtggcatgtgaagtatttggatgaatataatcctggaatatttagacaagttcaggtttctttttcttctcggattcctgttgcatttccctctggtgatgcaagctctcttagtaaaaatatcatgatgtatgcctgtataaatgcgacaaaagattctcaccacacgctgttacaccaggaggggatgtctgtaggcagtcctcacggatcacagccacactctagatcccacagtacacatatgaacatcttagctcccacagtaatgatgatctctaaacacatagatggttctttaaatcagtgggcagtcacttttgctgataagtctgcctttaccactgttctaactgtatctcacaaatttagatattgcggtcatcgatttcacctcaatgacctggcatgtcattcagttttaccactgttattgacatcctctcatcataatgctctattgactcctgaattagattgtcagtgggactcagacaataaattaagtagattaatggaccctgtaaaacatataaaaggttcctcgaaacaacctcttagaaatgcagcaactcgtacatttcatgacccaaatgcaatctacagtgaacttattctgtggcgtgtagacccaataggacctttgtcatacactggaggagtatcagaattggctcgaattaactctttacatacctcagcgttctctaatgtggcttggcttccaactctcattcccagttactgtctaggcacatactgcaattctgcaagtgcttgctttgttgcttctgatggcaaaaatctgagactctatcaagctgtagtggatgcaaggaaattattagatgaattgtcagacccagaatcttcaaaacttattggagaagtgtttaatattgtgagccaacagtctactgctcgacctggctgcattattgaactcgacgcaataaccaaccaatgtggctcaaatacacagttgcttcatgtgtttcaagaagacttcattataggatataaaccacataaggaagatatggagaaaaaggaaacagaaatattttttcagccatcacaaggataccgcccaccaccattttcagaaaagttctttctagtagtaattgagaaggacagcaataataactctattctgcatatgtggcaccttcatcttaaatctgtacaagcatgtttagctaaagcttcagaaggggcttcctctgagagtctactttcagtccctggacagaagaacgtagattcttctccagaaacctctcctagtgtgagccccatgccacattcttcatcaattgccaatcttcaaactgccagtaaacttattctgagttctagactggtgtatagccaaccccttgatctcccagaatcagttgaagtaataagagcaacgccttcagcaggccatctgagttcttcttcaatttatccagtgtgccttgcaccttatttagtggttacaacttgttctgacaataaagtacgcttctggaaatgttgtatggaagccaacccagagtgtaataaaagtgatgagaaagaaatttatcattggaagagatggcctttgatgaatgatgaaggagaagataatagcagtacagtgagcattgtgggaagaccagttgctgttagctgttcatacacaggtcgccttgcagtggcttataagcagcctatccaccataatggttttgtttctaaagaattttccatgcatgtttgtatatttgaatgtgaatctacaggaggatcagagtgggttttagaacaaacaattcatcttgatgatttggttaaggttgggagtgtacttgattcaagggtcagcgtcgacagtaatctgtttgtgtatagcaagtcagatgcactcttgagcaaggatagatatcttattccgaatatcaaacatttagtacatttggactgggtatcaaaagaagatggctcccacattcttacagtgggagtcggtgcgaatatcttcatgtatggaaggctttcaggaattgtgactgagcaaaccaacagtaaggatggagtagctgtcatcactttaccactaggtggtagtatcaagcaaggagttaagtcaagatgggttcttcttagatctatagacttggtatcttctgttgatggtactccttcactgcctgtttctctctcttgggtaagagatgggatattggtggtaggaatggattgtgaaatgcatgtatatgcacagtggaagcatgctgtcaaatttggagacactgaagctgatagttctaatgcagaagaggcagcaatgcaagatcattcgacctttaaatctaatatgctggcaagaaaaagtgttgttgaaggaacagctatttctgatgatgttttttgttcaccaactgtaattcaagatggtggcttatttgaggctgcacatgtactttcccctactcttccacaatatcatccaactcagctgttagaattgatggatttagggaaagtgcgaagggctaaagccattctctctcatttagtaaaatgtattgcaggtgaagtagcaatagttagagatcctgatgctggagaaggaactaagcgacatctctctcgaactattagtgtaagtggcagtacagcaaaggaaacagtcaccgtaggaaaagatggtactcgagattatactgagatagattctatccctccactaccactatatgcattacttgctgcagatcaagatacatcctacagaatttcagaagaaagtacaaagataccacagagctatgaagatcagacagtaagtcaaccagaggatcagtattcagagctgtttcaaatccaggatataccaacggatgatattgatttagagcctgaaaagagagaaaacaaatcaaaagtaataaatctttctcaatatggaccagcttactttggccaagaacatgcaagggtactttcaagtcatcttatgcactcaagtctaccaggccttacccgtttggagcagatgttccttgtagctttggctgatacagtggctactactagtactgagcttgatgaaagcagagataagagttgctcaggaagagatacattagatgagtgtggtttgagatacttgttagctatgcgcctacacacatgccttttgacatcgctgcctcctttataccgagtgcagctacttcatcaaggtgtctctacatgccattttgcctgggcttttcattctgaggctgaagaagaactgattaatatgattccagcaattcagagaggggacccccagtggtctgaattaagagctatgggcataggatggtgggtgaggaacattaacacgcttcgaagatgcattgaaaaggttgccaaagcttcttttcaaaggaacaatgatgccttagatgctgcactattctacctttcaatgaagaagaaagcagtagtgtggggtctgtttaggtcacagcatgatgaaaaaatgacaacatttttcagccacaactttaatgaagatagatggcgaaaagctgctttgaaaaatgctttttccttacttggaaaacaacgctttgaacaatcggctgcttttttcttgctagctggttcattgaaagatgccatagaggtatgtcttgaaaaaatggaagatattcagctagccatggttattgcccgtttatatgaatctgaatttgagacttcatccacttatatatccatcctaaatcagaagattttgggttgccaaaaggatggctcaggattcagttgcaaaagattacatcctgatcctttcctgcgtagtcttgcctattgggtaatgaaagattacacccgagccttggacacattactggaacaaacaccaaaggaggatgatgaacatcaagttatcatcaagtcttgtaacccggtggcatttagtttttataactaccttcgaactcatcctttgctcattcgaagaaatcttgcctcccctgaaggaactttggcaaccttaggtctcaaaactgagaagaactttgttgataaaattaacctcatagaaagaaaattattctttaccactgcaaatgctcattttaaagttggatgccctgttttagccttggaggtactctccaaaattccaaaagtaaccaaaacatctgccttatctgcaaaaaaagatcagcctgacttcatttctcacaggatggatgatgtaccttcacattcaaaagctctgagtgatggcaatggaagttctggcattgaatggtcaaatgtaacttcatcacagtatgactggagtcagccaatagtaaaagttgatgaggaacctcttaatcttgattggggtgaagatcacgacagtgccttagatgaagaggaagacgatgctgttggtttagtgatgaaaagtacagatgccagggaaaaagataaacaatcagatcagaaggcctcagaccctaacatgttattaacacctcaggaagaggatgatcctgaaggtgatactgaagttgatgtgattgctgaacaactaaaattcagagcttgtttaaagatccttatgactgaattaagaacattggctacaggttatgaagtagatggaggaaaactcagatttcaactctataactggcttgaaaaggaaattgctgccttgcatgagatatgtaatcatgaatcagttattaaagagtattccagtaagacatattccaaagtagagagtgatctgctggatcaggaagaaatggtagacaaaccagatattggttcctatgagcgccatcaaatagaaagaagaagattgcaggccaaacgagagcatgcagaaagacgaaagtcgtggttgcagaaaaaccaagatctcctgagagtatttctcagctactgtagccttcatggggcccaaggtggtggtttggcttcagtaaggatggaactcaaatttttgctacaagaatcacaacaggaaactacagtaaagcagctccagtctccactaccactgcctaccaccctacctctgctttcagcaagtattgcgtcaacaaaaacagtcatagctaatcctgtattgtacttaaataatcacatccatgatatactttatactattgttcagatgaaaacaccacctcatcccagtattgaagatgtgaaggtgcacacacttcattcactagcagcatcactttctgcatcaatttaccaagcattatgtgacagtcatagctacagtcaaacagaaggaaatcagtttacaggaatggcttatcaaggacttcttttaagtgatcgtagaagactaaggacagaaagcattgaagaacacgcaacaccaaattcatctcctgctcaatggcctggtgtgagctcacttattaatcttttgagttcagcccaagatgaagaccagccaaaactgaacattttgctatgtgaagctgttgttgctgtttacttaagtttattgatacatgctcttgccacaaattcctccagtgaattatttcggcttgcagcccacccattaaataatcgaatgtgggctgctgtttttggaggcggtgtaaaacttgttgtgaaacctcgaagacaatcagaaaatatttcagcacctcctgtcctttctgaagacatagataaacaccgtaggagatttaacatgagaatgctcgtccctggaaggcctgtaaaagatgctaccccaccaccggtgcctgcagaaagaccatcttacaaagaaaaatttattcctcccgaacttagtatgtgggattattttgttgcaaagccatttcttcctttgtctgatagtggtgttatatatgattctgatgaaagcattcatagtgatgaagaagatgatgcctttttttcagatacacaaatacaggagcaccaagatccaaattcctatagctgggctcttctacatttgacaatggttaaactagcacttcacaatgtcaagaatttctttcctattgctggactggaattctctgagctgcctgtaacatcaccattaggtattgctgtgattaaaaacttggagaactgggaacagatcttgcaagagaaaatggatcagtttgaaggtccaccccctaactatatcaacacatatccaactgacctttcagtgggagctggaccagctattcttcgaaataaagcaatgctagaacctgaaaataccccattcaagtcccgggattcttctgcatttccagtcaaacgactttggcatttccttgttaaacaagaggtccttcaagagacatttattagatatattttcactaagaaaagaaagcagagtgagtctatagaagaacatgtggagcaggtcaaccaaaactgcatagcagaagattgccacatcaaggttgaagctgatctgggctatccaggtggaaaggcgaaagtcatccataaggaatctgatatgatcatggcattttctgttaataaggcaaattgtaatgaaattgttttggcttcaacacatgatgttcaagaacttgatgttacttctctactggcctgtcagtcatacatatggatcggagaagaatatgacagagaatccaaaagttcagatgatgttgattatcgtggttccactacaactctttatcaacccagtgcaacatcctattcagcaagtcaggtgcatccaccttcatctctgccatggctgggcactggacagactagcactggagctagtgtgcttatgaaaaggaatctacataatgttaagagaatgacttcacacccagtccatcaatactatcttacaggtgctcaggacggcagtgtacgaatgtttgaatggacgcggcctcagcaacttgtctgctttcgtcaagctggcaatgcaagagttactagattatattttaattcacaaggcaacaagtgtggtgttgcggatggagagggttttctgagtatctggcaagttaaccaaactgcatcaaatcctaaaccttatatgagttggcagtgccacagtaaagccacaagtgactttgcatttattacctcttcaagtctagttgccacatctggacactccaatgacaatagaaatgtttgcctctgggacacattaatatcacccggaaacagcctcattcatggtttcacgtgccacgatcatggtgccacggtactgcagtatgcacccaaacagcaactcctaatctcggggggtaggaaaggacacgtctgcatttttgacatcaggcaaaggcagctcattcacacgttccaggcccatgactcagctattaaggctctggccttggatccctatgaggaatattttaccacaggttcagcagaaggtaacataaaggtttggagattgacaggccatggcctaattcattcatttaaaagtgaacatgctaagcagtccatatttcgaaacattggggctggagtcatgcagattgacatcatccagggcaatcggctcttctcctgtggtgcagatggcacgctgaaaaccagggttttgcccaatgcttttaacatccctaacagaattcttgacattctataaagattggggttttatttttatatacatttcagttaaaaggcacactacagtcatcactaggcaattctgctttctaagcagttgtattgaaaacagagaatctctgtgtagaatttgaatatgacccaagctgagtattatctaaacaggttggtggaatgaatgcgcatgtaccttattatgctgacatactaaaaaaaataaaacctagtattgtatgaaggatagctattctttacagcatttagcaaacctgattcagaaaacatttgagattagcaaattagtaacttgaaataatgaaaaggacgtttataccaaattaaggaagaaaatgttgctgatttgggtttttcttcctgttcttaccactgactgaagcatgcctgcagtctcctcctctgttgaatgaaggataatcataaggtgtttgttaggagcgctagaccacctggaaaactttcttagctgtggagcagtgcgcagtgaccagttctctgctgtgagaggccgtttccattctttcctgctgaatatttttcctgttagtgtttatactgagctagtactgtaacttgcaaatgagtgcaaatttaaatgcaatgttttactcacaatttgcacattcacattttttggactgctagtttttctatttaaatatttgccttcatgttaggaatgtactatgtgaacatgacatatttgtagttaaccaaacacaccttcttagtccagtttagtactttttcttttcgtgtattcaaggttaaacacccaaacatttaaggatatgttgaaactacaccaatagagcatttcatatcataattaaaatgaatgttaggcttcttgtggccagttaatagttgatgagattggtgacattatttattgccacagcctattgtataaactatgcagagttaaatatttgcttgtaaaatattagccaatgttgtcattattttgatgtatttccttggttatgaccaaaaatatgttgagatactgaaactaatgtctgtgtgtttaaatgtttaccagcaaattgtcttatcatgttaatgagaatgttcaatgcctgtgtggtaaatagtaaatacaatggcataaaagtaactttctctgaagatgtgatgttcaggctgtgaaatatatatgtaaaagaaaaataaatgttatttgttagagtttttagtttgatactgtttttgaccattgagatttttaatttgataaaatgtttaactgttagag

SEQ ID NO: 8598 - DNA, 7465 bp, Homo sapiens
acagagggaaacggctctcgcagcccgaggagggtcaggcgcggagcttgtcgcacctcccgcgcattctgtccagcccgggctccggagatgcatctgcatcaggtcctcaccggagctgtcaaccctggagacaactgctactccgtgggcagcgtcggggatgtccccttcacggcatatggatcaggctgtgatattgttattttggcaaatgactttgaatgtgtacagatcattcctggtgctaagcatggaaacatccaagtcagctgtgtggagtgttctaaccaacaaggaagaattgcagcttcatatggtaatgctgtttgtatatttgagcccttgggcataaattctcataaaagaaattgtcaactcaagtgccagtggcttaaaactgggcagttttttttgagttctgtgacatacaacttagcatgggatcctcaagataatagattgttgacagcaactgattctattcagttgtgggctcctccaggagatgatattctggaagaggaggaagaaattgataatacagttcctcctgttttaaatgattggaagtgtgtctggcagtgcaaaacctcagtatctgtacatttgatggaatggtctcctgatggtgaatattttgctactgctggaaaggatgattgtcttttgaaagtgtggtatcctatgactggttggaagtcttcaattatacctcaggatcatcatgaagtaaaaaggagacagtcctctactcaattttcttttgtttacttggcacatccccgagctgtgacaggtttttcgtggcgcaaaactagcaagtatatgcccaggggttctgtctgtaatgtgttgttaacttcatgtcatgatggtgtgtgccggctctgggcagaaactttattaccagaagactgtcttttgggtgagcagatttgtgagactaccacttccagcattgccagcagcctttctcatgctggaagacacaaagacagaatacagcatgctcttgagacaatacaccatttgaaaaatttaaggaaaggacagaggaggtcatctgttcttgtaactcatgctgaattaatgcccgaccagacagcaatgcatgaagttcaaagacacatttcccaccatgcaaatgcactctgtcattttcatattgcagcaagcatcaaccctgccacagatattccaaatgtcttggttggcactgcatttaatgttgatgatggaaatgggggctttgtagttcattggttaaacaacaaggaatttcattttacatcatctacagaagtatttatgcatcaattacgaaaactttctgataagcaggtagatcatgaaaatgatgatgcagatagagaagatgaggaacattcacaggaggatagagaacggggtttacatatgaaattagaccatgatttatccctggatagagaatctgaggcaggtacaggatcatcagaacatgaagatggagaaagagaaggaagtcctagaacttactcacgacttagtgtaccaatgccactgcctacggttctgcttgatcggaagattgaaacgctgctaactgaatggaataagaatcctgatatgctttttacaatacaccctgtagatggtacctttctagtgtggcatgtgaagtatttggatgaatataatcctggaatatttagacaagttcaggtttctttttcttctcggattcctgttgcatttccctctggtgatgcaagctctcttagtaaaaatatcatgatgtatgcctgtataaatgcgacaaaagattctcaccacacgctgttacaccaggaggggatgtctgtaggcagtcctcacggatcacagccacactctagatcccacagtacacatatgaacatcttagctcccacagtaatgatgatctctaaacacatagatggttctttaaatcagtgggcagtcacttttgctgataagtctgcctttaccactgttctaactgtatctcacaaatttagatattgcggtcatcgatttcacctcaatgacctggcatgtcattcagttttaccactgttattgacatcctctcatcataatgctctattgactcctgaattagattgtcagtgggactcagacaataaattaagtagattaatggaccctgtaaaacatataaaaggttcctcgaaacaacctcttagaaatgcagcaactcgtacatttcatgacccaaatgcaatctacagtgaacttattctgtggcgtgtagacccaataggacctttgtcatacactggaggagtatcagaattggctcgaattaactctttacatacctcagcgttctctaatgtggcttggcttccaactctcattcccagttactgtctaggcacatactgcaattctgcaagtgcttgctttgttgcttctgatggcaaaaatctgagactctatcaagctgtagtggatgcaaggaaattattagatgaattgtcagacccagaatcttcaaaacttattggagaagtgtttaatattgtgagccaacagtctactgctcgacctggctgcattattgaactcgacgcaataaccaaccaatgtggctcaaatacacagttgcttcatgtgtttcaagaagacttcattataggatataaaccacataaggaagatatggagaaaaaggaaacagaaatattttttcagccatcacaaggataccgcccaccaccattttcagaaaagttctttctagtagtaattgagaaggacagcaataataactctattctgcatatgtggcaccttcatcttaaatctgtacaagcatgtttaggaagagatacattagatgagtgtggtttgagatacttgttagctatgcgcctacacacatgccttttgacatcgctgcctcctttataccgagtgcagctacttcatcaaggtgtctctacatgccattttgcctgggcttttcattctgaggctgaagaagaactgattaatatgattccagcaattcagagaggggacccccagtggtctgaattaagagctatgggcataggatggtgggtgaggaacattaacacgcttcgaagatgcattgaaaaggttgccaaagcttcttttcaaaggaacaatgatgccttagatgctgcactattctacctttcaatgaagaagaaagcagtagtgtggggtctgtttaggtcacagcatgatgaaaaaatgacaacatttttcagccacaactttaatgaagatagatggcgaaaagctgctttgaaaaatgctttttccttacttggaaaacaacgctttgaacaatcggctgcttttttcttgctagctggttcattgaaagatgccatagaggtatgtcttgaaaaaatggaagatattcagctagccatggttattgcccgtttatatgaatctgaatttgagacttcatccacttatatatccatcctaaatcagaagattttgggttgccaaaaggatggctcaggattcagttgcaaaagattacatcctgatcctttcctgcgtagtcttgcctattgggtaatgaaagattacacccgagccttggacacattactggaacaaacaccaaaggaggatgatgaacatcaagttatcatcaagtcttgtaacccggtggcatttagtttttataactaccttcgaactcatcctttgctcattcgaagaaatcttgcctcccctgaaggaactttggcaaccttaggtctcaaaactgagaagaactttgttgataaaattaacctcatagaaagaaaattattctttaccactgcaaatgctcattttaaagttggatgccctgttttagccttggaggtactctccaaaattccaaaagtaaccaaaacatctgccttatctgcaaaaaaagatcagcctgacttcatttctcacaggatggatgatgtaccttcacattcaaaagctctgagtgatggcaatggaagttctggcattgaatggtcaaatgtaacttcatcacagtatgactggagtcagccaatagtaaaagttgatgaggaacctcttaatcttgattggggtgaagatcacgacagtgccttagatgaagaggaagacgatgctgttggtttagtgatgaaaagtacagatgccagggaaaaagataaacaatcagatcagaaggcctcagaccctaacatgttattaacacctcaggaagaggatgatcctgaaggtgatactgaagttgatgtgattgctgaacaactaaaattcagagcttgtttaaagatccttatgactgaattaagaacattggctacaggttatgaagtagatggaggaaaactcagatttcaactctataactggcttgaaaaggaaattgctgccttgcatgagatatgtaatcatgaatcagttattaaagagtattccagtaagacatattccaaagtagagagtgatctgctggatcaggaagaaatggtagacaaaccagatattggttcctatgagcgccatcaaatagaaagaagaagattgcaggccaaacgagagcatgcagaaagacgaaagtcgtggttgcagaaaaaccaagatctcctgagagtatttctcagctactgtagccttcatggggcccaaggtggtggtttggcttcagtaaggatggaactcaaatttttgctacaagaatcacaacaggaaactacagtaaagcagctccagtctccactaccactgcctaccaccctacctctgctttcagcaagtattgcgtcaacaaaaacagtcatagctaatcctgtattgtacttaaataatcacatccatgatatactttatactattgttcagatgaaaacaccacctcatcccagtattgaagatgtgaaggtgcacacacttcattcactagcagcatcactttctgcatcaatttaccaagcattatgtgacagtcatagctacagtcaaacagaaggaaatcagtttacaggaatggcttatcaaggacttcttttaagtgatcgtagaagactaaggacagaaagcattgaagaacacgcaacaccaaattcatctcctgctcaatggcctggtgtgagctcacttattaatcttttgagttcagcccaagatgaagaccagccaaaactgaacattttgctatgtgaagctgttgttgctgtttacttaagtttattgatacatgctcttgccacaaattcctccagtgaattatttcggcttgcagcccacccattaaataatcgaatgtgggctgctgtttttggaggcggtgtaaaacttgttgtgaaacctcgaagacaatcagaaaatatttcagcacctcctgtcctttctgaagacatagataaacaccgtaggagatttaacatgagaatgctcgtccctggaaggcctgtaaaagatgctaccccaccaccggtgcctgcagaaagaccatcttacaaagaaaaatttattcctcccgaacttagtatgtgggattattttgttgcaaagccatttcttcctttgtctgatagtggtgttatatatgattctgatgaaagcattcatagtgatgaagaagatgatgcctttttttcagatacacaaatacaggagcaccaagatccaaattcctatagctgggctcttctacatttgacaatggttaaactagcacttcacaatgtcaagaatttctttcctattgctggactggaattctctgagctgcctgtaacatcaccattaggtattgctgtgattaaaaacttggagaactgggaacagatcttgcaagagaaaatggatcagtttgaaggtccaccccctaactatatcaacacatatccaactgacctttcagtgggagctggaccagctattcttcgaaataaagcaatgctagaacctgaaaataccccattcaagtcccgggattcttctgcatttccagtcaaacgactttggcatttccttgttaaacaagaggtccttcaagagacatttattagatatattttcactaagaaaagaaagcagagtgaggttgaagctgatctgggctatccaggtggaaaggcgaaagtcatccataaggaatctgatatgatcatggcattttctgttaataaggcaaattgtaatgaaattgttttggcttcaacacatgatgttcaagaacttgatgttacttctctactggcctgtcagtcatacatatggatcggagaagaatatgacagagaatccaaaagttcagatgatgttgattatcgtggttccactacaactctttatcaacccagtgcaacatcctattcagcaagtcaggtgcatccaccttcatctctgccatggctgggcactggacagactagcactggagctagtgtgcttatgaaaaggaatctacataatgttaagagaatgacttcacacccagtccatcaatactatcttacaggtgctcaggacggcagtgtacgaatgtttgaatggacgcggcctcagcaacttgtctgctttcgtcaagctggcaatgcaagagttactagattatattttaattcacaaggcaacaagtgtggtgttgcggatggagagggttttctgagtatctggcaagttaaccaaactgcatcaaatcctaaaccttatatgagttggcagtgccacagtaaagccacaagtgactttgcatttattacctcttcaagtctagttgccacatctggacactccaatgacaatagaaatgtttgcctctgggacacattaatatcacccggaaacagcctcattcatggtttcacgtgccacgatcatggtgccacggtactgcagtatgcacccaaacagcaactcctaatctcggggggtaggaaaggacacgtctgcatttttgacatcaggcaaaggcagctcattcacacgttccaggcccatgactcagctattaaggctctggccttggatccctatgaggaatattttaccacaggttcagcagaaggtaacataaaggtttggagattgacaggccatggcctaattcattcatttaaaagtgaacatgctaagcagtccatatttcgaaacattggggctggagtcatgcagattgacatcatccagggcaatcggctcttctcctgtggtgcagatggcacgctgaaaaccagggttttgcccaatgcttttaacatccctaacagaattcttgacattctataaagattggggttttatttttatatacatttcagttaaaaggcacactacagtcatcactaggcaattctgctttctaagcagttgtattgaaaacagagaatctctgtgtagaatttgaatatgacccaagctgagtattatctaaacaggttggtggaatgaatgcgcatgt

SEQ ID NO: 8599 - DNA, 10400 bp, Homo sapiens
acagagggaaacggctctcgcagcccgaggagggtcaggcgcggagcttgtcgcacctcccgcgcattctgtccagcccgggctccggagatgcatctgcatcaggtcctcaccggagctgtcaaccctggagacaactgctactccgtgggcagcgtcggggatgtccccttcacggcatatggatcaggctgtgatattgttattttggcaaatgactttgaatgtgtacagatcattcctggtgctaagcatggaaacatccaagtcagctgtgtggagtgttctaaccaacaaggaagaattgcagcttcatatggtaatgctgtttgtatatttgagcccttgggcataaattctcataaaagaaattgtcaactcaagtgccagtggcttaaaactgggcagttttttttgagttctgtgacatacaacttagcatgggatcctcaagataatagattgttgacagcaactgattctattcagttgtgggctcctccaggagatgatattctggaagaggaggaagaaattgataatacagttcctcctgttttaaatgattggaagtgtgtctggcagtgcaaaacctcagtatctgtacatttgatggaatggtctcctgatggtgaatattttgctactgctggaaaggatgattgtcttttgaaagtgtggtatcctatgactggttggaagtcttcaattatacctcaggatcatcatgaagtaaaaaggagacagtcctctactcaattttcttttgtttacttggcacatccccgagctgtgacaggtttttcgtggcgcaaaactagcaagtatatgcccaggggttctgtctgtaatgtgttgttaacttcatgtcatgatggtgtgtgccggctctgggcagaaactttattaccagaagactgtcttttgggtgagcagatttgtgagactaccacttccagcattgccagcagcctttctcatgctggaagacacaaagacagaatacagcatgctcttgagacaatacaccatttgaaaaatttaaggaaaggacagaggaggtcatctgttcttgtaactcatgctgaattaatgcccgaccagacagcaatgcatgaagttcaaagacacatttcccaccatgcaaatgcactctgtcattttcatattgcagcaagcatcaaccctgccacagatattccaaatgtcttggttggcactgcatttaatgttgatgatggaaatgggggctttgtagttcattggttaaacaacaaggaatttcattttacatcatctacagaagtatttatgcatcaattacgaaaactttctgataagcaggtagatcatgaaaatgatgatgcagatagagaagatgaggaacattcacaggaggatagagaacggggtttacatatgaaattagaccatgatttatccctggatagagaatctgaggcaggtacaggatcatcagaacatgaagatggagaaagagaaggaagtcctagaacttactcacgacttagtgtaccaatgccactgcctacggttctgcttgatcggaagattgaaacgctgctaactgaatggaataagaatcctgatatgctttttacaatacaccctgtagatggtacctttctagtgtggcatgtgaagtatttggatgaatataatcctggaatatttagacaagttcaggtttctttttcttctcggattcctgttgcatttccctctggtgatgcaagctctcttagtaaaaatatcatgatgtatgcctgtataaatgcgacaaaagattctcaccacacgctgttacaccaggaggggatgtctgtaggcagtcctcacggatcacagccacactctagatcccacagtacacatatgaacatcttagctcccacagtaatgatgatctctaaacacatagatggttctttaaatcagtgggcagtcacttttgctgataagtctgcctttaccactgttctaactgtatctcacaaatttagatattgcggtcatcgatttcacctcaatgacctggcatgtcattcagttttaccactgttattgacatcctctcatcataatgctctattgactcctgaattagattgtcagtgggactcagacaataaattaagtagattaatggaccctgtaaaacatataaaaggttcctcgaaacaacctcttagaaatgcagcaactcgtacatttcatgacccaaatgcaatctacagtgaacttattctgtggcgtgtagacccaataggacctttgtcatacactggaggagtatcagaattggctcgaattaactctttacatacctcagcgttctctaatgtggcttggcttccaactctcattcccagttactgtctaggcacatactgcaattctgcaagtgcttgctttgttgcttctgatggcaaaaatctgagactctatcaagctgtagtggatgcaaggaaattattagatgaattgtcagacccagaatcttcaaaacttattggagaagtgtttaatattgtgagccaacagtctactgctcgacctggctgcattattgaactcgacgcaataaccaaccaatgtggctcaaatacacagttgcttcatgtgtttcaagaagacttcattataggatataaaccacataaggaagatatggagaaaaaggaaacagaaatattttttcagccatcacaaggataccgcccaccaccattttcagaaaagttctttctagtagtaattgagaaggacagcaataataactctattctgcatatgtggcaccttcatcttaaatctgtacaagcatgtttagctaaagcttcagaaggggcttcctctgagagtctactttcagtccctggacagaagaacgtagattcttctccagaaacctctcctagtgtgagccccatgccacattcttcatcaattgccaatcttcaaactgccagtaaacttattctgagttctagactggtgtatagccaaccccttgatctcccagaatcagttgaagtaataagagcaacgccttcagcaggccatctgagttcttcttcaatttatccagtgtgccttgcaccttatttagtggttacaacttgttctgacaataaagtacgcttctggaaatgttgtatggaagccaacccagagtgtaataaaagtgatgagaaagaaatttatcattggaagagatggcctttgatgaatgatgaaggagaagataatagcagtacagtgagcattgtgggaagaccagttgctgttagctgttcatacacaggtcgccttgcagtggcttataagcagcctatccaccataatggttttgtttctaaagaattttccatgcatgtttgtatatttgaatgtgaatctacaggaggatcagagtgggttttagaacaaacaattcatcttgatgatttggttaaggttgggagtgtacttgattcaagggtcagcgtcgacagtaatctgtttgtgtatagcaagtcagatgcactcttgagcaaggatagatatcttattccgaatatcaaacatttagtacatttggactgggtatcaaaagaagatggctcccacattcttacagtgggagtcggtgcgaatatcttcatgtatggaaggctttcaggaattgtgactgagcaaaccaacagtaaggatggagtagctgtcatcactttaccactaggtggtagtatcaagcaaggagttaagtcaagatgggttcttcttagatctatagacttggtatcttctgttgatggtactccttcactgcctgtttctctctcttgggtaagagatgggatattggtggtaggaatggattgtgaaatgcatgtatatgcacagtggaagcatgctgtcaaatttggagacactgaagctgatagttctaatgcagaagaggcagcaatgcaagatcattcgacctttaaatctaatatgctggcaagaaaaagtgttgttgaaggaacagctatttctgatgatgttttttgttcaccaactgtaattcaagatggtggcttatttgaggctgcacatgtactttcccctactcttccacaatatcatccaactcagctgttagaattgatggatttagggaaagtgcgaagggctaaagccattctctctcatttagtaaaatgtattgcaggtgaagtagcaatagttagagatcctgatgctggagaaggaactaagcgacatctctctcgaactattagtgtaagtggcagtacagcaaaggaaacagtcaccgtaggaaaagatggtactcgagattatactgagatagattctatccctccactaccactatatgcattacttgctgcagatcaagatacatcctacagaatttcagaagaaagtacaaagataccacagagctatgaagatcagacagtaagtcaaccagaggatcagtattcagagctgtttcaaatccaggatataccaacggatgatattgatttagagcctgaaaagagagaaaacaaatcaaaagtaataaatctttctcaatatggaccagcttactttggccaagaacatgcaagggtactttcaagtcatcttatgcactcaagtctaccaggccttacccgtttggagcagatgttccttgtagctttggctgatacagtggctactactagtactgagcttgatgaaagcagagataagagttgctcaggaagagatacattagatgagtgtggtttgagatacttgttagctatgcgcctacacacatgccttttgacatcgctgcctcctttataccgagtgcagctacttcatcaaggtgtctctacatgccattttgcctgggcttttcattctgaggctgaagaagaactgattaatatgattccagcaattcagagaggggacccccagtggtctgaattaagagctatgggcataggatggtgggtgaggaacattaacacgcttcgaagatgcattgaaaaggttgccaaagcttcttttcaaaggaacaatgatgccttagatgctgcactattctacctttcaatgaagaagaaagcagtagtgtggggtctgtttaggtcacagcatgatgaaaaaatgacaacatttttcagccacaactttaatgaagatagatggcgaaaagctgctttgaaaaatgctttttccttacttggaaaacaacgctttgaacaatcggctgcttttttcttgctagctggttcattgaaagatgccatagaggtatgtcttgaaaaaatggaagatattcagctagccatggttattgcccgtttatatgaatctgaatttgagacttcatccacttatatatccatcctaaatcagaagattttgggttgccaaaaggatggctcaggattcagttgcaaaagattacatcctgatcctttcctgcgtagtcttgcctattgggtaatgaaagattacacccgagccttggacacattactggaacaaacaccaaaggaggatgatgaacatcaagttatcatcaagtcttgtaacccggtggcatttagtttttataactaccttcgaactcatcctttgctcattcgaagaaatcttgcctcccctgaaggaactttggcaaccttaggtctcaaaactgagaagaactttgttgataaaattaacctcatagaaagaaaattattctttaccactgcaaatgctcattttaaagttggatgccctgttttagccttggaggtactctccaaaattccaaaagtaaccaaaacatctgccttatctgcaaaaaaagatcagcctgacttcatttctcacaggatggatgatgtaccttcacattcaaaagctctgagtgatggcaatggaagttctggcattgaatggtcaaatgtaacttcatcacagtatgactggagtcagccaatagtaaaagttgatgaggaacctcttaatcttgattggggtgaagatcacgacagtgccttagatgaagaggaagacgatgctgttggtttagtgatgaaaagtacagatgccagggaaaaagataaacaatcagatcagaaggcctcagaccctaacatgttattaacacctcaggaagaggatgatcctgaaggtgatactgaagttgatgtgattgctgaacaactaaaattcagagcttgtttaaagatccttatgactgaattaagaacattggctacaggttatgaagtagatggaggaaaactcagatttcaactctataactggcttgaaaaggaaattgctgccttgcatgagatatgtaatcatgaatcagttattaaagagtattccagtaagacatattccaaagtagagagtgatctgctggatcaggaagaaatggtagacaaaccagatattggttcctatgagcgccatcaaatagaaagaagaagattgcaggccaaacgagagcatgcagaaagacgaaagtcgtggttgcagaaaaaccaagatctcctgagagtatttctcagctactgtagccttcatggggcccaaggtggtggtttggcttcagtaaggatggaactcaaatttttgctacaagaatcacaacaggaaactacagtaaagcagctccagtctccactaccactgcctaccaccctacctctgctttcagcaagtattgcgtcaacaaaaacagtcatagctaatcctgtattgtacttaaataatcacatccatgatatactttatactattgttcagatgaaaacaccacctcatcccagtattgaagatgtgaaggtgcacacacttcattcactagcagcatcactttctgcatcaatttaccaagcattatgtgacagtcatagctacagcagtcaaacagaaggaaatcagtttacaggaatggcttatcaaggacttcttttaagtgatcgtagaagactaaggacagaaagcattgaagaacacgcaacaccaaattcatctcctgctcaatggcctggtgtgagctcacttattaatcttttgagttcagcccaagatgaagaccagccaaaactgaacattttgctatgtgaagctgttgttgctgtttacttaagtttattgatacatgctcttgccacaaattcctccagtgaattatttcggcttgcagcccacccattaaataatcgaatgtgggctgctgtttttggaggcggtgtaaaacttgttgtgaaacctcgaagacaatcagaaaatatttcagcacctcctgtcctttctgaagacatagataaacaccgtaggagatttaacatgagaatgctcgtccctggaaggcctgtaaaagatgctaccccaccaccggtgcctgcagaaagaccatcttacaaagaaaaatttattcctcccgaacttagtatgtgggattattttgttgcaaagccatttcttcctttgtctgatagtggtgttatatatgattctgatgaaagcattcatagtgatgaagaagatgatgcctttttttcagatacacaaatacaggagcaccaagatccaaattcctatagctgggctcttctacatttgacaatggttaaactagcacttcacaatgtcaagaatttctttcctattgctggactggaattctctgagctgcctgtaacatcaccattaggtattgctgtgattaaaaacttggagaactgggaacagatcttgcaagagaaaatggatcagtttgaaggtccaccccctaactatatcaacacatatccaactgacctttcagtgggagctggaccagctattcttcgaaataaagcaatgctagaacctgaaaataccccattcaagtcccgggattcttctgcatttccagtcaaacgactttggcatttccttgttaaacaagaggtccttcaagagacatttattagatatattttcactaagaaaagaaagcagagtgaggttgaagctgatctgggctatccaggtggaaaggcgaaagtcatccataaggaatctgatatgatcatggcattttctgttaataaggcaaattgtaatgaaattgttttggcttcaacacatgatgttcaagaacttgatgttacttctctactggcctgtcagtcatacatatggatcggagaagaatatgacagagaatccaaaagttcagatgatgttgattatcgtggttccactacaactctttatcaacccagtgcaacatcctattcagcaagtcaggtgcatccaccttcatctctgccatggctgggcactggacagactagcactggagctagtgtgcttatgaaaaggaatctacataatgttaagagaatgacttcacacccagtccatcaatactatcttacaggtgctcaggacggcagtgtacgaatgtttgaatggacgcggcctcagcaacttgtctgctttcgtcaagctggcaatgcaagagttactagattatattttaattcacaaggcaacaagtgtggtgttgcggatggagagggttttctgagtatctggcaagttaaccaaactgcatcaaatcctaaaccttatatgagttggcagtgccacagtaaagccacaagtgactttgcatttattacctcttcaagtctagttgccacatctggacactccaatgacaatagaaatgtttgcctctgggacacattaatatcacccggaaacagcctcattcatggtttcacgtgccacgatcatggtgccacggtactgcagtatgcacccaaacagcaactcctaatctcggggggtaggaaaggacacgtctgcatttttgacatcaggcaaaggcagctcattcacacgttccaggcccatgactcagctattaaggctctggccttggatccctatgaggaatattttaccacaggttcagcagaaggtaacataaaggtttggagattgacaggccatggcctaattcattcatttaaaagtgaacatgctaagcagtccatatttcgaaacattggggctggagtcatgcagattgacatcatccagggcaatcggctcttctcctgtggtgcagatggcacgctgaaaaccagggttttgcccaatgcttttaacatccctaacagaattcttgacattctataaagattggggttttatttttatatacatttcagttaaaaggcacactacagtcatcactaggcaattctgctttctaagcagttgtattgaaaacagagaatctctgtgtagaatttgaatatgacccaagctgagtattatctaaacaggttggtggaatgaatgcgcatgtaccttattatgctgacatactaaaaaaaataaaacctagtattgtatgaaggatagctattctttacagcatttagcaaacctgattcagaaaacatttgagattagcaaattagtaacttgaaataatgaaaaggacgtttataccaaattaaggaagaaaatgttgctgatttgggtttttcttcctgttcttaccactgactgaagcatgcctgcagtctcctcctctgttgaatgaaggataatcataaggtgtttgttaggagcgctagaccacctggaaaactttcttagctgtggagcagtgcgcagtgaccagttctctgctgtgagaggccgtttccattctttcctgctgaatatttttcctgttagtgtttatactgagctagtactgtaacttgcaaatgagtgcaaatttaaatgcaatgttttactcacaatttgcacattcacattttttggactgctagtttttctatttaaatatttgccttcatgttaggaatgtactatgtgaacatgacatatttgtagttaaccaaacacaccttcttagtccagtttagtactttttcttttcgtgtattcaaggttaaacacccaaacatttaaggatatgttgaaactacaccaatagagcatttcatatcataattaaaatgaatgttaggcttcttgtggccagttaatagttgatgagattggtgacattatttattgccacagcctattgtataaactatgcagagttaaatatttgcttgtaaaatattagccaatgttgtcattattttgatgtatttccttggttatgaccaaaaatatgttgagatactgaaactaatgtctgtgtgtttaaatgtttaccagcaaattgtcttatcatgttaatgagaatgttcaatgcctgtgtggtaaatagtaaatacaatggcataaaagtaactttctctgaagatgtgatgttcaggctgtgaaatatatatgtaaaagaaaaataaatgttatttgttagagtt

SEQ ID NO: 8600 - DNA, 5351 bp, Homo sapiens
ggctccgttccatccttctgcacagggtatcgcctctctccgtttggtacatcccctcctcccccacgcccggactggggtggtagacgccgcctccgctcatcgcccctccccatcggtttccgcgcgaaaagccggggcgcctgcgctgccgccgccgcgtctgctgaagcctccgagatgccggcgcgtaccgccccagcccgggtgcccacactggccgtcccggccatctcgctgcccgacgatgtccgcaggcggctcaaagatttggaaagagacagcttaacagaaaaggaatgtgtgaaggagaaattgaatctcttgcacgaatttctgcaaacagaaataaagaatcagttatgtgacttggaaaccaaattacgtaaagaagaattatccgaggagggctacctggctaaagtcaaatcccttttaaataaagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggctaagcctgaaccttcacctagccccaggattacaaggaaaagcaccaggcaaaccaccatcacatctcattttgcaaagggccctgccaaacggaaacctcaggaagagtctgaaagagccaaatcggatgagtccatcaaggaagaagacaaagaccaggatgagaagagacgtagagttacatccagagaacgagttgctagaccgcttcctgcagaagaacctgaaagagcaaaatcaggaacgcgcactgaaaaggaagaagaaagagatgaaaaagaagaaaagagactccgaagtcaaaccaaagaaccaacacccaaacagaaactgaaggaggagccggacagagaagccagggcaggcgtgcaggctgacgaggacgaagatggagacgagaaagatgagaagaagcacagaagtcaacccaaagatctagctgccaaacggaggcccgaagaaaaagaacctgaaaaagtaaatccacagatttctgatgaaaaagacgaggatgaaaaggaggagaagagacgcaaaacgacccccaaagaaccaacggagaaaaaaatggctcgcgccaaaacagtcatgaactccaagacccaccctcccaagtgcattcagtgcgggcagtacctggacgaccctgacctcaaatatgggcagcacccaccagacgcggtggatgagccacagatgctgacaaatgagaagctgtccatctttgatgccaacgagtctggctttgagagttatgaggcgcttccccagcacaaactgacctgcttcagtgtgtactgtaagcacggtcacctgtgtcccatcgacaccggcctcatcgagaagaatatcgaactcttcttttctggttcagcaaaaccaatctatgatgatgacccatctcttgaaggtggtgttaatggcaaaaatcttggccccataaatgaatggtggatcactggctttgatggaggtgaaaaggccctcatcggcttcagcacctcatttgccgaatacattctgatggatcccagtcccgagtatgcgcccatatttgggctgatgcaggagaagatctacatcagcaagattgtggtggagttcctgcagagcaattccgactcgacctatgaggacctgatcaacaagatcgagaccacggttcctccttctggcctcaacttgaaccgcttcacagaggactccctcctgcgacacgcgcagtttgtggtggagcaggtggagagttatgacgaggccggggacagtgatgagcagcccatcttcctgacaccctgcatgcgggacctgatcaagctggctggggtcacgctgggacagaggcgagcccaggcgaggcggcagaccatcaggcattctaccagggagaaggacaggggacccacgaaagccaccaccaccaagctggtctaccagatcttcgatactttcttcgcagagcaaattgaaaaggatgacagagaagacaaggagaacgcctttaagcgccggcgatgtggcgtctgtgaggtgtgtcagcagcctgagtgtgggaaatgtaaagcctgcaaggacatggttaaatttggtggcagtggacggagcaagcaggcttgccaagagcggaggtgtcccaatatggccatgaaggaggcagatgacgatgaggaagtcgatgataacatcccagagatgccgtcacccaaaaaaatgcaccaggggaagaagaagaaacagaacaagaatcgcatctcttgggtcggagaagccgtcaagactgatgggaagaagagttactataagaaggtgtgcattgatgcggaaaccctggaagtgggggactgtgtctctgttattccagatgattcctcaaaaccgctgtatctagcaagggtcacggcgctgtgggaggacagcagcaacgggcagatgtttcacgcccactggttctgcgctgggacagacacagtcctcggggccacgtcggaccctctggagctgttcttggtggatgaatgtgaggacatgcagctttcatatatccacagcaaagtgaaagtcatctacaaagccccctccgaaaactgggccatggagggaggcatggatcccgagtccctgctggagggggacgacgggaagacctacttctaccagctgtggtatgatcaagactacgcgagattcgagtcccctccaaaaacccagccaacagaggacaacaagttcaaattctgtgtgagctgtgcccgtctggctgagatgaggcaaaaagaaatccccagggtcctggagcagctcgaggacctggatagccgggtcctctactactcagccaccaagaacggcatcctgtaccgagttggtgatggtgtgtacctgccccctgaggccttcacgttcaacatcaagctgtccagtcccgtgaaacgcccacggaaggagcccgtggatgaggacctgtacccagagcactaccggaaatactccgactacatcaaaggcagcaacctggatgcccctgagccctaccgaattggccggatcaaagagatcttctgtcccaagaagagcaacggcaggcccaatgagactgacatcaaaatccgggtcaacaagttctacaggcctgagaacacccacaagtccactccagcgagctaccacgcagacatcaacctgctctactggagcgacgaggaggccgtggtggacttcaaggctgtgcagggccgctgcaccgtggagtatggggaggacctgcccgagtgcgtccaggtgtactccatgggcggccccaaccgcttctacttcctcgaggcctataatgcaaagagcaaaagctttgaagatcctcccaaccatgcccgtagccctggaaacaaagggaagggcaagggaaaagggaagggcaagcccaagtcccaagcctgtgagccgagcgagccagagatagagatcaagctgcccaagctgcggaccctggatgtgttttctggctgcggggggttgtcggagggattccaccaagcaggcatctctgacacgctgtgggccatcgagatgtgggaccctgcggcccaggcgttccggctgaacaaccccggctccacagtgttcacagaggactgcaacatcctgctgaagctggtcatggctggggagaccaccaactcccgcggccagcggctgccccagaagggagacgtggagatgctgtgcggcgggccgccctgccagggcttcagcggcatgaaccgcttcaattcgcgcacctactccaagttcaaaaactctctggtggtttccttcctcagctactgcgactactaccggccccggttcttcctcctggagaatgtcaggaactttgtctccttcaagcgctccatggtcctgaagctcaccctccgctgcctggtccgcatgggctatcagtgcaccttcggcgtgctgcaggccggtcagtacggcgtggcccagactaggaggcgggccatcatcctggccgcggcccctggagagaagctccctctgttcccggagccactgcacgtgtttgctccccgggcctgccagctgagcgtggtggtggatgacaagaagtttgtgagcaacataaccaggttgagctcgggtcctttccggaccatcacggtgcgagacacgatgtccgacctgccggaggtgcggaatggagcctcggcactggagatctcctacaacggggagcctcagtcctggttccagaggcagctccggggcgcacagtaccagcccatcctcagggaccacatctgtaaggacatgagtgcattggtggctgcccgcatgcggcacatccccttggccccagggtcagactggcgcgatctgcccaacatcgaggtgcggctctcagacggcaccatggccaggaagctgcggtatacccaccatgacaggaagaacggccgcagcagctctggggccctccgtggggtctgctcctgcgtggaagccggcaaagcctgcgaccccgcagccaggcagttcaacaccctcatcccctggtgcctgccccacaccgggaaccggcacaaccactgggctggcctctatggaaggctcgagtgggacggcttcttcagcacaaccgtcaccaaccccgagcccatgggcaagcagggccgcgtgctccacccagagcagcaccgtgtggtgagcgtgcgggagtgtgcccgctcccagggcttccctgacacctaccggctcttcggcaacatcctggacaagcaccggcaggtgggcaatgccgtgccaccgcccctggccaaagccattggcttggagatcaagctttgtatgttggccaaagcccgagagagtgcctcagctaaaataaaggaggaggaagctgctaaggactagttctgccctcccgtcacccctgtttctggcaccaggaatccccaacatgcactgatgttgtgtttttaacatgtcaatctgtccgttcacatgtgtggtacatggtgtttgtggccttggctgacatgaagctgttgtgtgaggttcgcttatcaactaatgatttagtgatcaaattgtgcagtactttgtgcattctggattttaaaagttttttattatgcattatatcaaatctaccactgtatgagtggaaattaagactttatgtagtttttatatgttgtaatatttcttcaaataaatctctcctataaacc

SEQ ID NO: 8601 - DNA, 5399 bp, Homo sapiens
ggctccgttccatccttctgcacagggtatcgcctctctccgtttggtacatcccctcctcccccacgcccggactggggtggtagacgccgcctccgctcatcgcccctccccatcggtttccgcgcgaaaagccggggcgcctgcgctgccgccgccgcgtctgctgaagcctccgagatgccggcgcgtaccgccccagcccgggtgcccacactggccgtcccggccatctcgctgcccgacgatgtccgcaggcggctcaaagatttggaaagagacagcttaacagaaaaggaatgtgtgaaggagaaattgaatctcttgcacgaatttctgcaaacagaaataaagaatcagttatgtgacttggaaaccaaattacgtaaagaagaattatccgaggagggctacctggctaaagtcaaatcccttttaaataaagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggctaagcgttcaagagaccctcctgcctcagcctcccaagtaactgggattagagctgaaccttcacctagccccaggattacaaggaaaagcaccaggcaaaccaccatcacatctcattttgcaaagggccctgccaaacggaaacctcaggaagagtctgaaagagccaaatcggatgagtccatcaaggaagaagacaaagaccaggatgagaagagacgtagagttacatccagagaacgagttgctagaccgcttcctgcagaagaacctgaaagagcaaaatcaggaacgcgcactgaaaaggaagaagaaagagatgaaaaagaagaaaagagactccgaagtcaaaccaaagaaccaacacccaaacagaaactgaaggaggagccggacagagaagccagggcaggcgtgcaggctgacgaggacgaagatggagacgagaaagatgagaagaagcacagaagtcaacccaaagatctagctgccaaacggaggcccgaagaaaaagaacctgaaaaagtaaatccacagatttctgatgaaaaagacgaggatgaaaaggaggagaagagacgcaaaacgacccccaaagaaccaacggagaaaaaaatggctcgcgccaaaacagtcatgaactccaagacccaccctcccaagtgcattcagtgcgggcagtacctggacgaccctgacctcaaatatgggcagcacccaccagacgcggtggatgagccacagatgctgacaaatgagaagctgtccatctttgatgccaacgagtctggctttgagagttatgaggcgcttccccagcacaaactgacctgcttcagtgtgtactgtaagcacggtcacctgtgtcccatcgacaccggcctcatcgagaagaatatcgaactcttcttttctggttcagcaaaaccaatctatgatgatgacccatctcttgaaggtggtgttaatggcaaaaatcttggccccataaatgaatggtggatcactggctttgatggaggtgaaaaggccctcatcggcttcagcacctcatttgccgaatacattctgatggatcccagtcccgagtatgcgcccatatttgggctgatgcaggagaagatctacatcagcaagattgtggtggagttcctgcagagcaattccgactcgacctatgaggacctgatcaacaagatcgagaccacggttcctccttctggcctcaacttgaaccgcttcacagaggactccctcctgcgacacgcgcagtttgtggtggagcaggtggagagttatgacgaggccggggacagtgatgagcagcccatcttcctgacaccctgcatgcgggacctgatcaagctggctggggtcacgctgggacagaggcgagcccaggcgaggcggcagaccatcaggcattctaccagggagaaggacaggggacccacgaaagccaccaccaccaagctggtctaccagatcttcgatactttcttcgcagagcaaattgaaaaggatgacagagaagacaaggagaacgcctttaagcgccggcgatgtggcgtctgtgaggtgtgtcagcagcctgagtgtgggaaatgtaaagcctgcaaggacatggttaaatttggtggcagtggacggagcaagcaggcttgccaagagcggaggtgtcccaatatggccatgaaggaggcagatgacgatgaggaagtcgatgataacatcccagagatgccgtcacccaaaaaaatgcaccaggggaagaagaagaaacagaacaagaatcgcatctcttgggtcggagaagccgtcaagactgatgggaagaagagttactataagaaggtgtgcattgatgcggaaaccctggaagtgggggactgtgtctctgttattccagatgattcctcaaaaccgctgtatctagcaagggtcacggcgctgtgggaggacagcagcaacgggcagatgtttcacgcccactggttctgcgctgggacagacacagtcctcggggccacgtcggaccctctggagctgttcttggtggatgaatgtgaggacatgcagctttcatatatccacagcaaagtgaaagtcatctacaaagccccctccgaaaactgggccatggagggaggcatggatcccgagtccctgctggagggggacgacgggaagacctacttctaccagctgtggtatgatcaagactacgcgagattcgagtcccctccaaaaacccagccaacagaggacaacaagttcaaattctgtgtgagctgtgcccgtctggctgagatgaggcaaaaagaaatccccagggtcctggagcagctcgaggacctggatagccgggtcctctactactcagccaccaagaacggcatcctgtaccgagttggtgatggtgtgtacctgccccctgaggccttcacgttcaacatcaagctgtccagtcccgtgaaacgcccacggaaggagcccgtggatgaggacctgtacccagagcactaccggaaatactccgactacatcaaaggcagcaacctggatgcccctgagccctaccgaattggccggatcaaagagatcttctgtcccaagaagagcaacggcaggcccaatgagactgacatcaaaatccgggtcaacaagttctacaggcctgagaacacccacaagtccactccagcgagctaccacgcagacatcaacctgctctactggagcgacgaggaggccgtggtggacttcaaggctgtgcagggccgctgcaccgtggagtatggggaggacctgcccgagtgcgtccaggtgtactccatgggcggccccaaccgcttctacttcctcgaggcctataatgcaaagagcaaaagctttgaagatcctcccaaccatgcccgtagccctggaaacaaagggaagggcaagggaaaagggaagggcaagcccaagtcccaagcctgtgagccgagcgagccagagatagagatcaagctgcccaagctgcggaccctggatgtgttttctggctgcggggggttgtcggagggattccaccaagcaggcatctctgacacgctgtgggccatcgagatgtgggaccctgcggcccaggcgttccggctgaacaaccccggctccacagtgttcacagaggactgcaacatcctgctgaagctggtcatggctggggagaccaccaactcccgcggccagcggctgccccagaagggagacgtggagatgctgtgcggcgggccgccctgccagggcttcagcggcatgaaccgcttcaattcgcgcacctactccaagttcaaaaactctctggtggtttccttcctcagctactgcgactactaccggccccggttcttcctcctggagaatgtcaggaactttgtctccttcaagcgctccatggtcctgaagctcaccctccgctgcctggtccgcatgggctatcagtgcaccttcggcgtgctgcaggccggtcagtacggcgtggcccagactaggaggcgggccatcatcctggccgcggcccctggagagaagctccctctgttcccggagccactgcacgtgtttgctccccgggcctgccagctgagcgtggtggtggatgacaagaagtttgtgagcaacataaccaggttgagctcgggtcctttccggaccatcacggtgcgagacacgatgtccgacctgccggaggtgcggaatggagcctcggcactggagatctcctacaacggggagcctcagtcctggttccagaggcagctccggggcgcacagtaccagcccatcctcagggaccacatctgtaaggacatgagtgcattggtggctgcccgcatgcggcacatccccttggccccagggtcagactggcgcgatctgcccaacatcgaggtgcggctctcagacggcaccatggccaggaagctgcggtatacccaccatgacaggaagaacggccgcagcagctctggggccctccgtggggtctgctcctgcgtggaagccggcaaagcctgcgaccccgcagccaggcagttcaacaccctcatcccctggtgcctgccccacaccgggaaccggcacaaccactgggctggcctctatggaaggctcgagtgggacggcttcttcagcacaaccgtcaccaaccccgagcccatgggcaagcagggccgcgtgctccacccagagcagcaccgtgtggtgagcgtgcgggagtgtgcccgctcccagggcttccctgacacctaccggctcttcggcaacatcctggacaagcaccggcaggtgggcaatgccgtgccaccgcccctggccaaagccattggcttggagatcaagctttgtatgttggccaaagcccgagagagtgcctcagctaaaataaaggaggaggaagctgctaaggactagttctgccctcccgtcacccctgtttctggcaccaggaatccccaacatgcactgatgttgtgtttttaacatgtcaatctgtccgttcacatgtgtggtacatggtgtttgtggccttggctgacatgaagctgttgtgtgaggttcgcttatcaactaatgatttagtgatcaaattgtgcagtactttgtgcattctggattttaaaagttttttattatgcattatatcaaatctaccactgtatgagtggaaattaagactttatgtagtttttatatgttgtaatatttcttcaaataaatctctcctataaacc

SEQ ID NO: 8602 - DNA, 5360 bp, Homo sapiens
ggctccgttccatccttctgcacagggtatcgcctctctccgtttggtacatcccctcctcccccacgcccggactggggtggtagacgccgcctccgctcatcgcccctccccatcggtttccgcgcgaaaagccggggcgcctgcgctgccgccgccgcgtctgctgaagcctccgagatgccggcgcgtaccgccccagcccgggtgcccacactggccgtcccggccatctcgctgcccgacgatgtccgcaggcggctcaaagatttggaaagagacagcttaacagaaaaggaatgtgtgaaggagaaattgaatctcttgcacgaatttctgcaaacagaaataaagaatcagttatgtgacttggaaaccaaattacgtaaagaagaattatccgaggagggctacctggctaaagtcaaatcccttttaaataaagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggctaagcctgaaccttcacctagccccaggattacaaggaaaagcaccaggcaaaccaccatcacatctcattttgcaaagggccctgccaaacggaaacctcaggaagagtctgaaagagccaaatcggatgagtccatcaaggaagaagacaaagaccaggatgagaagagacgtagagttacatccagagaacgagttgctagaccgcttcctgcagaagaacctgaaagagcaaaatcaggaacgcgcactgaaaaggaagaagaaagagatgaaaaagaagaaaagagactccgaagtcaaaccaaagaaccaacacccaaacagaaactgaaggaggagccggacagagaagccagggcaggcgtgcaggctgacgaggacgaagatggagacgagaaagatgagaagaagcacagaagtcaacccaaagatctagctgccaaacggaggcccgaagaaaaagaacctgaaaaagtaaatccacagatttctgatgaaaaagacgaggatgaaaaggaggagaagagacgcaaaacgacccccaaagaaccaacggagaaaaaaatggctcgcgccaaaacagtcatgaactccaagacccaccctcccaagtgcattcagtgcgggcagtacctggacgaccctgacctcaaatatgggcagcacccaccagacgcggtggatgagccacagatgctgacaaatgagaagctgtccatctttgatgccaacgagtctggctttgagagttatgaggcgcttccccagcacaaactgacctgcttcagtgtgtactgtaagcacggtcacctgtgtcccatcgacaccggcctcatcgagaagaatatcgaactcttcttttctggttcagcaaaaccaatctatgatgatgacccatctcttgaaggtggtgttaatggcaaaaatcttggccccataaatgaatggtggatcactggctttgatggaggtgaaaaggccctcatcggcttcagcacctcatttgccgaatacattctgatggatcccagtcccgagtatgcgcccatatttgggctgatgcaggagaagatctacatcagcaagattgtggtggagttcctgcagagcaattccgactcgacctatgaggacctgatcaacaagatcgagaccacggttcctccttctggcctcaacttgaaccgcttcacagaggactccctcctgcgacacgcgcagtttgtggtggagcaggtggagagttatgacgaggccggggacagtgatgagcagcccatcttcctgacaccctgcatgcgggacctgatcaagctggctggggtcacgctgggacagaggcgagcccaggcgaggcggcagaccatcaggcattctaccagggagaaggacaggggacccacgaaagccaccaccaccaagctggtctaccagatcttcgatactttcttcgcagagcaaattgaaaaggatgacagagaagacaaggagaacgcctttaagcgccggcgatgtggcgtctgtgaggtgtgtcagcagcctgagtgtgggaaatgtaaagcctgcaaggacatggttaaatttggtggcagtggacggagcaagcaggcttgccaagagcggaggtgtcccaatatggccatgaaggaggcagatgacgatgaggaagtcgatgataacatcccagagatgccgtcacccaaaaaaatgcaccaggggaagaagaagaaacagaacaagaatcgcatctcttgggtcggagaagccgtcaagactgatgggaagaagagttactataagaaggtgtgcattgatgcggaaaccctggaagtgggggactgtgtctctgttattccagatgattcctcaaaaccgctgtatctagcaagggtcacggcgctgtgggaggacagcagcaacgggcagatgtttcacgcccactggttctgcgctgggacagacacagtcctcggggccacgtcggaccctctggagctgttcttggtggatgaatgtgaggacatgcagctttcatatatccacagcaaagtgaaagtcatctacaaagccccctccgaaaactgggccatggagggaggcatggatcccgagtccctgctggagggggacgacgggaagacctacttctaccagctgtggtatgatcaagactacgcgagattcgagtcccctccaaaaacccagccaacagaggacaacaagttcaaattctgtgtgagctgtgcccgtctggctgagatgaggcaaaaagaaatccccagggtcctggagcagctcgaggacctggatagccgggtcctctactactcagccaccaagaacggcatcctgtaccgagttggtgatggtgtgtacctgccccctgaggccttcacgttcaacatcaagctgtccagtcccgtgaaacgcccacggaaggagcccgtggatgaggacctgtacccagagcactaccggaaatactccgactacatcaaaggcagcaacctggatgcccctgagccctaccgaattggccggatcaaagagatcttctgtcccaagaagagcaacggcaggcccaatgagactgacatcaaaatccgggtcaacaagttctacaggcctgagaacacccacaagtccactccagcgagctaccacgcagacatcaacctgctctactggagcgacgaggaggccgtggtggacttcaaggctgtgcagggccgctgcaccgtggagtatggggaggacctgcccgagtgcgtccaggtgtactccatgggcggccccaaccgcttctacttcctcgaggcctataatgcaaagagcaaaagctttgaagatcctcccaaccatgcccgtagccctggaaacaaagggaagggcaagggaaaagggaagggcaagcccaagtcccaagcctgtgagccgagcgagccagagatagagatcaagctgcccaagctgcggaccctggatgtgttttctggctgcggggggttgtcggagggattccaccaagcaggcatctctgacacgctgtgggccatcgagatgtgggaccctgcggcccaggcgttccggctgaacaaccccggctccacagtgttcacagaggactgcaacatcctgctgaagctggtcatggctggggagaccaccaactcccgcggccagcggctgccccagaagggagacgtggagatgctgtgcggcgggccgccctgccagggcttcagcggcatgaaccgcttcaattcgcgcacctactccaagttcaaaaactctctggtggtttccttcctcagctactgcgactactaccggccccggttcttcctcctggagaatgtcaggaactttgtctccttcaagcgctccatggtcctgaagctcaccctccgctgcctggtccgcatgggctatcagtgcaccttcggcgtgctgcaggccggtcagtacggcgtggcccagactaggaggcgggccatcatcctggccgcggcccctggagagaagctccctctgttcccggagccactgcacgtgtttgctccccgggcctgccagctgagcgtggtggtggatgacaagaagtttgtgagcaacataaccaggttgagctcgggtcctttccggaccatcacggtgcgagacacgatgtccgacctgccggaggtgcggaatggagcctcggcactggagatctcctacaacggggagcctcagtcctggttccagaggcagctccggggcgcacagtaccagcccatcctcagggaccacatctgtaaggacatgagtgcattggtggctgcccgcatgcggcacatccccttggccccagggtcagactggcgcgatctgcccaacatcgaggtgcggctctcagacggcaccatggccaggaagctgcggtatacccaccatgacaggaagaacggccgcagcagctctggggccctccgtggggtctgctcctgcgtggaaggtgggtcctccggcaaagcctgcgaccccgcagccaggcagttcaacaccctcatcccctggtgcctgccccacaccgggaaccggcacaaccactgggctggcctctatggaaggctcgagtgggacggcttcttcagcacaaccgtcaccaaccccgagcccatgggcaagcagggccgcgtgctccacccagagcagcaccgtgtggtgagcgtgcgggagtgtgcccgctcccagggcttccctgacacctaccggctcttcggcaacatcctggacaagcaccggcaggtgggcaatgccgtgccaccgcccctggccaaagccattggcttggagatcaagctttgtatgttggccaaagcccgagagagtgcctcagctaaaataaaggaggaggaagctgctaaggactagttctgccctcccgtcacccctgtttctggcaccaggaatccccaacatgcactgatgttgtgtttttaacatgtcaatctgtccgttcacatgtgtggtacatggtgtttgtggccttggctgacatgaagctgttgtgtgaggttcgcttatcaactaatgatttagtgatcaaattgtgcagtactttgtgcattctggattttaaaagttttttattatgcattatatcaaatctaccactgtatgagtggaaattaagactttatgtagtttttatatgttgtaatatttcttcaaataaatctctcctataaacc

SEQ ID NO: 8603 - DNA, 4775 bp, Homo sapiens
ggttcatgccattctcctgcctcagcctcccaagtagctgggactacagctgaaccttcacctagccccaggattacaaggaaaagcaccaggcaaaccaccatcacatctcattttgcaaagggccctgccaaacggaaacctcaggaagagtctgaaagagccaaatcggatgagtccatcaaggaagaagacaaagaccaggatgagaagagacgtagagttacatccagagaacgagttgctagaccgcttcctgcagaagaacctgaaagagcaaaatcaggaacgcgcactgaaaaggaagaagaaagagatgaaaaagaagaaaagagactccgaagtcaaaccaaagaaccaacacccaaacagaaactgaaggaggagccggacagagaagccagggcaggcgtgcaggctgacgaggacgaagatggagacgagaaagatgagaagaagcacagaagtcaacccaaagatctagctgccaaacggaggcccgaagaaaaagaacctgaaaaagtaaatccacagatttctgatgaaaaagacgaggatgaaaaggaggagaagagacgcaaaacgacccccaaagaaccaacggagaaaaaaatggctcgcgccaaaacagtcatgaactccaagacccaccctcccaagtgcattcagtgcgggcagtacctggacgaccctgacctcaaatatgggcagcacccaccagacgcggtggatgagccacagatgctgacaaatgagaagctgtccatctttgatgccaacgagtctggctttgagagttatgaggcgcttccccagcacaaactgacctgcttcagtgtgtactgtaagcacggtcacctgtgtcccatcgacaccggcctcatcgagaagaatatcgaactcttcttttctggttcagcaaaaccaatctatgatgatgacccatctcttgaaggtggtgttaatggcaaaaatcttggccccataaatgaatggtggatcactggctttgatggaggtgaaaaggccctcatcggcttcagcacctcatttgccgaatacattctgatggatcccagtcccgagtatgcgcccatatttgggctgatgcaggagaagatctacatcagcaagattgtggtggagttcctgcagagcaattccgactcgacctatgaggacctgatcaacaagatcgagaccacggttcctccttctggcctcaacttgaaccgcttcacagaggactccctcctgcgacacgcgcagtttgtggtggagcaggtggagagttatgacgaggccggggacagtgatgagcagcccatcttcctgacaccctgcatgcgggacctgatcaagctggctggggtcacgctgggacagaggcgagcccaggcgaggcggcagaccatcaggcattctaccagggagaaggacaggggacccacgaaagccaccaccaccaagctggtctaccagatcttcgatactttcttcgcagagcaaattgaaaaggatgacagagaagacaaggagaacgcctttaagcgccggcgatgtggcgtctgtgaggtgtgtcagcagcctgagtgtgggaaatgtaaagcctgcaaggacatggttaaatttggtggcagtggacggagcaagcaggcttgccaagagcggaggtgtcccaatatggccatgaaggaggcagatgacgatgaggaagtcgatgataacatcccagagatgccgtcacccaaaaaaatgcaccaggggaagaagaagaaacagaacaagaatcgcatctcttgggtcggagaagccgtcaagactgatgggaagaagagttactataagaaggtgtgcattgatgcggaaaccctggaagtgggggactgtgtctctgttattccagatgattcctcaaaaccgctgtatctagcaagggtcacggcgctgtgggaggacagcagcaacgggcagatgtttcacgcccactggttctgcgctgggacagacacagtcctcggggccacgtcggaccctctggagctgttcttggtggatgaatgtgaggacatgcagctttcatatatccacagcaaagtgaaagtcatctacaaagccccctccgaaaactgggccatggagggaggcatggatcccgagtccctgctggagggggacgacgggaagacctacttctaccagctgtggtatgatcaagactacgcgagattcgagtcccctccaaaaacccagccaacagaggacaacaagttcaaattctgtgtgagctgtgcccgtctggctgagatgaggcaaaaagaaatccccagggtcctggagcagctcgaggacctggatagccgggtcctctactactcagccaccaagaacggcatcctgtaccgagttggtgatggtgtgtacctgccccctgaggccttcacgttcaacatcaagctgtccagtcccgtgaaacgcccacggaaggagcccgtggatgaggacctgtacccagagcactaccggaaatactccgactacatcaaaggcagcaacctggatgcccctgagccctaccgaattggccggatcaaagagatcttctgtcccaagaagagcaacggcaggcccaatgagactgacatcaaaatccgggtcaacaagttctacaggcctgagaacacccacaagtccactccagcgagctaccacgcagacatcaacctgctctactggagcgacgaggaggccgtggtggacttcaaggctgtgcagggccgctgcaccgtggagtatggggaggacctgcccgagtgcgtccaggtgtactccatgggcggccccaaccgcttctacttcctcgaggcctataatgcaaagagcaaaagctttgaagatcctcccaaccatgcccgtagccctggaaacaaagggaagggcaagggaaaagggaagggcaagcccaagtcccaagcctgtgagccgagcgagccagagatagagatcaagctgcccaagctgcggaccctggatgtgttttctggctgcggggggttgtcggagggattccaccaagcaggcatctctgacacgctgtgggccatcgagatgtgggaccctgcggcccaggcgttccggctgaacaaccccggctccacagtgttcacagaggactgcaacatcctgctgaagctggtcatggctggggagaccaccaactcccgcggccagcggctgccccagaagggagacgtggagatgctgtgcggcgggccgccctgccagggcttcagcggcatgaaccgcttcaattcgcgcacctactccaagttcaaaaactctctggtggtttccttcctcagctactgcgactactaccggccccggttcttcctcctggagaatgtcaggaactttgtctccttcaagcgctccatggtcctgaagctcaccctccgctgcctggtccgcatgggctatcagtgcaccttcggcgtgctgcaggccggtcagtacggcgtggcccagactaggaggcgggccatcatcctggccgcggcccctggagagaagctccctctgttcccggagccactgcacgtgtttgctccccgggcctgccagctgagcgtggtggtggatgacaagaagtttgtgagcaacataaccaggttgagctcgggtcctttccggaccatcacggtgcgagacacgatgtccgacctgccggaggtgcggaatggagcctcggcactggagatctcctacaacggggagcctcagtcctggttccagaggcagctccggggcgcacagtaccagcccatcctcagggaccacatctgtaaggacatgagtgcattggtggctgcccgcatgcggcacatccccttggccccagggtcagactggcgcgatctgcccaacatcgaggtgcggctctcagacggcaccatggccaggaagctgcggtatacccaccatgacaggaagaacggccgcagcagctctggggccctccgtggggtctgctcctgcgtggaagccggcaaagcctgcgaccccgcagccaggcagttcaacaccctcatcccctggtgcctgccccacaccgggaaccggcacaaccactgggctggcctctatggaaggctcgagtgggacggcttcttcagcacaaccgtcaccaaccccgagcccatgggcaagcagggccgcgtgctccacccagagcagcaccgtgtggtgagcgtgcgggagtgtgcccgctcccagggcttccctgacacctaccggctcttcggcaacatcctggacaagcaccggcaggtgggcaatgccgtgccaccgcccctggccaaagccattggcttggagatcaagctttgtatgttggccaaagcccgagagagtgcctcagctaaaataaaggaggaggaagctgctaaggactagttctgccctcccgtcacccctgtttctggcaccaggaatccccaacatgcactgatgttgtgtttttaacatgtcaatctgtccgttcacatgtgtggtacatggtgtttgtggccttggctgacatgaagctgttgtgtgaggttcgcttatcaactaatgatttagtgatcaaattgtgcagtactttgtgcattctggattttaaaagttttttattatgcattatatcaaatctaccactgtatgagtggaaattaagactttatgtagtttttatatgttgtaatatttcttcaaataaatctctcctataaacc

SEQ ID NO: 8604 - DNA, 4380 bp, Homo sapiens
gcagtgggctctggcggaggtcgggagaactgcagggcgaaggccgccgggggctccgcgggctgcggggggaggcacttgacaccggcccggggagaggaggggccgctgtccctgcggccagtgctggatgcggggacccagcgcagaagcagcgccaggtggagccatcgaagcccccacccacaggctgacagaggcaccgttcaccagagggctcaacaccgggatctatgtttaagttttaactctcgcctccaaagaccacgataattccttccccaaagcccagcagccccccagccccgcgcagccccagcctgcctcccggcgcccagatgcccgccatgccctccagcggccccggggacaccagcagctctgctgcggagcgggaggaggaccgaaaggacggagaggagcaggaggagccgcgtggcaaggaggagcgccaagagcccagcaccacggcacggaaggtggggcggcctgggaggaagcgcaagcaccccccggtggaaagcggtgacacgccaaaggaccctgcggtgatctccaagtccccatccatggcccaggactcaggcgcctcagagctattacccaatggggacttggagaagcggagtgagccccagccagaggaggggagccctgctggggggcagaagggcggggccccagcagagggagagggtgcagctgagaccctgcctgaagcctcaagagcagtggaaaatggctgctgcacccccaaggagggccgaggagcccctgcagaagcgggcaaagaacagaaggagaccaacatcgaatccatgaaaatggagggctcccggggccggctgcggggtggcttgggctgggagtccagcctccgtcagcggcccatgccgaggctcaccttccaggcgggggacccctactacatcagcaagcgcaagcgggacgagtggctggcacgctggaaaagggaggctgagaagaaagccaaggtcattgcaggaatgaatgctgtggaagaaaaccaggggcccggggagtctcagaaggtggaggaggccagccctcctgctgtgcagcagcccactgaccccgcatcccccactgtggctaccacgcctgagcccgtggggtccgatgctggggacaagaatgccaccaaagcaggcgatgacgagccagagtacgaggacggccggggctttggcattggggagctggtgtgggggaaactgcggggcttctcctggtggccaggccgcattgtgtcttggtggatgacgggccggagccgagcagctgaaggcacccgctgggtcatgtggttcggagacggcaaattctcagtggtgtgtgttgagaagctgatgccgctgagctcgttttgcagtgcgttccaccaggccacgtacaacaagcagcccatgtaccgcaaagccatctacgaggtcctgcaggtggccagcagccgcgcggggaagctgttcccggtgtgccacgacagcgatgagagtgacactgccaaggccgtggaggtgcagaacaagcccatgattgaatgggccctggggggcttccagccttctggccctaagggcctggagccaccagaagaagagaagaatccctacaaagaagtgtacacggacatgtgggtggaacctgaggcagctgcctacgcaccacctccaccagccaaaaagccccggaagagcacagcggagaagcccaaggtcaaggagattattgatgagcgcacaagagagcggctggtgtacgaggtgcggcagaagtgccggaacattgaggacatctgcatctcctgtgggagcctcaatgttaccctggaacaccccctcttcgttggaggaatgtgccaaaactgcaagaactgctttctggagtgtgcgtaccagtacgacgacgacggctaccagtcctactgcaccatctgctgtgggggccgtgaggtgctcatgtgcggaaacaacaactgctgcaggtgcttttgcgtggagtgtgtggacctcttggtggggccgggggctgcccaggcagccattaaggaagacccctggaactgctacatgtgcgggcacaagggtacctacgggctgctgcggcggcgagaggactggccctcccggctccagatgttcttcgctaataaccacgaccaggaatttgaccctccaaaggtttacccacctgtcccagctgagaagaggaagcccatccgggtgctgtctctctttgatggaatcgctacagggctcctggtgctgaaggacttgggcattcaggtggaccgctacattgcctcggaggtgtgtgaggactccatcacggtgggcatggtgcggcaccaggggaagatcatgtacgtcggggacgtccgcagcgtcacacagaagcatatccaggagtggggcccattcgatctggtgattgggggcagtccctgcaatgacctctccatcgtcaaccctgctcgcaagggcctctacgagggcactggccggctcttctttgagttctaccgcctcctgcatgatgcgcggcccaaggagggagatgatcgccccttcttctggctctttgagaatgtggtggccatgggcgttagtgacaagagggacatctcgcgatttctcgagtccaaccctgtgatgattgatgccaaagaagtgtcagctgcacacagggcccgctacttctggggtaaccttcccggtatgaacaggccgttggcatccactgtgaatgataagctggagctgcaggagtgtctggagcatggcaggatagccaagttcagcaaagtgaggaccattactacgaggtcaaactccataaagcagggcaaagaccagcattttcctgtcttcatgaatgagaaagaggacatcttatggtgcactgaaatggaaagggtatttggtttcccagtccactatactgacgtctccaacatgagccgcttggcgaggcagagactgctgggccggtcatggagcgtgccagtcatccgccacctcttcgctccgctgaaggagtattttgcgtgtgtgtaagggacatgggggcaaactgaggtagcgacacaaagttaaacaaacaaacaaaaaacacaaaacataataaaacaccaagaacatgaggatggagagaagtatcagcacccagaagagaaaaaggaatttaaaacaaaaaccacagaggcggaaataccggagggctttgccttgcgaaaagggttggacatcatctcctgatttttcaatgttattcttcagtcctatttaaaaacaaaaccaagctcccttcccttcctcccccttcccttttttttcggtcagaccttttattttctactcttttcagaggggttttctgtttgtttgggttttgtttcttgctgtgactgaaacaagaaggttattgcagcaaaaatcagtaacaaaaaatagtaacaataccttgcagaggaaaggtgggagagaggaaaaaaggaaattctatagaaatctatatattgggttgtttttttttttgttttttgttttttttttttgggtttttttttttactatatatcttttttttgttgtctctagcctgatcagataggagcacaagcaggggacggaaagagagagacactcaggcggcagcattccctcccagccactgagctgtcgtgccagcaccattcctggtcacgcaaaacagaacccagttagcagcagggagacgagaacaccacacaagacatttttctacagtatttcaggtgcctaccacacaggaaaccttgaagaaaatcagtttctagaagccgctgttacctcttgtttacagtttatatatatatgatagatatgagatatatatataaaaggtactgttaactactgtacaacccgacttcataatggtgctttcaaacagcgagatgagtaaaaacatcagcttccacgttgccttctgcgcaaagggtttcaccaaggatggagaaagggagacagcttgcagatggcgcgttctcacggtgggctcttccccttggtttgtaacgaagtgaaggaggagaacttgggagccaggttctccctgccaaaaagggggctagatgaggtggtcgggcccgtggacagctgagagtgggattcatccagactcatgcaataaccctttgattgttttctaaaaggagactccctcggcaagatggcagagggtacggagtcttcaggcccagtttctcactttagccaattcgagggctccttgtggtgggatcagaactaatccagagtgtgggaaagtgacagtcaaaaccccacctggagcaaataaaaaaacatacaaaacgta

SEQ ID NO: 8605 - DNA, 4279 bp, Homo sapiens
gacgcggcgccgcggcaccagggcgcgcagccgggccggcccgaccccaccggccatacggtggagccatcgaagcccccacccacaggctgacagaggcaccgttcaccagagggctcaacaccgggatctatgtttaagttttaactctcgcctccaaagaccacgataattccttccccaaagcccagcagccccccagccccgcgcagccccagcctgcctcccggcgcccagatgcccgccatgccctccagcggccccggggacaccagcagctctgctgcggagcgggaggaggaccgaaaggacggagaggagcaggaggagccgcgtggcaaggaggagcgccaagagcccagcaccacggcacggaaggtggggcggcctgggaggaagcgcaagcaccccccggtggaaagcggtgacacgccaaaggaccctgcggtgatctccaagtccccatccatggcccaggactcaggcgcctcagagctattacccaatggggacttggagaagcggagtgagccccagccagaggaggggagccctgctggggggcagaagggcggggccccagcagagggagagggtgcagctgagaccctgcctgaagcctcaagagcagtggaaaatggctgctgcacccccaaggagggccgaggagcccctgcagaagcgggcaaagaacagaaggagaccaacatcgaatccatgaaaatggagggctcccggggccggctgcggggtggcttgggctgggagtccagcctccgtcagcggcccatgccgaggctcaccttccaggcgggggacccctactacatcagcaagcgcaagcgggacgagtggctggcacgctggaaaagggaggctgagaagaaagccaaggtcattgcaggaatgaatgctgtggaagaaaaccaggggcccggggagtctcagaaggtggaggaggccagccctcctgctgtgcagcagcccactgaccccgcatcccccactgtggctaccacgcctgagcccgtggggtccgatgctggggacaagaatgccaccaaagcaggcgatgacgagccagagtacgaggacggccggggctttggcattggggagctggtgtgggggaaactgcggggcttctcctggtggccaggccgcattgtgtcttggtggatgacgggccggagccgagcagctgaaggcacccgctgggtcatgtggttcggagacggcaaattctcagtggtgtgtgttgagaagctgatgccgctgagctcgttttgcagtgcgttccaccaggccacgtacaacaagcagcccatgtaccgcaaagccatctacgaggtcctgcaggtggccagcagccgcgcggggaagctgttcccggtgtgccacgacagcgatgagagtgacactgccaaggccgtggaggtgcagaacaagcccatgattgaatgggccctggggggcttccagccttctggccctaagggcctggagccaccagaagaagagaagaatccctacaaagaagtgtacacggacatgtgggtggaacctgaggcagctgcctacgcaccacctccaccagccaaaaagccccggaagagcacagcggagaagcccaaggtcaaggagattattgatgagcgcacaagagagcggctggtgtacgaggtgcggcagaagtgccggaacattgaggacatctgcatctcctgtgggagcctcaatgttaccctggaacaccccctcttcgttggaggaatgtgccaaaactgcaagaactgctttctggagtgtgcgtaccagtacgacgacgacggctaccagtcctactgcaccatctgctgtgggggccgtgaggtgctcatgtgcggaaacaacaactgctgcaggtgcttttgcgtggagtgtgtggacctcttggtggggccgggggctgcccaggcagccattaaggaagacccctggaactgctacatgtgcgggcacaagggtacctacgggctgctgcggcggcgagaggactggccctcccggctccagatgttcttcgctaataaccacgaccaggaatttgaccctccaaaggtttacccacctgtcccagctgagaagaggaagcccatccgggtgctgtctctctttgatggaatcgctacagggctcctggtgctgaaggacttgggcattcaggtggaccgctacattgcctcggaggtgtgtgaggactccatcacggtgggcatggtgcggcaccaggggaagatcatgtacgtcggggacgtccgcagcgtcacacagaagcatatccaggagtggggcccattcgatctggtgattgggggcagtccctgcaatgacctctccatcgtcaaccctgctcgcaagggcctctacgagggcactggccggctcttctttgagttctaccgcctcctgcatgatgcgcggcccaaggagggagatgatcgccccttcttctggctctttgagaatgtggtggccatgggcgttagtgacaagagggacatctcgcgatttctcgagtccaaccctgtgatgattgatgccaaagaagtgtcagctgcacacagggcccgctacttctggggtaaccttcccggtatgaacaggccgttggcatccactgtgaatgataagctggagctgcaggagtgtctggagcatggcaggatagccaagttcagcaaagtgaggaccattactacgaggtcaaactccataaagcagggcaaagaccagcattttcctgtcttcatgaatgagaaagaggacatcttatggtgcactgaaatggaaagggtatttggtttcccagtccactatactgacgtctccaacatgagccgcttggcgaggcagagactgctgggccggtcatggagcgtgccagtcatccgccacctcttcgctccgctgaaggagtattttgcgtgtgtgtaagggacatgggggcaaactgaggtagcgacacaaagttaaacaaacaaacaaaaaacacaaaacataataaaacaccaagaacatgaggatggagagaagtatcagcacccagaagagaaaaaggaatttaaaacaaaaaccacagaggcggaaataccggagggctttgccttgcgaaaagggttggacatcatctcctgatttttcaatgttattcttcagtcctatttaaaaacaaaaccaagctcccttcccttcctcccccttcccttttttttcggtcagaccttttattttctactcttttcagaggggttttctgtttgtttgggttttgtttcttgctgtgactgaaacaagaaggttattgcagcaaaaatcagtaacaaaaaatagtaacaataccttgcagaggaaaggtgggagagaggaaaaaaggaaattctatagaaatctatatattgggttgtttttttttttgttttttgttttttttttttgggtttttttttttactatatatcttttttttgttgtctctagcctgatcagataggagcacaagcaggggacggaaagagagagacactcaggcggcagcattccctcccagccactgagctgtcgtgccagcaccattcctggtcacgcaaaacagaacccagttagcagcagggagacgagaacaccacacaagacatttttctacagtatttcaggtgcctaccacacaggaaaccttgaagaaaatcagtttctagaagccgctgttacctcttgtttacagtttatatatatatgatagatatgagatatatatataaaaggtactgttaactactgtacaacccgacttcataatggtgctttcaaacagcgagatgagtaaaaacatcagcttccacgttgccttctgcgcaaagggtttcaccaaggatggagaaagggagacagcttgcagatggcgcgttctcacggtgggctcttccccttggtttgtaacgaagtgaaggaggagaacttgggagccaggttctccctgccaaaaagggggctagatgaggtggtcgggcccgtggacagctgagagtgggattcatccagactcatgcaataaccctttgattgttttctaaaaggagactccctcggcaagatggcagagggtacggagtcttcaggcccagtttctcactttagccaattcgagggctccttgtggtgggatcagaactaatccagagtgtgggaaagtgacagtcaaaaccccacctggagcaaataaaaaaacatacaaaacgta

SEQ ID NO: 8606 - DNA, 3589 bp, Homo sapiens
ccgcccccagccccatcgcccccttcccctcccccaagacgggcagctacttccagagcttcagggccgcggctcacacctgagcgcgactgcagaggggctgcacctggccttatggggatcctggagcgggttgtgagaaggaatgggcgcgtggatcgtagcctgaaagacgagtgtgatacggctgagaagaaagccaaggtcattgcaggaatgaatgctgtggaagaaaaccaggggcccggggagtctcagaaggtggaggaggccagccctcctgctgtgcagcagcccactgaccccgcatcccccactgtggctaccacgcctgagcccgtggggtccgatgctggggacaagaatgccaccaaagcaggcgatgacgagccagagtacgaggacggccggggctttggcattggggagctggtgtgggggaaactgcggggcttctcctggtggccaggccgcattgtgtcttggtggatgacgggccggagccgagcagctgaaggcacccgctgggtcatgtggttcggagacggcaaattctcagtggtgtgtgttgagaagctgatgccgctgagctcgttttgcagtgcgttccaccaggccacgtacaacaagcagcccatgtaccgcaaagccatctacgaggtcctgcaggtggccagcagccgcgcggggaagctgttcccggtgtgccacgacagcgatgagagtgacactgccaaggccgtggaggtgcagaacaagcccatgattgaatgggccctggggggcttccagccttctggccctaagggcctggagccaccagaagaagagaagaatccctacaaagaagtgtacacggacatgtgggtggaacctgaggcagctgcctacgcaccacctccaccagccaaaaagccccggaagagcacagcggagaagcccaaggtcaaggagattattgatgagcgcacaagagagcggctggtgtacgaggtgcggcagaagtgccggaacattgaggacatctgcatctcctgtgggagcctcaatgttaccctggaacaccccctcttcgttggaggaatgtgccaaaactgcaagaactgctttctggagtgtgcgtaccagtacgacgacgacggctaccagtcctactgcaccatctgctgtgggggccgtgaggtgctcatgtgcggaaacaacaactgctgcaggtgcttttgcgtggagtgtgtggacctcttggtggggccgggggctgcccaggcagccattaaggaagacccctggaactgctacatgtgcgggcacaagggtacctacgggctgctgcggcggcgagaggactggccctcccggctccagatgttcttcgctaataaccacgaccaggaatttgaccctccaaaggtttacccacctgtcccagctgagaagaggaagcccatccgggtgctgtctctctttgatggaatcgctacagggctcctggtgctgaaggacttgggcattcaggtggaccgctacattgcctcggaggtgtgtgaggactccatcacggtgggcatggtgcggcaccaggggaagatcatgtacgtcggggacgtccgcagcgtcacacagaagcatatccaggagtggggcccattcgatctggtgattgggggcagtccctgcaatgacctctccatcgtcaaccctgctcgcaagggcctctacgagggcactggccggctcttctttgagttctaccgcctcctgcatgatgcgcggcccaaggagggagatgatcgccccttcttctggctctttgagaatgtggtggccatgggcgttagtgacaagagggacatctcgcgatttctcgagtccaaccctgtgatgattgatgccaaagaagtgtcagctgcacacagggcccgctacttctggggtaaccttcccggtatgaacaggccgttggcatccactgtgaatgataagctggagctgcaggagtgtctggagcatggcaggatagccaagttcagcaaagtgaggaccattactacgaggtcaaactccataaagcagggcaaagaccagcattttcctgtcttcatgaatgagaaagaggacatcttatggtgcactgaaatggaaagggtatttggtttcccagtccactatactgacgtctccaacatgagccgcttggcgaggcagagactgctgggccggtcatggagcgtgccagtcatccgccacctcttcgctccgctgaaggagtattttgcgtgtgtgtaagggacatgggggcaaactgaggtagcgacacaaagttaaacaaacaaacaaaaaacacaaaacataataaaacaccaagaacatgaggatggagagaagtatcagcacccagaagagaaaaaggaatttaaaacaaaaaccacagaggcggaaataccggagggctttgccttgcgaaaagggttggacatcatctcctgatttttcaatgttattcttcagtcctatttaaaaacaaaaccaagctcccttcccttcctcccccttcccttttttttcggtcagaccttttattttctactcttttcagaggggttttctgtttgtttgggttttgtttcttgctgtgactgaaacaagaaggttattgcagcaaaaatcagtaacaaaaaatagtaacaataccttgcagaggaaaggtgggagagaggaaaaaaggaaattctatagaaatctatatattgggttgtttttttttttgttttttgttttttttttttgggtttttttttttactatatatcttttttttgttgtctctagcctgatcagataggagcacaagcaggggacggaaagagagagacactcaggcggcagcattccctcccagccactgagctgtcgtgccagcaccattcctggtcacgcaaaacagaacccagttagcagcagggagacgagaacaccacacaagacatttttctacagtatttcaggtgcctaccacacaggaaaccttgaagaaaatcagtttctagaagccgctgttacctcttgtttacagtttatatatatatgatagatatgagatatatatataaaaggtactgttaactactgtacaacccgacttcataatggtgctttcaaacagcgagatgagtaaaaacatcagcttccacgttgccttctgcgcaaagggtttcaccaaggatggagaaagggagacagcttgcagatggcgcgttctcacggtgggctcttccccttggtttgtaacgaagtgaaggaggagaacttgggagccaggttctccctgccaaaaagggggctagatgaggtggtcgggcccgtggacagctgagagtgggattcatccagactcatgcaataaccctttgattgttttctaaaaggagactccctcggcaagatggcagagggtacggagtcttcaggcccagtttctcactttagccaattcgagggctccttgtggtgggatcagaactaatccagagtgtgggaaagtgacagtcaaaaccccacctggagcaaataaaaaaacatacaaaacgta

SEQ ID NO: 8607 - DNA, 2300 bp, Homo sapiens
ccgcccccagccccatcgcccccttcccctcccccaagacgggcagctacttccagagcttcagggccgcggctcacacctgagcgcgactgcagaggggctgcacctggccttatgggctgagaagaaagccaaggtcattgcaggaatgaatgctgtggaagaaaaccaggggcccggggagtctcagaaggtggaggaggccagccctcctgctgtgcagcagcccactgaccccgcatcccccactgtggctaccacgcctgagcccgtggggtccgatgctggggacaagaatgccaccaaagcaggcgatgacgagccagagtacgaggacggccggggctttggcattggggagctggtgtgggggaaactgcggggcttctcctggtggccaggccgcattgtgtcttggtggatgacgggccggagccgagcagctgaaggcacccgctgggtcatgtggttcggagacggcaaattctcagtggtgtgtgttgagaagctgatgccgctgagctcgttttgcagtgcgttccaccaggccacgtacaacaagcagcccatgtaccgcaaagccatctacgaggtcctgcaggtggccagcagccgcgcggggaagctgttcccggtgtgccacgacagcgatgagagtgacactgccaaggccgtggaggtgcagaacaagcccatgattgaatgggccctggggggcttccagccttctggccctaagggcctggagccaccagaagaagagaagaatccctacaaagaagtgtacacggacatgtgggtggaacctgaggcagctgcctacgcaccacctccaccagccaaaaagccccggaagagcacagcggagaagcccaaggtcaaggagattattgatgagcgcacaagagagcggctggtgtacgaggtgcggcagaagtgccggaacattgaggacatctgcatctcctgtgggagcctcaatgttaccctggaacaccccctcttcgttggaggaatgtgccaaaactgcaagaactgctttctggagtgtgcgtaccagtacgacgacgacggctaccagtcctactgcaccatctgctgtgggggccgtgaggtgctcatgtgcggaaacaacaactgctgcaggtgcttttgcgtggagtgtgtggacctcttggtggggccgggggctgcccaggcagccattaaggaagacccctggaactgctacatgtgcgggcacaagggtacctacgggctgctgcggcggcgagaggactggccctcccggctccagatgttcttcgctaataaccacgaccaggaatttgaccctccaaaggtttacccacctgtcccagctgagaagaggaagcccatccgggtgctgtctctctttgatggaatcgctacagggctcctggtgctgaaggacttgggcattcaggtggaccgctacattgcctcggaggtgtgtgaggactccatcacggtgggcatggtgcggcaccaggggaagatcatgtacgtcggggacgtccgcagcgtcacacagaagcatatccaggagtggggcccattcgatctggtgattgggggcagtccctgcaatgacctctccatcgtcaaccctgctcgcaagggcctctacgagggcactggccggctcttctttgagttctaccgcctcctgcatgatgcgcggcccaaggagggagatgatcgccccttcttctggctctttgagaatgtggtggccatgggcgttagtgacaagagggacatctcgcgatttctcgagtccaaccctgtgatgattgatgccaaagaagtgtcagctgcacacagggcccgctacttctggggtaaccttcccggtatgaacaggccgttggcatccactgtgaatgataagctggagctgcaggagtgtctggagcatggcaggatagccaagttcagcaaagtgaggaccattactacgaggtcaaactccataaagcagggcaaagaccagcattttcctgtcttcatgaatgagaaagaggacatcttatggtgcactgaaatggaaagggtatttggtttcccagtccactatactgacgtctccaacatgagccgcttggcgaggcagagactgctgggccggtcatggagcgtgccagtcatccgccacctcttcgctccgctgaaggagtattttgcgtgtgtgtaagggacatgggggcaaactgaggtagcgacacaaagttaaacaaacaaacaaaaaacacaaaacataataaaacaccaagaac

SEQ ID NO: 8608 - DNA, 1775 bp, Homo sapiens
gcagtgggctctggcggaggtcgggagaactgcagggcgaaggccgccgggggctccgcgggctgcggggggaggcacttgacaccggcccggggagaggaggggccgctgtccctgcggccagtgctggatgcggggacccagcgcagaagcagcgccaggtggagccatcgaagcccccacccacaggctgacagaggcaccgttcaccagagggctcaacaccgggatctatgtttaagttttaactctcgcctccaaagaccacgataattccttccccaaagcccagcagccccccagccccgcgcagccccagcctgcctcccggcgcccagatgcccgccatgccctccagcggccccggggacaccagcagctctgctgcggagcgggaggaggaccgaaaggacggagaggagcaggaggagccgcgtggcaaggaggagcgccaagagcccagcaccacggcacggaaggtggggcggcctgggaggaagcgcaagcaccccccggtggaaagcggtgacacgccaaaggaccctgcggtgatctccaagtccccatccatggcccaggactcaggcgcctcagagctattacccaatggggacttggagaagcggagtgagccccagccagaggaggggagccctgctggggggcagaagggcggggccccagcagagggagagggtgcagctgagaccctgcctgaagcctcaagagcagtggaaaatggctgctgcacccccaaggagggccgaggagcccctgcagaagcgggtgagtcctcagcaccaggggcagcctcttctgggcccaccagcataccctgagagtcagggacttggctctccagcaggtcccaggaaggatggtctgggtcgtggctaaaggtctgcttgccaaggctatggcctggaggctactggctggatgcagcctgcgcatatgttttatttggcccatagagtgttttaaacatttaaaaaattagttgccagtatttaaaaatcaaaaaatttcacataaaaatctggagttttggcttctcatgaaaaaaaaaaaagctagatctggcaacagcgggctttcataacgccaacgattgctagactgggataatggcggtccctccatcgccttctgtggctggttgtgggccttagttttctgcagctctacctggcctgcttactctcccacgtgccatgcagttcctgggggttgctgtatttgtagcccctggcctgggcactcaagggcagcagataccctgtttgcctccctgagtgcagaggtcctgagcccaccctagttgggctgactcaactggaaatttggttgtgacagtggcgtggggagagggctgggtgattgtattctgtgtactgcccagcccaggcctcttcatctggggactttttggcctaaccctggaagcctggaaagttgcccacttttctctttcaggttaagccagcaatttcagggccaaccgagctgtaaacatgttagtaatgaggacaactagcatttgtacagggcttcacagtttacaaagcgctttctcatacattatcacatttgatcctcccagggccctgccaggttgttttgcatatgtgcattttaatttcaaaaagtcttccttccaagcgtgtatgatgaaatgagtaaattgattaattggcgtaacttattttgcatggatccaacctaatgttcatgcaggatagagaacatttccagaatacaaatttccaaactta

SEQ ID NO: 8609 - DNA, 4255 bp, Homo sapiens
gaagggagagagcaaacaaaggggtcaggagggaaaataatgcactggcttcctgagcccctgcagaggctgagcagggagagggggccagggccagaggggacagaggctggcggcagacgggccgggacaggcaggtcctaaatggcattgtttgaaggggccggctaattgcacagagcagtctgagcctgagaccccagccctggcctccccactctgtcctgggtgctggcgtctgagccttcgggacagcctgtccacatggaaccaagtcctgagcctccaagcttggaaagcatgaagggagacaccaggcatctcaatggagaggaggacgccggcgggagggaagactcgatcctcgtcaacggggcctgcagcgaccagtcctccgactcgcccccaatcctggaggctatccgcaccccggagatcagaggccgaagatcaagctcgcgactctccaagagggaggtgtccagtctgctaagctacacacaggacttgacaggcgatggcgacggggaagatggggatggctctgacaccccagtcatgccaaagctcttccgggaaaccaggactcgttcagaaagcccagctgtccgaactcgaaataacaacagtgtctccagccgggagaggcacaggccttccccacgttccacccgaggccggcagggccgcaaccatgtggacgagtcccccgtggagttcccggctaccaggtccctgagacggcgggcaacagcatcggcaggaacgccatggccgtcccctcccagctcttaccttaccatcgacctcacagacgacacagaggacacacatgggacgccccagagcagcagtaccccctacgcccgcctagcccaggacagccagcaggggggcatggagtccccgcaggtggaggcagacagtggagatggagacagttcagagtatcaggatgggaaggagtttggaataggggacctcgtgtggggaaagatcaagggcttctcctggtggcccgccatggtggtgtcttggaaggccacctccaagcgacaggctatgtctggcatgcggtgggtccagtggtttggcgatggcaagttctccgaggtctctgcagacaaactggtggcactggggctgttcagccagcactttaatttggccaccttcaataagctcgtctcctatcgaaaagccatgtaccatgctctggagaaagctagggtgcgagctggcaagaccttccccagcagccctggagactcattggaggaccagctgaagcccatgttggagtgggcccacgggggcttcaagcccactgggatcgagggcctcaaacccaacaacacgcaaccagagaacaagactcgaagacgcacagctgacgactcagccacctctgactactgccccgcacccaagcgcctcaagacaaattgctataacaacggcaaagaccgaggggatgaagatcagagccgagaacaaatggcttcagatgttgccaacaacaagagcagcctggaagatggctgtttgtcttgtggcaggaaaaaccccgtgtccttccaccctctctttgagggggggctctgtcagacatgccgggatcgcttccttgagctgttttacatgtatgatgacgatggctatcagtcttactgcactgtgtgctgcgagggccgagagctgctgctttgcagcaacacgagctgctgccggtgtttctgtgtggagtgcctggaggtgctggtgggcacaggcacagcggccgaggccaagcttcaggagccctggagctgttacatgtgtctcccgcagcgctgtcatggcgtcctgcggcgccggaaggactggaacgtgcgcctgcaggccttcttcaccagtgacacggggcttgaatatgaagcccccaagctgtaccctgccattcccgcagcccgaaggcggcccattcgagtcctgtcattgtttgatggcatcgcgacaggctacctagtcctcaaagagttgggcataaaggtaggaaagtacgtcgcttctgaagtgtgtgaggagtccattgctgttggaaccgtgaagcacgaggggaatatcaaatacgtgaacgacgtgaggaacatcacaaagaaaaatattgaagaatggggcccatttgacttggtgattggcggaagcccatgcaacgatctctcaaatgtgaatccagccaggaaaggcctgtatgagggtacaggccggctcttcttcgaattttaccacctgctgaattactcacgccccaaggagggtgatgaccggccgttcttctggatgtttgagaatgttgtagccatgaaggttggcgacaagagggacatctcacggttcctggagtgtaatccagtgatgattgatgccatcaaagtttctgctgctcacagggcccgatacttctggggcaacctacccgggatgaacaggcccgtgatagcatcaaagaatgataaactcgagctgcaggactgcttggaatacaataggatagccaagttaaagaaagtacagacaataaccaccaagtcgaactcgatcaaacaggggaaaaaccaacttttccctgttgtcatgaatggcaaagaagatgttttgtggtgcactgagctcgaaaggatctttggctttcctgtgcactacacagacgtgtccaacatgggccgtggtgcccgccagaagctgctgggaaggtcctggagcgtgcctgtcatccgacacctcttcgcccctctgaaggactactttgcatgtgaatagttccagccaggccccaagcccactggggtgtgtggcagagccaggacccaggaggtgtgattcctgaaggcatccccaggccctgctcttcctcagctgtgtgggtcataccgtgtacctcagttccctcttgctcagtgggggcagagccacctgactcttgcaggggtagcctgaggtgccgcctccttgtgcacaaatcagacctggctgcttggagcagcctaacacggtgctcattttttcttctcctaaaactttaaaacttgaagtaggtagcaacgtggctttttttttttcccttcctgggtctaccactcagagaaacaatggctaagataccaaaaccacagtgccgacagctctccaatactcaggttaatgctgaaaaatcatccaagacagttattgcaagagtttaatttttgaaaactggctactgctctgtgtttacagacgtgtgcagttgtaggcatgtagctacaggacatttttaagggcccaggatcgttttttcccagggcaagcagaagagaaaatgttgtatatgtcttttacccggcacattccccttgcctaaatacaagggctggagtctgcacgggacctattagagtattttccacaatgatgatgatttcagcagggatgacgtcatcatcacattcagggctattttttcccccacaaacccaagggcaggggccactcttagctaaatccctccccgtgactgcaatagaaccctctggggagctcaggaaggggtgtgctgagttctataatataagctgccatatattttgtagacaagtatggctcctccatatctccctcttccctaggagaggagtgtgaagcaaggagcttagataagacaccccctcaaacccattccctctccaggagacctaccctccacaggcacaggtccccagatgagaagtctgctaccctcatttctcatctttttactaaactcagaggcagtgacagcagtcagggacagacatacatttctcataccttccccacatctgagagatgacagggaaaactgcaaagctcggtgctccctttggagattttttaatccttttttattccataagaagtcgtttttagggagaacgggaattcagacaagctgcatttcagaaatgctgtcataatggtttttaacaccttttactcttcttactggtgctattttgtagaataaggaacaacgttgacaagttttgtggggctttttatacactttttaaaatctcaaacttctatttttatgtttaacgttttcattaaaattttttttgtaactggagccacgacgtaacaaatatggggaaaaaactgtgccttgtttcaacagtttttgctaatttttaggctgaaagatgacggatgcctagagtttaccttatgtttaattaaaatcagtatttgtcta

SEQ ID NO: 8610 - DNA, 4336 bp, Homo sapiens
acccactcccgctgccccgtccggcccgcgccgcttcctcgcagcagctgctcccggctccgcggccgcagcccgcgtggacgctccgagcgccccccgacggacgggaccggctccctggcggtcgggcgagcgggcggcaacgctgcccggccggcagcgctggggttaagtggcccaagtaaacctagctcggcgatcggcgccggagattcgcgagcccagcgccctgcacggccgccagccggcctcccgccagccagccccgacccgcggctccgccgcccagccgcgccccagccagccctgcggcaggaaagcatgaagggagacaccaggcatctcaatggagaggaggacgccggcgggagggaagactcgatcctcgtcaacggggcctgcagcgaccagtcctccgactcgcccccaatcctggaggctatccgcaccccggagatcagaggccgaagatcaagctcgcgactctccaagagggaggtgtccagtctgctaagctacacacaggacttgacaggcgatggcgacggggaagatggggatggctctgacaccccagtcatgccaaagctcttccgggaaaccaggactcgttcagaaagcccagctgtccgaactcgaaataacaacagtgtctccagccgggagaggcacaggccttccccacgttccacccgaggccggcagggccgcaaccatgtggacgagtcccccgtggagttcccggctaccaggtccctgagacggcgggcaacagcatcggcaggaacgccatggccgtcccctcccagctcttaccttaccatcgacctcacagacgacacagaggacacacatgggacgccccagagcagcagtaccccctacgcccgcctagcccaggacagccagcaggggggcatggagtccccgcaggtggaggcagacagtggagatggagacagttcagagtatcaggatgggaaggagtttggaataggggacctcgtgtggggaaagatcaagggcttctcctggtggcccgccatggtggtgtcttggaaggccacctccaagcgacaggctatgtctggcatgcggtgggtccagtggtttggcgatggcaagttctccgaggtctctgcagacaaactggtggcactggggctgttcagccagcactttaatttggccaccttcaataagctcgtctcctatcgaaaagccatgtaccatgctctggagaaagctagggtgcgagctggcaagaccttccccagcagccctggagactcattggaggaccagctgaagcccatgttggagtgggcccacgggggcttcaagcccactgggatcgagggcctcaaacccaacaacacgcaaccagtggttaataagtcgaaggtgcgtcgtgcaggcagtaggaaattagaatcaaggaaatacgagaacaagactcgaagacgcacagctgacgactcagccacctctgactactgccccgcacccaagcgcctcaagacaaattgctataacaacggcaaagaccgaggggatgaagatcagagccgagaacaaatggcttcagatgttgccaacaacaagagcagcctggaagatggctgtttgtcttgtggcaggaaaaaccccgtgtccttccaccctctctttgagggggggctctgtcagacatgccgggatcgcttccttgagctgttttacatgtatgatgacgatggctatcagtcttactgcactgtgtgctgcgagggccgagagctgctgctttgcagcaacacgagctgctgccggtgtttctgtgtggagtgcctggaggtgctggtgggcacaggcacagcggccgaggccaagcttcaggagccctggagctgttacatgtgtctcccgcagcgctgtcatggcgtcctgcggcgccggaaggactggaacgtgcgcctgcaggccttcttcaccagtgacacggggcttgaatatgaagcccccaagctgtaccctgccattcccgcagcccgaaggcggcccattcgagtcctgtcattgtttgatggcatcgcgacaggctacctagtcctcaaagagttgggcataaaggtaggaaagtacgtcgcttctgaagtgtgtgaggagtccattgctgttggaaccgtgaagcacgaggggaatatcaaatacgtgaacgacgtgaggaacatcacaaagaaaaatattgaagaatggggcccatttgacttggtgattggcggaagcccatgcaacgatctctcaaatgtgaatccagccaggaaaggcctgtatgagggtacaggccggctcttcttcgaattttaccacctgctgaattactcacgccccaaggagggtgatgaccggccgttcttctggatgtttgagaatgttgtagccatgaaggttggcgacaagagggacatctcacggttcctggagtgtaatccagtgatgattgatgccatcaaagtttctgctgctcacagggcccgatacttctggggcaacctacccgggatgaacaggcccgtgatagcatcaaagaatgataaactcgagctgcaggactgcttggaatacaataggatagccaagttaaagaaagtacagacaataaccaccaagtcgaactcgatcaaacaggggaaaaaccaacttttccctgttgtcatgaatggcaaagaagatgttttgtggtgcactgagctcgaaaggatctttggctttcctgtgcactacacagacgtgtccaacatgggccgtggtgcccgccagaagctgctgggaaggtcctggagcgtgcctgtcatccgacacctcttcgcccctctgaaggactactttgcatgtgaatagttccagccaggccccaagcccactggggtgtgtggcagagccaggacccaggaggtgtgattcctgaaggcatccccaggccctgctcttcctcagctgtgtgggtcataccgtgtacctcagttccctcttgctcagtgggggcagagccacctgactcttgcaggggtagcctgaggtgccgcctccttgtgcacaaatcagacctggctgcttggagcagcctaacacggtgctcattttttcttctcctaaaactttaaaacttgaagtaggtagcaacgtggctttttttttttcccttcctgggtctaccactcagagaaacaatggctaagataccaaaaccacagtgccgacagctctccaatactcaggttaatgctgaaaaatcatccaagacagttattgcaagagtttaatttttgaaaactggctactgctctgtgtttacagacgtgtgcagttgtaggcatgtagctacaggacatttttaagggcccaggatcgttttttcccagggcaagcagaagagaaaatgttgtatatgtcttttacccggcacattccccttgcctaaatacaagggctggagtctgcacgggacctattagagtattttccacaatgatgatgatttcagcagggatgacgtcatcatcacattcagggctattttttcccccacaaacccaagggcaggggccactcttagctaaatccctccccgtgactgcaatagaaccctctggggagctcaggaaggggtgtgctgagttctataatataagctgccatatattttgtagacaagtatggctcctccatatctccctcttccctaggagaggagtgtgaagcaaggagcttagataagacaccccctcaaacccattccctctccaggagacctaccctccacaggcacaggtccccagatgagaagtctgctaccctcatttctcatctttttactaaactcagaggcagtgacagcagtcagggacagacatacatttctcataccttccccacatctgagagatgacagggaaaactgcaaagctcggtgctccctttggagattttttaatccttttttattccataagaagtcgtttttagggagaacgggaattcagacaagctgcatttcagaaatgctgtcataatggtttttaacaccttttactcttcttactggtgctattttgtagaataaggaacaacgttgacaagttttgtggggctttttatacactttttaaaatctcaaacttctatttttatgtttaacgttttcattaaaattttttttgtaactggagccacgacgtaacaaatatggggaaaaaactgtgccttgtttcaacagtttttgctaatttttaggctgaaagatgacggatgcctagagtttaccttatgtttaattaaaatcagtatttgtcta

SEQ ID NO: 8611 - DNA, 3932 bp, Homo sapiens
gcgccctgcacggccgccagccggcctcccgccagccagccccgacccgcggctccgccgcccagccgcgccccagccagccctgcggcaggaaagcatgaagggagacaccaggcatctcaatggagaggaggacgccggcgggagggaagactcgatcctcgtcaacggggcctgcagcgaccagtcctccgactcgcccccaatcctggaggctatccgcaccccggagatcagaggccgaagatcaagctcgcgactctccaagagggaggtgtccagtctgctaagctacacacaggacttgacaggcgatggcgacggggaagatggggatggctctgacaccccagtcatgccaaagctcttccgggaaaccaggactcgttcagaaagcccagctgtccgaactcgaaataacaacagtgtctccagccgggagaggcacaggccttccccacgttccacccgaggccggcagggccgcaaccatgtggacgagtcccccgtggagttcccggctaccaggtccctgagacggcgggcaacagcatcggcaggaacgccatggccgtcccctcccagctcttaccttaccatcgacctcacagacgacacagaggacacacatgggacgccccagagcagcagtaccccctacgcccgcctagcccaggacagccagcaggggggcatggagtccccgcaggtggaggcagacagtggagatggagacagttcagagtatcaggatgggaaggagtttggaataggggacctcgtgtggggaaagatcaagggcttctcctggtggcccgccatggtggtgtcttggaaggccacctccaagcgacaggctatgtctggcatgcggtgggtccagtggtttggcgatggcaagttctccgaggtctctgcagacaaactggtggcactggggctgttcagccagcactttaatttggccaccttcaataagctcgtctcctatcgaaaagccatgtaccatgctctggagaaagctagggtgcgagctggcaagaccttccccagcagccctggagactcattggaggaccagctgaagcccatgttggagtgggcccacgggggcttcaagcccactgggatcgagggcctcaaacccaacaacacgcaaccagagaacaagactcgaagacgcacagctgacgactcagccacctctgactactgccccgcacccaagcgcctcaagacaaattgctataacaacggcaaagaccgaggggatgaagatcagagccgagaacaaatggcttcagatgttgccaacaacaagagcagcctggaagatggctgtttgtcttgtggcaggaaaaaccccgtgtccttccaccctctctttgagggggggctctgtcagacatgccgggatcgcttccttgagctgttttacatgtatgatgacgatggctatcagtcttactgcactgtgtgctgcgagggccgagagctgctgctttgcagcaacacgagctgctgccggtgtttctgtgtggagtgcctggaggtgctggtgggcacaggcacagcggccgaggccaagcttcaggagccctggagctgttacatgtgtctcccgcagcgctgtcatggcgtcctgcggcgccggaaggactggaacgtgcgcctgcaggccttcttcaccagtgacacggggcttgaatatgaagcccccaagctgtaccctgccattcccgcagcccgaaggcggcccattcgagtcctgtcattgtttgatggcatcgcgacaggctacctagtcctcaaagagttgggcataaaggtaggaaagtacgtcgcttctgaagtgtgtgaggagtccattgctgttggaaccgtgaagcacgaggggaatatcaaatacgtgaacgacgtgaggaacatcacaaagaaaaatattgaagaatggggcccatttgacttggtgattggcggaagcccatgcaacgatctctcaaatgtgaatccagccaggaaaggcctgtatgagggtacaggccggctcttcttcgaattttaccacctgctgaattactcacgccccaaggagggtgatgaccggccgttcttctggatgtttgagaatgttgtagccatgaaggttggcgacaagagggacatctcacggttcctggagtgtaatccagtgatgattgatgccatcaaagtttctgctgctcacagggcccgatacttctggggcaacctacccgggatgaacaggcccgtgatagcatcaaagaatgataaactcgagctgcaggactgcttggaatacaataggatagccaaggatctttggctttcctgtgcactacacagacgtgtccaacatgggccgtggtgcccgccagaagctgctgggaaggtcctggagcgtgcctgtcatccgacacctcttcgcccctctgaaggactactttgcatgtgaatagttccagccaggccccaagcccactggggtgtgtggcagagccaggacccaggaggtgtgattcctgaaggcatccccaggccctgctcttcctcagctgtgtgggtcataccgtgtacctcagttccctcttgctcagtgggggcagagccacctgactcttgcaggggtagcctgaggtgccgcctccttgtgcacaaatcagacctggctgcttggagcagcctaacacggtgctcattttttcttctcctaaaactttaaaacttgaagtaggtagcaacgtggctttttttttttcccttcctgggtctaccactcagagaaacaatggctaagataccaaaaccacagtgccgacagctctccaatactcaggttaatgctgaaaaatcatccaagacagttattgcaagagtttaatttttgaaaactggctactgctctgtgtttacagacgtgtgcagttgtaggcatgtagctacaggacatttttaagggcccaggatcgttttttcccagggcaagcagaagagaaaatgttgtatatgtcttttacccggcacattccccttgcctaaatacaagggctggagtctgcacgggacctattagagtattttccacaatgatgatgatttcagcagggatgacgtcatcatcacattcagggctattttttcccccacaaacccaagggcaggggccactcttagctaaatccctccccgtgactgcaatagaaccctctggggagctcaggaaggggtgtgctgagttctataatataagctgccatatattttgtagacaagtatggctcctccatatctccctcttccctaggagaggagtgtgaagcaaggagcttagataagacaccccctcaaacccattccctctccaggagacctaccctccacaggcacaggtccccagatgagaagtctgctaccctcatttctcatctttttactaaactcagaggcagtgacagcagtcagggacagacatacatttctcataccttccccacatctgagagatgacagggaaaactgcaaagctcggtgctccctttggagattttttaatccttttttattccataagaagtcgtttttagggagaacgggaattcagacaagctgcatttcagaaatgctgtcataatggtttttaacaccttttactcttcttactggtgctattttgtagaataaggaacaacgttgacaagttttgtggggctttttatacactttttaaaatctcaaacttctatttttatgtttaacgttttcattaaaattttttttgtaactggagccacgacgtaacaaatatggggaaaaaactgtgccttgtttcaacagtttttgctaatttttaggctgaaagatgacggatgcctagagtttaccttatgtttaattaaaatcagtatttgtct

SEQ ID NO: 8612 - DNA, 4048 bp, Homo sapiens
cgcagcagctgctcccggctccgcggccgcagcccgcgtggacgctccgagcgccccccgacggacgggaccggctccctggcggtcgggcgagcgggcggcaacgctgcccggccggcagcgctggggttaagtggcccaagtaaacctagctcggcgatcggcgccggagattcgcgagcccagcgccctgcacggccgccagccggcctcccgccagccagccccgacccgcggctccgccgcccagccgcgccccagccagccctgcggcaggaaagcatgaagggagacaccaggcatctcaatggagaggaggacgccggcgggagggaagactcgatcctcgtcaacggggcctgcagcgaccagtcctccgactcgcccccaatcctggaggctatccgcaccccggagatcagaggccgaagatcaagctcgcgactctccaagagggaggtgtccagtctgctaagctacacacaggacttgacaggcgatggcgacggggaagatggggatggctctgacaccccagtcatgccaaagctcttccgggaaaccaggactcgttcagaaagcccagctgtccgaactcgaaataacaacagtgtctccagccgggagaggcacaggccttccccacgttccacccgaggccggcagggccgcaaccatgtggacgagtcccccgtggagttcccggctaccaggtccctgagacggcgggcaacagcatcggcaggaacgccatggccgtcccctcccagctcttaccttaccatcgacctcacagacgacacagaggacacacatgggacgccccagagcagcagtaccccctacgcccgcctagcccaggacagccagcaggggggcatggagtccccgcaggtggaggcagacagtggagatggagacagttcagagtatcaggatgggaaggagtttggaataggggacctcgtgtggggaaagatcaagggcttctcctggtggcccgccatggtggtgtcttggaaggccacctccaagcgacaggctatgtctggcatgcggtgggtccagtggtttggcgatggcaagttctccgaggtctctgcagacaaactggtggcactggggctgttcagccagcactttaatttggccaccttcaataagctcgtctcctatcgaaaagccatgtaccatgctctggagaaagctagggtgcgagctggcaagaccttccccagcagccctggagactcattggaggaccagctgaagcccatgttggagtgggcccacgggggcttcaagcccactgggatcgagggcctcaaacccaacaacacgcaaccagagaacaagactcgaagacgcacagctgacgactcagccacctctgactactgccccgcacccaagcgcctcaagacaaattgctataacaacggcaaagaccgaggggatgaagatcagagccgagaacaaatggcttcagatgttgccaacaacaagagcagcctggaagatggctgtttgtcttgtggcaggaaaaaccccgtgtccttccaccctctctttgagggggggctctgtcagacatgccgggatcgcttccttgagctgttttacatgtatgatgacgatggctatcagtcttactgcactgtgtgctgcgagggccgagagctgctgctttgcagcaacacgagctgctgccggtgtttctgtgtggagtgcctggaggtgctggtgggcacaggcacagcggccgaggccaagcttcaggagccctggagctgttacatgtgtctcccgcagcgctgtcatggcgtcctgcggcgccggaaggactggaacgtgcgcctgcaggccttcttcaccagtgacacggggcttgaatatgaagcccccaagctgtaccctgccattcccgcagcccgaaggcggcccattcgagtcctgtcattgtttgatggcatcgcgacaggctacctagtcctcaaagagttgggcataaaggtaggaaagtacgtcgcttctgaagtgtgtgaggagtccattgctgttggaaccgtgaagcacgaggggaatatcaaatacgtgaacgacgtgaggaacatcacaaagaaaaatattgaagaatggggcccatttgacttggtgattggcggaagcccatgcaacgatctctcaaatgtgaatccagccaggaaaggcctgtatgagggtacaggccggctcttcttcgaattttaccacctgctgaattactcacgccccaaggagggtgatgaccggccgttcttctggatgtttgagaatgttgtagccatgaaggttggcgacaagagggacatctcacggttcctggagtgtaatccagtgatgattgatgccatcaaagtttctgctgctcacagggcccgatacttctggggcaacctacccgggatgaacaggatctttggctttcctgtgcactacacagacgtgtccaacatgggccgtggtgcccgccagaagctgctgggaaggtcctggagcgtgcctgtcatccgacacctcttcgcccctctgaaggactactttgcatgtgaatagttccagccaggccccaagcccactggggtgtgtggcagagccaggacccaggaggtgtgattcctgaaggcatccccaggccctgctcttcctcagctgtgtgggtcataccgtgtacctcagttccctcttgctcagtgggggcagagccacctgactcttgcaggggtagcctgaggtgccgcctccttgtgcacaaatcagacctggctgcttggagcagcctaacacggtgctcattttttcttctcctaaaactttaaaacttgaagtaggtagcaacgtggctttttttttttcccttcctgggtctaccactcagagaaacaatggctaagataccaaaaccacagtgccgacagctctccaatactcaggttaatgctgaaaaatcatccaagacagttattgcaagagtttaatttttgaaaactggctactgctctgtgtttacagacgtgtgcagttgtaggcatgtagctacaggacatttttaagggcccaggatcgttttttcccagggcaagcagaagagaaaatgttgtatatgtcttttacccggcacattccccttgcctaaatacaagggctggagtctgcacgggacctattagagtattttccacaatgatgatgatttcagcagggatgacgtcatcatcacattcagggctattttttcccccacaaacccaagggcaggggccactcttagctaaatccctccccgtgactgcaatagaaccctctggggagctcaggaaggggtgtgctgagttctataatataagctgccatatattttgtagacaagtatggctcctccatatctccctcttccctaggagaggagtgtgaagcaaggagcttagataagacaccccctcaaacccattccctctccaggagacctaccctccacaggcacaggtccccagatgagaagtctgctaccctcatttctcatctttttactaaactcagaggcagtgacagcagtcagggacagacatacatttctcataccttccccacatctgagagatgacagggaaaactgcaaagctcggtgctccctttggagattttttaatccttttttattccataagaagtcgtttttagggagaacgggaattcagacaagctgcatttcagaaatgctgtcataatggtttttaacaccttttactcttcttactggtgctattttgtagaataaggaacaacgttgacaagttttgtggggctttttatacactttttaaaatctcaaacttctatttttatgtttaacgttttcattaaaattttttttgtaactggagccacgacgtaacaaatatggggaaaaaactgtgccttgtttcaacagtttttgctaatttttaggctgaaagatgacggatgcctagagtttaccttatgtttaattaaaatcagtatttgtcta

SEQ ID NO: 8613 - DNA, 4237 bp, Homo sapiens
cgcagcagctgctcccggctccgcggccgcagcccgcgtggacgctccgagcgccccccgacggacgggaccggctccctggcggtcgggcgagcgggcggcaacgctgcccggccggcagcgctggggttaagtggcccaagtaaacctagctcggcgatcggcgccggagattcgcgagcccagcgccctgcacggccgccagccggcctcccgccagccagccccgacccgcggctccgccgcccagccgcgccccagccagccctgcggcaggaaagcatgaagggagacaccaggcatctcaatggagaggaggacgccggcgggagggaagactcgatcctcgtcaacggggcctgcagcgaccagtcctccgactcgcccccaatcctggaggctatccgcaccccggagatcagaggccgaagatcaagctcgcgactctccaagagggaggtgtccagtctgctaagctacacacaggacttgacaggcgatggcgacggggaagatggggatggctctgacaccccagtcatgccaaagctcttccgggaaaccaggactcgttcagaaagcccagctgtccgaactcgaaataacaacagtgtctccagccgggagaggcacaggccttccccacgttccacccgaggccggcagggccgcaaccatgtggacgagtcccccgtggagttcccggctaccaggtccctgagacggcgggcaacagcatcggcaggaacgccatggccgtcccctcccagctcttaccttaccatcgacctcacagacgacacagaggacacacatgggacgccccagagcagcagtaccccctacgcccgcctagcccaggacagccagcaggggggcatggagtccccgcaggtggaggcagacagtggagatggagacagttcagagtatcaggatgggaaggagtttggaataggggacctcgtgtggggaaagatcaagggcttctcctggtggcccgccatggtggtgtcttggaaggccacctccaagcgacaggctatgtctggcatgcggtgggtccagtggtttggcgatggcaagttctccgaggtctctgcagacaaactggtggcactggggctgttcagccagcactttaatttggccaccttcaataagctcgtctcctatcgaaaagccatgtaccatgctctggagaaagctagggtgcgagctggcaagaccttccccagcagccctggagactcattggaggaccagctgaagcccatgttggagtgggcccacgggggcttcaagcccactgggatcgagggcctcaaacccaacaacacgcaaccagagaacaagactcgaagacgcacagctgacgactcagccacctctgactactgccccgcacccaagcgcctcaagacaaattgctataacaacggcaaagaccgaggggatgaagatcagagccgagaacaaatggcttcagatgttgccaacaacaagagcagcctggaagatggctgtttgtcttgtggcaggaaaaaccccgtgtccttccaccctctctttgagggggggctctgtcagacatgccgggatcgcttccttgagctgttttacatgtatgatgacgatggctatcagtcttactgcactgtgtgctgcgagggccgagagctgctgctttgcagcaacacgagctgctgccggtgtttctgtgtggagtgcctggaggtgctggtgggcacaggcacagcggccgaggccaagcttcaggagccctggagctgttacatgtgtctcccgcagcgctgtcatggcgtcctgcggcgccggaaggactggaacgtgcgcctgcaggccttcttcaccagtgacacggggcttgaatatgaagcccccaagctgtaccctgccattcccgcagcccgaaggcggcccattcgagtcctgtcattgtttgatggcatcgcgacaggctacctagtcctcaaagagttgggcataaaggtaggaaagtacgtcgcttctgaagtgtgtgaggagtccattgctgttggaaccgtgaagcacgaggggaatatcaaatacgtgaacgacgtgaggaacatcacaaagaaaaatattgaagaatggggcccatttgacttggtgattggcggaagcccatgcaacgatctctcaaatgtgaatccagccaggaaaggcctgtatgagggtacaggccggctcttcttcgaattttaccacctgctgaattactcacgccccaaggagggtgatgaccggccgttcttctggatgtttgagaatgttgtagccatgaaggttggcgacaagagggacatctcacggttcctggagtgtaatccagtgatgattgatgccatcaaagtttctgctgctcacagggcccgatacttctggggcaacctacccgggatgaacaggcccgtgatagcatcaaagaatgataaactcgagctgcaggactgcttggaatacaataggatagccaagttaaagaaagtacagacaataaccaccaagtcgaactcgatcaaacaggggaaaaaccaacttttccctgttgtcatgaatggcaaagaagatgttttgtggtgcactgagctcgaaaggatctttggctttcctgtgcactacacagacgtgtccaacatgggccgtggtgcccgccagaagctgctgggaaggtcctggagcgtgcctgtcatccgacacctcttcgcccctctgaaggactactttgcatgtgaatagttccagccaggccccaagcccactggggtgtgtggcagagccaggacccaggaggtgtgattcctgaaggcatccccaggccctgctcttcctcagctgtgtgggtcataccgtgtacctcagttccctcttgctcagtgggggcagagccacctgactcttgcaggggtagcctgaggtgccgcctccttgtgcacaaatcagacctggctgcttggagcagcctaacacggtgctcattttttcttctcctaaaactttaaaacttgaagtaggtagcaacgtggctttttttttttcccttcctgggtctaccactcagagaaacaatggctaagataccaaaaccacagtgccgacagctctccaatactcaggttaatgctgaaaaatcatccaagacagttattgcaagagtttaatttttgaaaactggctactgctctgtgtttacagacgtgtgcagttgtaggcatgtagctacaggacatttttaagggcccaggatcgttttttcccagggcaagcagaagagaaaatgttgtatatgtcttttacccggcacattccccttgcctaaatacaagggctggagtctgcacgggacctattagagtattttccacaatgatgatgatttcagcagggatgacgtcatcatcacattcagggctattttttcccccacaaacccaagggcaggggccactcttagctaaatccctccccgtgactgcaatagaaccctctggggagctcaggaaggggtgtgctgagttctataatataagctgccatatattttgtagacaagtatggctcctccatatctccctcttccctaggagaggagtgtgaagcaaggagcttagataagacaccccctcaaacccattccctctccaggagacctaccctccacaggcacaggtccccagatgagaagtctgctaccctcatttctcatctttttactaaactcagaggcagtgacagcagtcagggacagacatacatttctcataccttccccacatctgagagatgacagggaaaactgcaaagctcggtgctccctttggagattttttaatccttttttattccataagaagtcgtttttagggagaacgggaattcagacaagctgcatttcagaaatgctgtcataatggtttttaacaccttttactcttcttactggtgctattttgtagaataaggaacaacgttgacaagttttgtggggctttttatacactttttaaaatctcaaacttctatttttatgtttaacgttttcattaaaattttttttgtaactggagccacgacgtaacaaatatggggaaaaaactgtgccttgtttcaacagtttttgctaatttttaggctgaaagatgacggatgcctagagtttaccttatgtttaattaaaatcagtatttgtcta

SEQ ID NO: 8614 - DNA, 1709 bp, Homo sapiens
acggccgccagccggcctcccgccagccagccccgacccgcggctccgccgcccagccgcgccccagccagccctgcggcaggaaagcatgaagggagacaccaggcatctcaatggagaggaggacgccggcgggagggaagactcgatcctcgtcaacggggcctgcagcgaccagtcctccgactcgcccccaatcctggaggctatccgcaccccggagatcagaggccgaagatcaagctcgcgactctccaagagggaggtgtccagtctgctaagctacacacaggacttgacaggcgatggcgacggggaagatggggatggctctgacaccccagtcatgccaaagctcttccgggaaaccaggactcgttcagaaagcccagcttccctgagacggcgggcaacagcatcggcaggaacgccatggccgtcccctcccagctcttaccttaccatcgacctcacagacgacacagaggacacacatgggacgccccagagcagcagtaccccctacgcccgcctagcccaggacagccagcaggggggcatggagtccccgcaggtggaggcagacagtggagatggagacagttcagagtatcaggatgggaaggagtttggaataggggacctcgtgtggggaaagatcaagggcttctcctggtggcccgccatggtggtgtcttggaaggccacctccaagcgacaggctatgtctggcatgcggtgggtccagtggtttggcgatggcaagttctccgaggtctctgcagacaaactggtggcactggggctgttcagccagcactttaatttggccaccttcaataagctcgtctcctatcgaaaagccatgtaccatgctctggagagaacaagactcgaagacgcacagctgacgactcagccacctctgactactgccccgcacccaagcgcctcaagacaaattgctataacaacggcaaagaccgaggggatgaagatcagagccgagaacaaatggcttcagatgttgccaacaacaagagcagcctggaaggaaaaaccccgtgtccttccaccctctctttgagggggggctctgtcagacatgccgggatcgcttccttgagctgttttacatgtatgatgacgatggctatcagtcttactgcactgtgtgctgcgagggccgagagctgctgctttgcagcaacacgagctgctgccggtgtttctgtgtggagtgcctggaggtgctggtgggcacaggcacagcggccgaggccaagcttcaggagccctggagctgttacatgtgtctcccgcagcgctgtcatggcgtcctgcggcgccggaaggactggaacgtgcgcctgcaggccttcttcaccagtgacacggggcttgaatatgaagcccccaagctgtaccctgccattcccgcagcccgaaggcggcccattcgagtcctgtcattgtttgatggcatcgcgacaggctacctagtcctcaaagagttgggcataaaggtaggaaagtacgtcgcttctgaagtgtgtgaggagtccattgctgttggaaccgtgaagcacgaggggaatatcaaatacgtgaacgacgtgaggaacatcacaaagaaaaatattgaagaatggggcccatttgacttggtgattggcggaagcccatgcaacgatctctcaaatgtgaat

SEQ ID NO: 8615 - DNA, 2662 bp, Homo sapiens
agcgccctgcacggccgccagccggcctcccgccagccagccccgacccgcggctccgccgcccagccgcgccccagccagccctgcggcaggaaagcatgaagggagacaccaggcatctcaatggagaggaggacgccggcgggagggaagactcgatcctcgtcaacggggcctgcagcgaccagtcctccgactcgcccccaatcctggaggctatccgcaccccggagatcagaggccgaagatcaagctcgcgactctccaagagggaggtgtccagtctgctaagctacacacaggacttgacaggcgatggcgacggggaagatggggatggctctgacaccccagtcatgccaaagctcttccgggaaaccaggactcgttcagaaagcccagcttccctgagacggcgggcaacagcatcggcaggaacgccatggccgtcccctcccagctcttaccttaccatcgacctcacagacgacacagaggacacacatgggacgccccagagcagcagtaccccctacgcccgcctagcccaggacagccagcaggggggcatggagtccccgcaggtggaggcagacagtggagatggagacagttcagagtatcaggatgggaaggagtttggaataggggacctcgtgtggggaaagatcaagggcttctcctggtggcccgccatggtggtgtcttggaaggccacctccaagcgacaggctatgtctggcatgcggtgggtccagtggtttggcgatggcaagttctccgaggtctctgcagacaaactggtggcactggggctgttcagccagcactttaatttggccaccttcaataagctcgtctcctatcgaaaagccatgtaccatgctctggagaaagctagggtgcgagctggcaagaccttccccagcagccctggagactcattggaggaccagctgaagcccatgttggagtgggcccacgggggcttcaagcccactgggatcgagggcctcaaacccaacaacacgcaaccagagaacaagactcgaagacgcacagctgacgactcagccacctctgactactgccccgcacccaagcgcctcaagacaaattgctataacaacggcaaagaccgaggggatgaagatcagagccgagaacaaatggcttcagatgttgccaacaacaagagcagcctggaagatggctgtttgtcttgtggcaggaaaaaccccgtgtccttccaccctctctttgagggggggctctgtcagacatgccgggatcgcttccttgagctgttttacatgtatgatgacgatggctatcagtcttactgcactgtgtgctgcgagggccgagagctgctgctttgcagcaacacgagctgctgccggtgtttctgtgtggagtgcctggaggtgctggtgggcacaggcacagcggccgaggccaagcttcaggagccctggagctgttacatgtgtctcccgcagcgctgtcatggcgtcctgcggcgccggaaggactggaacgtgcgcctgcaggccttcttcaccagtgacacggggcttgaatatgaagcccccaagctgtaccctgccattcccgcagcccgaaggcggcccattcgagtcctgtcattgtttgatggcatcgcgacaggctacctagtcctcaaagagttgggcataaaggtaggaaagtacgtcgcttctgaagtgtgtgaggagtccattgctgttggaaccgtgaagcacgaggggaatatcaaatacgtgaacgacgtgaggaacatcacaaagaaaaatattgaagaatggggcccatttgacttggtgattggcggaagcccatgcaacgatctctcaaatgtgaatccagccaggaaaggcctgtatgagggtacaggccggctcttcttcgaattttaccacctgctgaattactcacgccccaaggagggtgatgaccggccgttcttctggatgtttgagaatgttgtagccatgaaggttggcgacaagagggacatctcacggttcctggagtgtaatccagtgatgattgatgccatcaaagtttctgctgctcacagggcccgatacttctggggcaacctacccgggatgaacaggatctttggctttcctgtgcactacacagacgtgtccaacatgggccgtggtgcccgccagaagctgctgggaaggtcctggagcgtgcctgtcatccgacacctcttcgcccctctgaaggactactttgcatgtgaatagttccagccaggccccaagcccactggggtgtgtggcagagccaggacccaggaggtgtgattcctgaaggcatccccaggccctgctcttcctcagctgtgtgggtcataccgtgtacctcagttccctcttgctcagtgggggcagagccacctgactcttgcaggggtagcctgaggtgccgcctccttgtgcacaaatcagacctggctgcttggagcagcctaacacggtgctcattttttcttctcctaaaactttaaaacttgaagtaggtagcaacgtggctttttttttttcccttcctgggtctaccactcagagaaacaatggctaagataccaaaaccacagtgccgacagctctccaatactcag

SEQ ID NO: 8616 - DNA, 3634 bp, Homo sapiens
gcgccctgcacggccgccagccggcctcccgccagccagccccgacccgcggctccgccgcccagccgcgccccagccagccctgcggcaggaaagcatgaagggagacaccaggcatctcaatggagaggaggacgccggcgggagggaagactcgatcctcgtcaacggggcctgcagcgaccagtcctccgactcgcccccaatcctggaggctatccgcaccccggagatcagaggccgaagatcaagctcgcgactctccaagagggaggtgtccagtctgctaagctacacacagtccctgagacggcgggcaacagcatcggcaggaacgccatggccgtcccctcccagctcttaccttaccatcgacctcacagacgacacagaggacacacatgggacgccccagagcagcagtaccccctacgcccgcctagcccaggacagccagcaggggggcatggagtccccgcaggtggaggcagacagtggagatggagacagttcagagtatcaggatgggaaggagtttggaataggggacctcgtgtggggaaagatcaagggcttctcctggtggcccgccatggtggtgtcttggaaggccacctccaagcgacaggctatgtctggcatgcggtgggtccagtggtttggcgatggcaagttctccgaggtctctgcagacaaactggtggcactggggctgttcagccagcactttaatttggccaccttcaataagctcgtctcctatcgaaaagccatgtaccatgctctggagaaagctagggtgcgagctggcaagaccttccccagcagccctggagactcattggaggaccagctgaagcccatgttggagtgggcccacgggggcttcaagcccactgggatcgagggcctcaaacccaacaacacgcaaccagagaacaagactcgaagacgcacagctgacgactcagccacctctgactactgccccgcacccaagcgcctcaagacaaattgctataacaacggcaaagaccgaggggatgaagatcagagccgagaacaaatggcttcagatgttgccaacaacaagagcagcctggaagatggctgtttgtcttgtggcaggaaaaaccccgtgtccttccaccctctctttgagggggggctctgtcagacatgccgggatcgcttccttgagctgttttacatgtatgatgacgatggctatcagtcttactgcactgtgtgctgcgagggccgagagctgctgctttgcagcaacacgagctgctgccggtgtttctgtgtggagtgcctggaggtgctggtgggcacaggcacagcggccgaggccaagcttcaggagccctggagctgttacatgtgtctcccgcagcgctgtcatggcgtcctgcggcgccggaaggactggaacgtgcgcctgcaggccttcttcaccagtgacacggggcttgaatatgaagcccccaagctgtaccctgccattcccgcagcccgaaggcggcccattcgagtcctgtcattgtttgatggcatcgcgacaggctacctagtcctcaaagagttgggcataaaggtaggaaagtacgtcgcttctgaagtgtgtgaggagtccattgctgttggaaccgtgaagcacgaggggaatatcaaatacgtgaacgacgtgaggaacatcacaaagaaaaatattgaagaatggggcccatttgacttggtgattggcggaagcccatgcaacgatctctcaaatgtgaatccagccaggaaaggcctgtatgagggtacaggccggctcttcttcgaattttaccacctgctgaattactcacgccccaaggagggtgatgaccggccgttcttctggatgtttgagaatgttgtagccatgaaggttggcgacaagagggacatctcacggttcctggagtgtaatccagtgatgattgatgccatcaaagtttctgctgctcacagggcccgatacttctggggcaacctacccgggatgaacaggatctttggctttcctgtgcactacacagacgtgtccaacatgggccgtggtgcccgccagaagctgctgggaaggtcctggagcgtgcctgtcatccgacacctcttcgcccctctgaaggactactttgcatgtgaatagttccagccaggccccaagcccactggggtgtgtggcagagccaggacccaggaggtgtgattcctgaaggcatccccaggccctgctcttcctcagctgtgtgggtcataccgtgtacctcagttccctcttgctcagtgggggcagagccacctgactcttgcaggggtagcctgaggtgccgcctccttgtgcacaaatcagacctggctgcttggagcagcctaacacggtgctcattttttcttctcctaaaactttaaaacttgaagtaggtagcaacgtggctttttttttttcccttcctgggtctaccactcagagaaacaatggctaagataccaaaaccacagtgccgacagctctccaatactcaggttaatgctgaaaaatcatccaagacagttattgcaagagtttaatttttgaaaactggctactgctctgtgtttacagacgtgtgcagttgtaggcatgtagctacaggacatttttaagggcccaggatcgttttttcccagggcaagcagaagagaaaatgttgtatatgtcttttacccggcacattccccttgcctaaatacaagggctggagtctgcacgggacctattagagtattttccacaatgatgatgatttcagcagggatgacgtcatcatcacattcagggctattttttcccccacaaacccaagggcaggggccactcttagctaaatccctccccgtgactgcaatagaaccctctggggagctcaggaaggggtgtgctgagttctataatataagctgccatatattttgtagacaagtatggctcctccatatctccctcttccctaggagaggagtgtgaagcaaggagcttagataagacaccccctcaaacccattccctctccaggagacctaccctccacaggcacaggtccccagatgagaagtctgctaccctcatttctcatctttttactaaactcagaggcagtgacagcagtcagggacagacatacatttctcataccttccccacatctgagagatgacagggaaaactgcaaagctcggtgctccctttggagattttttaatccttttttattccataagaagtcgtttttagggagaacgggaattcagacaagctgcatttcagaaatgctgtcataatggtttttaacaccttttactcttcttactggtgctattttgtagaataaggaacaacgttgacaagttttgtggggctttttatacactttttaaaatctcaaacttctatttttatgtttaacgttttcattaaaattttttttgtaactggagccacgacgtaacaaatatggggaaaaaactgtgccttgtttcaacagtttttgctaatttttaggctgaaagatgacggatgcctagagtttaccttatgtttaattaaaatcagtatttgtct

SEQ ID NO: 8617 - DNA, 1764 bp, Homo sapiens
acccactcccgctgccccgtccggcccgcgccgcttcctcgcagcagctgctcccggctccgcggccgcagcccgcgtggacgctccgagcgccccccgacggacgggaccggctccctggcggtcgggcgagcgggcggcaacgctgcccggccggcagcgctggggttaagtggcccaagtaaacctagctcggcgatcggcgccggagattcgcgagcccagcgccctgcacggccgccagccggcctcccgccagccagccccgacccgcggctccgccgcccagccgcgccccagccagccctgcggcaggaaagcatgaagggagacaccaggcatctcaatggagaggaggacgccggcgggagggaagactcgatcctcgtcaacggggcctgcagcgaccagtcctccgactcgcccccaatcctggaggctatccgcaccccggagatcagaggccgaagatcaagctcgcgactctccaagagggaggtgtccagtctgctaagctacacacaggacttgacaggcgatggcgacggggaagatggggatggctctgacaccccagtcatgccaaagctcttccgggaaaccaggactcgttcagaaagcccagctgtccgaactcgaaataacaacagtgtctccagccgggagaggcacaggccttccccacgttccacccgaggccggcagggccgcaaccatgtggacgagtcccccgtggagttcccggctaccaggtccctgagacggcgggcaacagcatcggcaggaacgccatggccgtcccctcccagctcttaccttaccatcgacctcacagacgacacagaggacacacatgggacgccccagagcagcagtaccccctacgcccgcctagcccaggacagccagcaggggggcatggagtccccgcaggtggaggcagacagtggagatggagacagttcagagtatcaggatgggaaggagtttggaataggggacctcgtgtggggaaagatcaagggcttctcctggtggcccgccatggtggtgtcttggaaggccacctccaagcgacaggctatgtctggcatgcggtgggtccagtggtttggcgatggcaagttctccgaggtctctgcagacaaactggtggcactggggctgttcagccagcactttaatttggccaccttcaataagctcgtctcctatcgaaaagccatgtaccatgctctggagaaagctagggtgcgagctggcaagaccttccccagcagccctggagactcattggaggaccagctgaagcccatgttggagtgggcccacgggggcttcaagcccactgggatcgagggcctcaaacccaacaacacgcaaccagagaacaagactcgaagacgcacagctgacgactcagccacctctgactactgccccgcacccaagcgcctcaagacaaattgctataacaacggcaaagaccgaggggatgaagatcagagccgagaacaaatggcttcagatgttgccaacaacaagagcagcctggaagatggctgtttgtcttgtggcaggaaaaaccccgtgtccttccaccctctctttgagggggggctctgtcagacatgccggcacctgtgtggagactcagtgaagcccactcatcccagctgccttgcactctgcctctggggcaggatgggggacagctgtcacagaggccaatggcacgcaggtcacagccagttgtccttttaa

SEQ ID NO: 8618 - DNA, 1706 bp, Homo sapiens
cccatctccacccctcccctgaaccccactccccactgaggtccccaaaccccacccctcactccaccctgagggccccatcctctgaaccccaatcccccagccccactgagctcttaaccctccccacctgagggttccctttccctgcccgtcccccagcttcctagctccccaccccaagtgaccccccgcagctcctcgcccctcccactgcaaaccggcactgaagggctgccccgcccccgcccctccccgcccccgcgggacacgcccagattctttgcccccatagcctggtgacctctggccacccgctgtcccaggtgggcctggatccttccagctcattctttgcctgcgccgtccctcgttccatggcccagtcctccccggggaccctgagcctggaagccccggaccactggaaccttgaacccaccagctggctgtacccggagccgtggcagcagccctcatccccatggcggccatcccagccctggacccagaggccgagcccagcatggacgtgattttggtgggatccagtgagctctcaagctccgtttcacccgggacaggcagagatcttattgcatatgaagtcaaggctaaccagcgaaatatagaagacatctgcatctgctgcggaagtctccaggttcacacacagcaccctctgtttgagggagggatctgcgccccatgtaaggacaagttcctggatgccctcttcctgtacgacgatgacgggtaccaatcctactgctccatctgctgctccggagagacgctgctcatctgcggaaaccctgattgcacccgatgctactgcttcgagtgtgtggatagcctggtcggccccgggacctcggggaaggtgcacgccatgagcaactgggtgtgctacctgtgcctgccgtcctcccgaagcgggctgctgcagcgtcggaggaagtggcgcagccagctcaaggccttctacgaccgagagtcggagaatccccttgagatgttcgaaaccgtgcctgtgtggaggagacagccagtccgggtgctgtccctttttgaagacatcaagaaagagctgacgagtttgggctttttggaaagtggttctgacccgggacaactgaagcatgtggttgatgtcacagacacagtgaggaaggatgtggaggagtggggacccttcgatcttgtgtacggcgccacacctcccctgggccacacctgtgaccgtcctcccagctggtacctgttccagttccaccggctcctgcagtacgcacggcccaagccaggcagccccaggcccttcttctggatgttcgtggacaatctggtgctgaacaaggaagacctggacgtcgcatctcgcttcctggagatggagccagtcaccatcccagatgtccacggcggatccttgcagaatgctgtccgcgtgtggagcaacatcccagccataaggagcagcaggcactgggctctggtttcggaagaagaattgtccctgctggcccagaacaagcagagctcgaagctcgcggccaagtggcccaccaagctggtgaagaactgctttctccccctaagagaatatttcaagtatttttcaacagaactcacttcctctttataaatgagtcactatactgtgaagaaaaagacttttcctagaacaaaggcaactttcctca

SEQ ID NO: 8619 - DNA, 1702 bp, Homo sapiens
cccatctccacccctcccctgaaccccactccccactgaggtccccaaaccccacccctcactccaccctgagggccccatcctctgaaccccaatcccccagccccactgagctcttaaccctccccacctgagggttccctttccctgcccgtcccccagcttcctagctccccaccccaagtgaccccccgcagctcctcgcccctcccactgcaaaccggcactgaagggctgccccgcccccgcccctccccgcccccgcgggacacgcccagattctttgcccccatagcctggtgacctctggccacccgctgtcccaggtgggcctggatccttccagctcattctttgcctgcgccgtccctcgttccatggcccagtcctccccggggaccctgagcctggaagccccggaccactggaaccttgaacccaccagctggctgtacccggagccgtggcagcagccctcatccccatggcggccatcccagccctggacccagaggccgagcccagcatggacgtgattttggtgggatccagtgagctctcaagctccgtttcacccgggacaggcagagatcttattgcatatgaagtcaaggctaaccagcgaaatatagaagacatctgcatctgctgcggaagtctccaggttcacacacagcaccctctgtttgagggagggatctgcgccccatgtaaggacaagttcctggatgccctcttcctgtacgacgatgacgggtaccaatcctactgctccatctgctgctccggagagacgctgctcatctgcggaaaccctgattgcacccgatgctactgcttcgagtgtgtggatagcctggtcggccccgggacctcggggaaggtgcacgccatgagcaactgggtgtgctacctgtgcctgccgtcctcccgaagcgggctgctgcagcgtcggaggaagtggcgcagccagctcaaggccttctacgaccgagagtcggagaatccccttgagatgttcgaaaccgtgcctgtgtggaggagacagccagtccgggtgctgtccctttttgaagacatcaagaaagagctgacgagtttgggctttttggaaagtggttctgacccgggacaactgaagcatgtggttgatgtcacagacacagtgaggaaggatgtggaggagtggggacccttcgatcttgtgtacggcgccacacctcccctgggccacacctgtgaccgtcctcccagctggtacctgttccagttccaccggctcctgcagtacgcacggcccaagccaggcagccccaggcccttcttctggatgttcgtggacaatctggtgctgaacaaggaagacctggacgtcgcatctcgcttcctggagatggagccagtcaccatcccagatgtccacggcggatccttgcagaatgctgtccgcgtgtggagcaacatcccagccataaggagcaggcactgggctctggtttcggaagaagaattgtccctgctggcccagaacaagcagagctcgaagctcgcggccaagtggcccaccaagctggtgaagaactgctttctccccctaagagaatatttcaagtatttttcaacagaactcacttcctctttataaatgagtcactatactgtgaagaaaaagacttttcctagaacaaaggcaactttcctc

SEQ ID NO: 8620 - DNA, 4464 bp, Homo sapiens
ggactctgagggctttttggagctcgctatgcttaacctggagatgattaaggccccgcttcctggcctcccagcctctaatgccaaaagataagggagaggctggcgtgtgaccccgttttgagtcaggtggacagagggctggccaccttcggaaccatgggtgcaatacggagtcagacctcaatacaagcccactctttcacatatttgaacttttttcacatatcaactttttttgttcactgtgcagggattgttcattgctgctggaggaagatcatggactgtcgcgggaaactgaagtggttgagtatccactagtcgtggatgagggcagtgacttcgcagttttttgcgaattacacatctctttgattatgttgtgactagttttgttagatagtcatttagtgtttgggatacctgttaagccctttgtccagggactgtggttggatttatgaattatttggacggttgtccacttgaaagaactgacagtagcttcataacaatgttacaaatctcgttctaagattaagctgttgaacctatatttgccattagcgcttaatttttgaagtattatttttatgaatcaagccctggaaaaggacaagatatttgaatgaaatagcacccataatggagaacttcacagttgctactcctgtgataggtttatcttagtttcattgtggtataaatggaatagcaggtgttgtcaggtacaaggtttgtagcttgccaatatgttcattaccaacactgcagattcccattgagttggtgggggttttgttacctttgttttttttctcagcaaaataattctataactttttgtttgtgacaagaaatggactttcagtttacttaagattaatacttcttgaatgataaaatcattttgccatgttagaagacatttccgaagaagacatttgggaatacaaatctaaaagaaaaccaaaacgagttgatccaaataatggctctaaaaatattctaaaatctgttgaaaaagcaacagatggaaaataccagtcaaaacggagtagaaacagaaaaagagccgcagaagctaaagaggtgaaggaccatgaagtgccccttggaaatgcaggttgtcagacttctgttgcttctagtcagaattcaagttgtggagatggtattcagcagacccaagacaaggaaactactccaggaaaactctgtagaactcaaaaaagccaacacgtgtccccaaagatacgtccagtttatgatggatactgtccaaattgccagatgcctttttcctcattgatagggcagacacctcgatggcatgtttttgaatgtttggattctccaccacgctctgaaacagagtgtcctgatggtcttctgtgtacctcaaccattccttttcattacaagagatacactcacttcctgctagctcaaagcagggctggtgatcatccttttagcagcccatcacctgcgtcaggtggcagtttcagtgagactaagtcaggcgtcctttgtagccttgaggaaagatggtcttcgtatcagaaccaaactgataactcggtttcaaatgatcccttattgatgacacagtattttaaaaagtctccgtctctgactgaagccagtgaaaagatttctactcatatccaaacatcccaacaagctctacaatttacagattttgttgagaatgacaaactagtgggagttgctttgcgtcttgcaaacaactcagaacacataaatttgccattgccagaaaatgacttcagtgactgtgaaatctcctattctccacttcaaagtgatgaagacactcatgatatcgatgaaaaaccggatgattcacaagaacaactgttttttaccgaaagctcaaaagatggcagcctcgaagaagatgatgacagctgtggtttttttaaaaaacgacatggtcccttactgaaggaccaggatgagagctgccccaaagtgaacagcttcttaactcgggataagtatgatgaaggattgtatagattcaatagtctaaatgatttgtctcaacctatttctcaaaataatgagagtactttgccttatgatctggcatgtactggtggtgattttgtgttgtttccacctgcattggcagggaagcttgctgcttctgttcatcaggcaactaaagcaaaacctgatgagccagaatttcactcagctcaatcaaataaacagaaacaggtaattgaagaatcatctgtttacaatcaagtttctcttccgttagttaagagtttaatgttgaaaccttttgaaagtcaggtagaagggtatctttcttcccaaccaacccaaaatacaattagaaaattatcaagtgagaacttgaatgctaagaataatactaactcagcatgtttctgcagaaaggcattagagggtgtgccagttggtaaagctacaattttaaatacagaaaacttgtctagtacacctgctccgaagtatttgaaaatattgccttctggtcttaagtataatgcaagacatccttctaccaaggtaatgaagcaaatggatataggtgtgtattttggactacctcccaaaagaaaggaagagaaattgctaggggaaagtgcattagaagggataaacttaaatccagttccaagtcctaatcaaaagaggtcctcgcagtgcaagaggaaagcagaaaaatctttaagtgatttagaatttgatgcaagtactttacatgagagtcagctttctgtggaactttctagtgagaggtcacagcgtcaaaaaaagagatgtagaaagtcaaattcactgcaggaaggagcgtgtcagaagagatcagatcaccttattaatacagaatctgaagcagtcaatttaagtaaagtcaaagtcttcacaaaatcagctcatggtgggctgcaaaggggcaacaagaaaatcccagagtcatctaatgtaggaggatcaagaaaaaagacatgtccattctataagaaaatacctggaaccggctttacagttgatgcctttcagtatggcgtggttgaaggttgcacagcctattttctcacacattttcattctgatcattatgctggattgtctaaacacttcacatttccagtttattgtagtgagataactggcaatttgttgaagaacaagcttcatgtgcaagaacaatatattcacccattgccactggacactgaatgtattgtgaatggtgtcaaagttgttttgcttgatgccaatcactgtccaggtgctgtcatgatcctcttttatcttcctaatggtactgtcatattacacacgggagacttcagagcagatcccagcatggaacgttctcttcttgcggaccagaaagtccatatgctgtacttagataccacatattgtagcccagaatacacctttccatctcagcaagaggttatccggtttgccatcaacactgcctttgaggctgtaactctaaacccacatgctcttgttgtctgtggcacttactctattggaaaagagaaagtcttcctagccattgctgatgttttaggttcaaaagtgggcatgtcccaggaaaaatataaaactctacagtgcctcaatataccagaaattaattcactcatcactaccgacatgtgcagttcattggttcaccttctcccaatgatgcaaattaattttaagggcttacagagtcatttgaagaagtgtggtgggaaatacaatcagattttggcatttcgacctacaggatggacacactctaacaagttcactagaatagcagatgttattccccagaccaaaggaaacatttcaatatatggaattccttacagtgaacacagcagctacctagaaatgaagcgctttgtccagtggctgaagccccagaaaatcatacctactgtaaatgtgggcacctggaaatctaggagcacaatggagaaatattttagagagtggaaattggaagctggatattgatgatacctccgaggattcagtagtagttaagttccttggatgtagcttgttagtagttaaatctatagaaatgtgaaatacactttgtgtggaaaaacctcatgaagattgttcagatactttattttctcatttatgtttgaacaacatgttcgtggtgctgaatgcctctcagcatcatcaaggataactgaaactgggtctccctgggacccttaatttcttgtcccctgccctccatgggcagttatattctgcatcaagccttagaagaggaagcaaaggcagattcagggaccaaaaggattaatgataattaataaagtagtttgaagcattatatatataagtaattatgtgtctttaaaattatgagatgaaacttttatatgacgtgtatacttaaataaaattaatataaaa

SEQ ID NO: 8621 - DNA, 4241 bp, Homo sapiens
cgggaacttgttcccgccaagaccctaaagggattgttcattgctgctggaggaagatcatggactgtcgcgggaaactgaagtggttgagtatccactagtcgtggatgagggcagtgacttcgcagttttttgcgaattacacatctctttgattatgttgtgactagttttgttagatagtcatttagtgtttgggatacctgttaagccctttgtccagggactgtggttggatttatgaattatttggacggttgtccacttgaaagaactgacagtagcttcataacaatgttacaaatctcgttctaagattaagctgttgaacctatatttgccattagcgcttaatttttgaagtattatttttatgaatcaagccctggaaaaggacaagatatttgaatgaaatagcacccataatggagaacttcacagttgctactcctgtgataggtttatcttagtttcattgtggtataaatggaatagcaggtgttgtcaggtacaaggtttgtagcttgccaatatgttcattaccaacactgcagattcccattgagttggtgggggttttgttacctttgttttttttctcagcaaaataattctataactttttgtttgtgacaagaaatggactttcagtttacttaagattaatacttcttgaatgataaaatcattttgccatgttagaagacatttccgaagaagacatttgggaatacaaatctaaaagaaaaccaaaacgagttgatccaaataatggctctaaaaatattctaaaatctgttgaaaaagcaacagatggaaaataccagtcaaaacggagtagaaacagaaaaagagccgcagaagctaaagaggtgaaggaccatgaagtgccccttggaaatgcaggttgtcagacttctgttgcttctagtcagaattcaagttgtggagatggtattcagcagacccaagacaaggaaactactccaggaaaactctgtagaactcaaaaaagccaacacgtgtccccaaagatacgtccagtttatgatggatactgtccaaattgccagatgcctttttcctcattgatagggcagacacctcgatggcatgtttttgaatgtttggattctccaccacgctctgaaacagagtgtcctgatggtcttctgtgtacctcaaccattccttttcattacaagagatacactcacttcctgctagctcaaagcagggctggtgatcatccttttagcagcccatcacctgcgtcaggtggcagtttcagtgagactaagtcaggcgtcctttgtagccttgaggaaagatggtcttcgtatcagaaccaaactgataactcggtttcaaatgatcccttattgatgacacagtattttaaaaagtctccgtctctgactgaagccagtgaaaagatttctactcatatccaaacatcccaacaagctctacaatttacagattttgttgagaatgacaaactagtgggagttgctttgcgtcttgcaaacaactcagaacacataaatttgccattgccagaaaatgacttcagtgactgtgaaatctcctattctccacttcaaagtgatgaagacactcatgatatcgatgaaaaaccggatgattcacaagaacaactgttttttaccgaaagctcaaaagatggcagcctcgaagaagatgatgacagctgtggtttttttaaaaaacgacatggtcccttactgaaggaccaggatgagagctgccccaaagtgaacagcttcttaactcgggataagtatgatgaaggattgtatagattcaatagtctaaatgatttgtctcaacctatttctcaaaataatgagagtactttgccttatgatctggcatgtactggtggtgattttgtgttgtttccacctgcattggcagggaagcttgctgcttctgttcatcaggcaactaaagcaaaacctgatgagccagaatttcactcagctcaatcaaataaacagaaacaggtaattgaagaatcatctgtttacaatcaagtttctcttccgttagttaagagtttaatgttgaaaccttttgaaagtcaggtagaagggtatctttcttcccaaccaacccaaaatacaattagaaaattatcaagtgagaacttgaatgctaagaataatactaactcagcatgtttctgcagaaaggcattagagggtgtgccagttggtaaagctacaattttaaatacagaaaacttgtctagtacacctgctccgaagtatttgaaaatattgccttctggtcttaagtataatgcaagacatccttctaccaaggtaatgaagcaaatggatataggtgtgtattttggactacctcccaaaagaaaggaagagaaattgctaggggaaagtgcattagaagggataaacttaaatccagttccaagtcctaatcaaaagaggtcctcgcagtgcaagaggaaagcagaaaaatctttaagtgatttagaatttgatgcaagtactttacatgagagtcagctttctgtggaactttctagtgagaggtcacagcgtcaaaaaaagagatgtagaaagtcaaattcactgcaggaaggagcgtgtcagaagagatcagatcaccttattaatacagaatctgaagcagtcaatttaagtaaagtcaaagtcttcacaaaatcagctcatggtgggctgcaaaggggcaacaagaaaatcccagagtcatctaatgtaggaggatcaagaaaaaagacatgtccattctataagaaaatacctggaaccggctttacagttgatgcctttcagtatggcgtggttgaaggttgcacagcctattttctcacacattttcattctgatcattatgctggattgtctaaacacttcacatttccagtttattgtagtgagataactggcaatttgttgaagaacaagcttcatgtgcaagaacaatatattcacccattgccactggacactgaatgtattgtgaatggtgtcaaagttgttttgcttgatgccaatcactgtccaggtgctgtcatgatcctcttttatcttcctaatggtactgtcatattacacacgggagacttcagagcagatcccagcatggaacgttctcttcttgcggaccagaaagtccatatgctgtacttagataccacatattgtagcccagaatacacctttccatctcagcaagaggttatccggtttgccatcaacactgcctttgaggctgtaactctaaacccacatgctcttgttgtctgtggcacttactctattggaaaagagaaagtcttcctagccattgctgatgttttaggttcaaaagtgggcatgtcccaggaaaaatataaaactctacagtgcctcaatataccagaaattaattcactcatcactaccgacatgtgcagttcattggttcaccttctcccaatgatgcaaattaattttaagggcttacagagtcatttgaagaagtgtggtgggaaatacaatcagattttggcatttcgacctacaggatggacacactctaacaagttcactagaatagcagatgttattccccagaccaaaggaaacatttcaatatatggaattccttacagtgaacacagcagctacctagaaatgaagcgctttgtccagtggctgaagccccagaaaatcatacctactgtaaatgtgggcacctggaaatctaggagcacaatggagaaatattttagagagtggaaattggaagctggatattgatgatacctccgaggattcagtagtagttaagttccttggatgtagcttgttagtagttaaatctatagaaatgtgaaatacactttgtgtggaaaaacctcatgaagattgttcagatactttattttctcatttatgtttgaacaacatgttcgtggtgctgaatgcctctcagcatcatcaaggataactgaaactgggtctccctgggacccttaatttcttgtcccctgccctccatgggcagttatattctgcatcaagccttagaagaggaagcaaaggcagattcagggaccaaaaggattaatgataattaataaagtagtttgaagcattatatatataagtaattatgtgtctttaaaattatgagatgaaacttttatatgacgtgtatacttaaataaaattaatataaaa

SEQ ID NO: 8622 - DNA, 1136 bp, Homo sapiens
ccgctactctggccctcagggttgtgtagtttccggggccacggcacctgggcacaccaggtggcgtcgcgcctttgctttcctgagccttctgagtaaggtaatgtggtgtccgtggggcgacgcctgcgcacaagaccgcgtcgggcctcacttttcccaggccttctgggtaatgtagtttccgggatcggcacccggcctgtgccagcttgcagagctcaccaggtgcagacccctgcggccagggcgaggacggatctgagcagctgggcagcaggtgccaccgcctgtgggacccagagggcttgaggacatctgcaatgctccagaagcccaagagcgtgaagctgcgggccctgcgcagcccgaggaagttcggcgtggctggccggagctgccaggaggtgctgcgcaagggctgtctccgcttccagctccctgagcgcggttcccggctgtgcctgtacgaggatggcacggagctgacggaagattacttccccagtgttcccgacaacgccgagctggtgctgctcaccttgggccaggcctggcagggctatgtgagcgacatcaggcgcttcctcagtgcatttcacgagccacaggtggggctcatccaggccgcccagcagctgctgtgtgatgagcaggccccacagaggcagaggctgctggctgacctcctgcacaacgtcagccagaacatcgcggccgagacccgggctgaggacccgccgtggtttgaaggcttggagtcccgatttcagagcaagtctggctatctgagatacagctgtgagagccggatccggagttacctgagggaggtgagctcctacccctccacggtgggtgcggaggctcaggaggaattcctgcgggtcctcggctccatgtgccagaggctccggtccatgcagtacaatggcagctacttcgacagaggagccaagggcggcagccgcctctgcacaccggaaggctggttctcctgccagggtccctttgacatggacagctgcttatcaagacactccatcaacccctacagtaacagggagagcaggatcctcttcagcacctggaacctggatcacatagatggagtcttgctctgtggcccaggctaa

SEQ ID NO: 8623 - DNA, 3005 bp, Homo sapiens
ggcacccggcctgtgccagcttgcagagctcaccaggtgcagacccctgcggccagggcgaggacggatctgagcagctgggcagcaggtgccaccgcctgtgggacccagagggcttgaggacatctgcaatgctccagaagcccaagagcgtgaagctgcgggccctgcgcagcccgaggaagttcggcgtggctggccggagctgccaggaggtgctgcgcaagggctgtctccgcttccagctccctgagcgcggttcccggctgtgcctgtacgaggatggcacggagctgacggaagattacttccccagtgttcccgacaacgccgagctggtgctgctcaccttgggccaggcctggcagggctctgttggtgtcagggcaaggacaaagacccgggacacctcaagtctgagtcctggtgattgccaggccctggggaatgggggaagatgtggtcagaggctcttcttgtgaccggggcaggatgtgtcttctgctggaccggcaccttttgtttgtcccattggtggcagatgtgagcgacatcaggcgcttcctcagtgcatttcacgagccacaggtggggctcatccaggccgcccagcagctgctgtgtgatgagcaggccccacagaggcagaggctgctggctgacctcctgcacaacgtcagccagaacatcgcggccgagacccgggctgaggacccgccgtggtttgaaggcttggagtcccgatttcagagcaagtctggctatctgagatacagctgtgagagccggatccggagttacctgagggaggtgagctcctacccctccacggtgggtgcggaggctcaggaggaattcctgcgggtcctcggctccatgtgccagaggctccggtccatgcagtacaatggcagctacttcgacagaggagccaagggcggcagccgcctctgcacaccggaaggctggttctcctgccagggtccctttgacatggacagctgcttatcaagacactccatcaacccctacagtaacagggagagcaggatcctcttcagcacctggaacctggatcacataatagaaaagaaacgcaccatcattcctacactggtggaagcaattaaggaacaagatggaagagaagtggactgggagtatttttatggcctgctttttacctcagagaacctaaaactagtgcacattgtctgccataagaaaaccacccacaagctcaactgtgacccaagcagaatctacaaaccccagacaaggttgaagcggaagcagcctgtgcggaaacgccagtgacacgtacacaccacgtcctggtctttgtttgaggcctgacgtgggcatcattttaacaggtgccttttttgtttttttgtttttcgtttttttggtcactccagtagctcctggaaaaaaccttaaaaaatgtttcctccaaatctgatttcattacatttctgaattgttggggttttttttgttgttttgttttgttttgtagatggagtttcacttttgttgcccaggctggagtgtagtggcgcgatctcggctcagcctcccgagtagctgggattacaggcatgtgccaccacgcccggctaatgtttgtatttttagtagagacggggtttcaccatgttggtcaggctggtctcaaactcctgacctcaggtgatccgcccacctcagcctcccaaagtgctgggatgacaggtgtgagccactgcgcccagcctgaatcatttcttataccttctgacagcccaacttccagaggacagctctggggtactcgttggatgtctgtgagtacctggtcatacgggtcagtagggataagaattgtctctgggctgaggaattcttctgttctctggtttcaccagcgttgggtttgctcatgtaatgtggtcaccatactcaaatggtgtcatggctgaagttggccaccttgcttgagggacaagttgtttatgtatcagctctctgctgggtctccctttccatggcaaatgggcagctccatcctcttgactcttctaaatgcccaaaagaggtgtcatgctttgggggtacgatgtttatactccgtaaagaacatacaaggacattcactgctgatttttttttttgtttgtttgagacagggtctcactctgtcgctcaggctggagtgcagtgatgcaatcttggctcactgcaacctccgcctctcaggttcaagtggttctccttcctcagcctcccaagtagctgggattacaggcacctaccaccagggccagctaatttttgtatgtttagtagaaacggggtttcaccatgttggccaggctgttctcgaactcctgacctcaggtgatctgcccgcctcggtctcccaaagtgctgggattacaggcatgagccactgcacctgacctgctgaattgtttataatggcaagaaataggaaaccccccaatgtctgttgaacagctatcacgttgaaccacgtgaaactgctgttttctaggccaaaaatggtgagcgatcatttatttcatgattcaacctgatacatttacatagtgcaaaactgtgtcacagtttcaggcttttatgaggaaagcgtttctgtgtagaaactggaagctgttcagggcatcggcagctgaaccctgctccgttggtcagcgttactatcatctcggatcatatggagctcatgtcagccgtgtgggtggcgggtgcacagagacggtctggaaggaaacacgcggatctgaacagcagtaatcctgggggatacgggggttgggctagattacagagggctcattttctacgtcatgtattttatgatacttgaattttttgaaatgggcatttattttataacatgttaaaatgtactttttaaattaagtcattttgtaatatttgaatttttacatttgttgtacaatcaggaaaagcaataaagatttttcaaaaataga

SEQ ID NO: 8624 - DNA, 635 bp, Homo sapiens
ccgctactctggccctcagggttgtgtagtttccggggccacggcacctgggcacaccaggtggcgtcgcgcctttgctttcctgagccttctgagtaaggtaatgtggtgtccgtggggcgacgcctgcgcacaagaccgcgtcgggcctcacttttcccaggccttctgggtaatgtagtttccgggatcggcacccggcctgtgccagcttgcagagctcaccaggtgcagacccctgcggccagggcgaggacggatctgagcagctgggcagcaggtgccaccgcctgtgggacccagagggcttgaggacatctgcaatgctccagaagcccaagagcgtgaagctgcgggccctgcgcagcccgaggaagttcggcgtggctggccggagctgccaggaggtgctgcgcaagggctgtctccgcttccagctccctgagcgcggttcccggctgtgcctgtacgaggatggcacggagctgacggaagattacttccccagtgttcccgacaacgccgagctggtgctgctcaccttgggccaggcctggcagggctggtttcgccatgtttcccaggatagtctcacactcctgggctcaagctgtcctcctgccttggtctcctaa

SEQ ID NO: 8625 - DNA, 2842 bp, Homo sapiens
ccctgcggccagggcgaggacggatctgagcagctgggcagcaggtgccaccgcctgtgggacccagagggcttgaggacatctgcaatgctccagaagcccaagagcgtgaagctgcgggccctgcgcagcccgaggaagttcggcgtggctggccggagctgccaggaggtgctgcgcaagggctgtctccgcttccagctccctgagcgcggttcccggctgtgcctgtacgaggatggcacggagctgacggaagattacttccccagtgttcccgacaacgccgagctggtgctgctcaccttgggccaggcctggcagggctgatgtgtcttctgctggaccggcaccttttgtttgtcccattggtggcagatgtgagcgacatcaggcgcttcctcagtgcatttcacgagccacaggtggggctcatccaggccgcccagcagctgctgtgtgatgagcaggccccacagaggcagaggctgctggctgacctcctgcacaacgtcagccagaacatcgcggccgagacccgggctgaggacccgccgtggtttgaaggcttggagtcccgatttcagagcaagtctggctatctgagatacagctgtgagagccggatccggagttacctgagggaggtgagctcctacccctccacggtgggtgcggaggctcaggaggaattcctgcgggtcctcggctccatgtgccagaggctccggtccatgcagtacaatggcagctacttcgacagaggagccaagggcggcagccgcctctgcacaccggaaggctggttctcctgccagggtccctttgacatggacagctgcttatcaagacactccatcaacccctacagtaacagggagagcaggatcctcttcagcacctggaacctggatcacataatagaaaagaaacgcaccatcattcctacactggtggaagcaattaaggaacaagatggaagagaagtggactgggagtatttttatggcctgctttttacctcagagaacctaaaactagtgcacattgtctgccataagaaaaccacccacaagctcaactgtgacccaagcagaatctacaaaccccagacaaggttgaagcggaagcagcctgtgcggaaacgccagtgacacgtacacaccacgtcctggtctttgtttgaggcctgacgtgggcatcattttaacaggtgccttttttgtttttttgtttttcgtttttttggtcactccagtagctcctggaaaaaaccttaaaaaatgtttcctccaaatctgatttcattacatttctgaattgttggggttttttttgttgttttgttttgttttgtagatggagtttcacttttgttgcccaggctggagtgtagtggcgcgatctcggctcagcctcccgagtagctgggattacaggcatgtgccaccacgcccggctaatgtttgtatttttagtagagacggggtttcaccatgttggtcaggctggtctcaaactcctgacctcaggtgatccgcccacctcagcctcccaaagtgctgggatgacaggtgtgagccactgcgcccagcctgaatcatttcttataccttctgacagcccaacttccagaggacagctctggggtactcgttggatgtctgtgagtacctggtcatacgggtcagtagggataagaattgtctctgggctgaggaattcttctgttctctggtttcaccagcgttgggtttgctcatgtaatgtggtcaccatactcaaatggtgtcatggctgaagttggccaccttgcttgagggacaagttgtttatgtatcagctctctgctgggtctccctttccatggcaaatgggcagctccatcctcttgactcttctaaatgcccaaaagaggtgtcatgctttgggggtacgatgtttatactccgtaaagaacatacaaggacattcactgctgatttttttttttgtttgtttgagacagggtctcactctgtcgctcaggctggagtgcagtgatgcaatcttggctcactgcaacctccgcctctcaggttcaagtggttctccttcctcagcctcccaagtagctgggattacaggcacctaccaccagggccagctaatttttgtatgtttagtagaaacggggtttcaccatgttggccaggctgttctcgaactcctgacctcaggtgatctgcccgcctcggtctcccaaagtgctgggattacaggcatgagccactgcacctgacctgctgaattgtttataatggcaagaaataggaaaccccccaatgtctgttgaacagctatcacgttgaaccacgtgaaactgctgttttctaggccaaaaatggtgagcgatcatttatttcatgattcaacctgatacatttacatagtgcaaaactgtgtcacagtttcaggcttttatgaggaaagcgtttctgtgtagaaactggaagctgttcagggcatcggcagctgaaccctgctccgttggtcagcgttactatcatctcggatcatatggagctcatgtcagccgtgtgggtggcgggtgcacagagacggtctggaaggaaacacgcggatctgaacagcagtaatcctgggggatacgggggttgggctagattacagagggctcattttctacgtcatgtattttatgatacttgaattttttgaaatgggcatttattttataacatgttaaaatgtactttttaaattaagtcattttgtaatatttgaatttttacatttgttgtacaatcaggaaaagcaataaagatttttcaaaaataga

SEQ ID NO: 8626 - DNA, 3028 bp, Homo sapiens
ccgctactctggccctcagggttgtgtagtttccggggccacggcacctgggcacaccaggtggcgtcgcgcctttgctttcctgagccttctgagtaaggtaatgtggtgtccgtggggcgacgcctgcgcacaagaccgcgtcgggcctcacttttcccaggccttctgggtaatgtagtttccgggatcggcacccggcctgtgccagcttgcagagctcaccaggtgcagacccctgcggccagggcgaggacggatctgagcagctgggcagcaggtgccaccgcctgtgggacccagagggcttgaggacatctgcaatgctccagaagcccaagagcgtgaagctgcgggccctgcgcagcccgaggaagttcggcgtggctggccggagctgccaggaggtgctgcgcaagggctgtctccgcttccagctccctgagcgcggttcccggctgtgcctgtacgaggatggcacggagctgacggaagattacttccccagtgttcccgacaacgccgagctggtgctgctcaccttgggccaggcctggcagggctatgtgagcgacatcaggcgcttcctcagtgcatttcacgagccacaggtggggctcatccaggccgcccagcagctgctgtgtgatgagcaggccccacagaggcagaggctgctggctgacctcctgcacaacgtcagccagaacatcgcggccgagacccgggctgaggacccgccgtggtttgaaggcttggagtcccgatttcagagcaagtctggctatctgagatacagctgtgagagccggatccggagttacctgagggaggtgagctcctacccctccacggtgggtgcggaggctcaggaggaattcctgcgggtcctcggctccatgtgccagaggctccggtccatgcagtacaatggcagctacttcgacagaggagccaagggcggcagccgcctctgcacaccggaaggctggttctcctgccagggtccctttgacatggacagctgcttatcaagacactccatcaacccctacagtaacagggagagcaggatcctcttcagcacctggaacctggatcacataatagaaaagaaacgcaccatcattcctacactggtggaagcaattaaggaacaagatggaagagaagtggactgggagtatttttatggcctgctttttacctcagagaacctaaaactagtgcacattgtctgccataagaaaaccacccacaagctcaactgtgacccaagcagaatctacaaaccccagacaaggttgaagcggaagcagcctgtgcggaaacgccagtgacacgtacacaccacgtcctggtctttgtttgaggcctgacgtgggcatcattttaacaggtgccttttttgtttttttgtttttcgtttttttggtcactccagtagctcctggaaaaaaccttaaaaaatgtttcctccaaatctgatttcattacatttctgaattgttggggttttttttgttgttttgttttgttttgtagatggagtttcacttttgttgcccaggctggagtgtagtggcgcgatctcggctcagcctcccgagtagctgggattacaggcatgtgccaccacgcccggctaatgtttgtatttttagtagagacggggtttcaccatgttggtcaggctggtctcaaactcctgacctcaggtgatccgcccacctcagcctcccaaagtgctgggatgacaggtgtgagccactgcgcccagcctgaatcatttcttataccttctgacagcccaacttccagaggacagctctggggtactcgttggatgtctgtgagtacctggtcatacgggtcagtagggataagaattgtctctgggctgaggaattcttctgttctctggtttcaccagcgttgggtttgctcatgtaatgtggtcaccatactcaaatggtgtcatggctgaagttggccaccttgcttgagggacaagttgtttatgtatcagctctctgctgggtctccctttccatggcaaatgggcagctccatcctcttgactcttctaaatgcccaaaagaggtgtcatgctttgggggtacgatgtttatactccgtaaagaacatacaaggacattcactgctgatttttttttttgtttgtttgagacagggtctcactctgtcgctcaggctggagtgcagtgatgcaatcttggctcactgcaacctccgcctctcaggttcaagtggttctccttcctcagcctcccaagtagctgggattacaggcacctaccaccagggccagctaatttttgtatgtttagtagaaacggggtttcaccatgttggccaggctgttctcgaactcctgacctcaggtgatctgcccgcctcggtctcccaaagtgctgggattacaggcatgagccactgcacctgacctgctgaattgtttataatggcaagaaataggaaaccccccaatgtctgttgaacagctatcacgttgaaccacgtgaaactgctgttttctaggccaaaaatggtgagcgatcatttatttcatgattcaacctgatacatttacatagtgcaaaactgtgtcacagtttcaggcttttatgaggaaagcgtttctgtgtagaaactggaagctgttcagggcatcggcagctgaaccctgctccgttggtcagcgttactatcatctcggatcatatggagctcatgtcagccgtgtgggtggcgggtgcacagagacggtctggaaggaaacacgcggatctgaacagcagtaatcctgggggatacgggggttgggctagattacagagggctcattttctacgtcatgtattttatgatacttgaattttttgaaatgggcatttattttataacatgttaaaatgtactttttaaattaagtcattttgtaatatttgaatttttacatttgttgtacaatcaggaaaagcaataaagatttttcaaaaataga

SEQ ID NO: 8627 - DNA, 674 bp, Homo sapiens
ccgctactctggccctcagggttgtgtagtttccggggccacggcacctgggcacaccaggtggcgtcgcgcctttgctttcctgagccttctgagtaaggtaatgtggtgtccgtggggcgacgcctgcgcacaagaccgcgtcgggcctcacttttcccaggccttctgggtaatgtagtttccgggatcggcacccggcctgtgccagcttgcagagctcaccaggtgcagacccctgcggccagggcgaggacggatctgagcagctgggcagcaggtgccaccgcctgtgggacccagagggcttgaggacatctgcaatgctccagaagcccaagagcgtgaagctgcgggccctgcgcagcccgaggaagttcggcgtggctggccggagctgccaggaggtgctgcgcaagggctgtctccgcttccagctccctgagcgcggttcccggctgtgcctgtacgaggatggcacggagctgacggaagattacttccccagtgttcccgacaacgccgagctggtgctgctcaccttgggccaggcctggcagggctctgttggtgtcagggcaaggacaaagacccgggacacctcaagtctgagtcctggtgattgccaggccctggggaatgggggaagatgtggtcagaggctcttcttgtga

SEQ ID NO: 8628 - DNA, 944 bp, Homo sapiens
atgctccagaagcccaagagcgtgaagctgcgggccctgcgcagcccgaggaagttcggcgtggctggccggagctgccaggaggtgctgcgcaagggctgtctccgcttccagctccctgagcgcggttcccggctgtgcctgtacgaggatggcacggagctgacggaagattacttccccagtgttcccgacaacgccgagctggtgctgctcaccttgggccaggcctggcagggctgctggagtgcagtggcgtgatcttggctcaccgcaacctctgcctccctgcaccctctgcctcccaggttaaagcgattctcctgcctcagcctcccgagtagctgggattacagggcttggagtcccgatttcagagcaagtctggctatctgagatacagctgtgagagccggatccggagttacctgagggaggtgagctcctacccctccacggtgggtgcggaggctcaggaggaattcctgcgggtcctcggctccatgtgccagaggctccggtccatgcagtacaatggcagctacttcgacagaggagccaagggcggcagccgcctctgcacaccggaaggctggttctcctgccagggtccctttgacatggacagctgcttatcaagacactccatcaacccctacagtaacagggagagcaggatcctcttcagcacctggaacctggatcacataatagaaaagaaacgcaccatcattcctacactggtggaagcaattaaggaacaagatggaagagaagtggactgggagtatttttatggcctgctttttacctcagagaacctaaaactagtgcacattgtctgccataagaaaaccacccacaagctcaactgtgacccaagcagaatctacaaaccccagacaaggttgaagcggaagcagcctgtgcggaaacgccagtga

SEQ ID NO: 8629 - DNA, 572 bp, Homo sapiens
atgctccagaagcccaagagcgtgaagctgcgggccctgcgcagcccgaggaagttcggcgtggctggccggagctgccaggaggtgctgcgcaagggctgtctccgcttccagctccctgagcgcggttcccggctgtgcctgtacgaggatggcacggagctgacggaagattacttccccagtgttcccgacaacgccgagctggtgctgctcaccttgggccaggcctggcagggctgtgagtgatggacagctgcttatcaagacactccatcaacccctacagtaacagggagagcaggatcctcttcagcacctggaacctggatcacataatagaaaagaaacgcaccatcattcctacactggtggaagcaattaaggaacaagatggaagagaagtggactgggagtatttttatggcctgctttttacctcagagaacctaaaactagtgcacattgtctgccataagaaaaccacccacaagctcaactgtgacccaagcagaatctacaaaccccagacaaggttgaagcggaagcagcctgtgcggaaacgccagtga

SEQ ID NO: 8630 - DNA, 3152 bp, Homo sapiens
ccgctactctggccctcagggttgtgtagtttccggggccacggcacctgggcacaccaggtggcgtcgcgcctttgctttcctgagccttctgagtaaggtaatgtggtgtccgtggggcgacgcctgcgcacaagaccgcgtcgggcctcacttttcccaggccttctgggtaatgtagtttccgggatcggcacccggcctgtgccagcttgcagagctcaccaggtgcagacccctgcggccagggcgaggacggatctgagcagctgggcagcaggtgccaccgcctgtgggacccagagggcttgaggacatctgcaatgctccagaagcccaagagcgtgaagctgcgggccctgcgcagcccgaggaagttcggcgtggctggccggagctgccaggaggtgctgcgcaagggctgtctccgcttccagctccctgagcgcggttcccggctgtgcctgtacgaggatggcacggagctgacggaagattacttccccagtgttcccgacaacgccgagctggtgctgctcaccttgggccaggcctggcagggctatgtgagcgacatcaggcgcttcctcagtgcatttcacgagccacaggtggggctcatccaggccgcccagcagctgctgtgtgatgagcaggccccacagaggcagaggctgctggctgacctcctgcacaacgtcagccagaacatcgcggccgagacccgggctgaggacccgccgtggtttgaaggcttggagtcccgatttcagagcaagtctggctatctgagatacagctgtgagagccggatccggagttacctgagggaggtgagctcctacccctccacggtgggtgcggaggctcaggaggaattcctgcgggtcctcggctccatgtgccagaggctccggtccatgcagtacaatggcagctacttcgacagaggagccaagggcggcagccgcctctgcacaccggaaggctggttctcctgccagggtccctttgacatggacagctgcttatcaagacactccatcaacccctacagtaacagggagagcaggatcctcttcagcacctggaacctggatcacatagatggagtcttgctctgtggcccaggctaaagtgcagtggcaggatcatggctcactgaagccctgaactcctggcctcaagcaatcctcctgcctcagcctcctgagtcgctgggactacagaatagaaaagaaacgcaccatcattcctacactggtggaagcaattaaggaacaagatggaagagaagtggactgggagtatttttatggcctgctttttacctcagagaacctaaaactagtgcacattgtctgccataagaaaaccacccacaagctcaactgtgacccaagcagaatctacaaaccccagacaaggttgaagcggaagcagcctgtgcggaaacgccagtgacacgtacacaccacgtcctggtctttgtttgaggcctgacgtgggcatcattttaacaggtgccttttttgtttttttgtttttcgtttttttggtcactccagtagctcctggaaaaaaccttaaaaaatgtttcctccaaatctgatttcattacatttctgaattgttggggttttttttgttgttttgttttgttttgtagatggagtttcacttttgttgcccaggctggagtgtagtggcgcgatctcggctcagcctcccgagtagctgggattacaggcatgtgccaccacgcccggctaatgtttgtatttttagtagagacggggtttcaccatgttggtcaggctggtctcaaactcctgacctcaggtgatccgcccacctcagcctcccaaagtgctgggatgacaggtgtgagccactgcgcccagcctgaatcatttcttataccttctgacagcccaacttccagaggacagctctggggtactcgttggatgtctgtgagtacctggtcatacgggtcagtagggataagaattgtctctgggctgaggaattcttctgttctctggtttcaccagcgttgggtttgctcatgtaatgtggtcaccatactcaaatggtgtcatggctgaagttggccaccttgcttgagggacaagttgtttatgtatcagctctctgctgggtctccctttccatggcaaatgggcagctccatcctcttgactcttctaaatgcccaaaagaggtgtcatgctttgggggtacgatgtttatactccgtaaagaacatacaaggacattcactgctgatttttttttttgtttgtttgagacagggtctcactctgtcgctcaggctggagtgcagtgatgcaatcttggctcactgcaacctccgcctctcaggttcaagtggttctccttcctcagcctcccaagtagctgggattacaggcacctaccaccagggccagctaatttttgtatgtttagtagaaacggggtttcaccatgttggccaggctgttctcgaactcctgacctcaggtgatctgcccgcctcggtctcccaaagtgctgggattacaggcatgagccactgcacctgacctgctgaattgtttataatggcaagaaataggaaaccccccaatgtctgttgaacagctatcacgttgaaccacgtgaaactgctgttttctaggccaaaaatggtgagcgatcatttatttcatgattcaacctgatacatttacatagtgcaaaactgtgtcacagtttcaggcttttatgaggaaagcgtttctgtgtagaaactggaagctgttcagggcatcggcagctgaaccctgctccgttggtcagcgttactatcatctcggatcatatggagctcatgtcagccgtgtgggtggcgggtgcacagagacggtctggaaggaaacacgcggatctgaacagcagtaatcctgggggatacgggggttgggctagattacagagggctcattttctacgtcatgtattttatgatacttgaattttttgaaatgggcatttattttataacatgttaaaatgtactttttaaattaagtcattttgtaatatttgaatttttacatttgttgtacaatcaggaaaagcaataaagatttttcaaaaataga

SEQ ID NO: 8631 - DNA, 4208 bp, Homo sapiens
ccccggttccgctgtcttttctgtctacagtttgcgatccccgcgtccaggatggagcagctgaacgaactggagctgctgatggagaagagtttttgggaggaggcggagctgccggcggagctatttcagaagaaagtggtagcttcctttccaagaacagttctgagcacaggaatggataaccggtacctggtgttggcagtcaatactgtacagaacaaagagggaaactgtgaaaagcgcctggtcatcactgcttcacagtcactagaaaataaagaactatgcatccttaggaatgactggtgttctgttccagtagagccaggagatatcattcatttggagggagactgcacatctgacacttggataatagataaagattttggatatttgattctgtatccagacatgctgatttctggcaccagcatagccagtagtattcgatgtatgagaagagctgtcctgagtgaaacttttaggagctctgatccagccacacgccaaatgctaattggtacggttctccatgaggtgtttcaaaaagccataaataatagctttgccccagaaaagctacaagaacttgcttttcaaacaattcaagaaataagacatttgaaggaaatgtaccgcttaaatctaagtcaagatgaaataaaacaagaagtagaggactatcttccttcgttttgtaaatgggcaggagatttcatgcataaaaacacttcgactgacttccctcagatgcagctctctctgccaagtgataatagtaaggataattcaacatgtaacattgaagtcgtgaaaccaatggatattgaagaaagcatttggtcccctaggtttggattgaaaggcaaaatagatgttacagttggtgtgaaaatacatcgagggtataaaacaaaatacaagataatgccgctggaacttaaaactggcaaagaatcaaattctattgaacaccgtagtcaggttgttctgtacactctactaagccaagagagaagagctgatccagaggctggcttgcttctctacctcaagactggtcagatgtaccctgtgcctgccaaccatctagataaaagagaattattaaagctaagaaaccagatggcattctcattgtttcaccgtattagcaaatctgctactagacagaagacacagcttgcttctttgccacaaataattgaggaagagaaaacttgtaaatattgttcacaaattggcaattgtgctctttatagcagagcagttgaacaacagatggattgtagttcagtcccaattgtgatgctgcccaaaatagaagaagaaacccagcatctgaagcaaacacacttagaatatttcagcctttggtgtctaatgttaaccctggagtcacaatcgaaggataataaaaagaatcaccaaaatatctggctaatgcctgcttcggaaatggagaagagtggcagttgcattggaaacctgattagaatggaacatgtaaagatagtttgtgatgggcaatatttacataatttccaatgtaaacatggtgccatacctgtcacaaatctaatggcaggtgacagagttattgtaagtggagaagaaaggtcactgtttgctttgtctagaggatatgtgaaggagattaacatgacaacagtaacttgtttattagacagaaacttgtcggtccttccagaatcaactttgttcagattagaccaagaagaaaaaaattgtgatatagataccccattaggaaatctttccaaattgatggaaaacacgtttgtcagcaaaaaacttcgagatttaattattgactttcgtgaacctcagtttatatcctaccttagttctgttcttccacatgatgcaaaggatacagttgcctgcattctaaagggtttgaataagcctcagaggcaagcgatgaaaaaggtacttctttcaaaagactacacactcatcgtgggtatgcctgggacaggaaaaacaactacgatatgtactctcgtaagaattctctacgcctgtggttttagcgttttgttgaccagctatacacactctgctgttgacaatattcttttgaagttagccaagtttaaaataggatttttgcgtttgggtcagattcagaaggttcatccagctatccagcaatttacagagcaagaaatttgcagatcaaagtccattaaatccttagctcttctagaagaactctacaatagtcaacttatagttgcaacaacatgtatgggaataaaccatccaatattttcccgtaaaatttttgatttttgtattgtggatgaagcctctcaaattagccaaccaatttgtctgggccccctttttttttcacggagatttgtgttagtgggggaccatcagcagcttcctcccctggtgctaaaccgtgaagcaagagctcttggcatgagtgaaagcttattcaagaggctggagcagaataagagtgctgttgtacagttaaccgtgcagtacagaatgaacagtaaaattatgtccttaagtaataagctgacctatgagggcaagctggagtgtggatcagacaaagtggccaatgcagtgataaacctacgtcactttaaagatgtgaagctggaactggaattttatgctgactattctgataatccttggttgatgggagtatttgaacccaacaatcctgtttgtttccttaatacagacaaggttccagcgccagaacaagttgaaaaaggtggtgtgagcaatgtaacagaagccaaactcatagttttcctaacctccatttttgttaaggctggatgcagtccctctgatattggtattattgcaccgtacaggcagcaattaaagatcatcaatgatttattggcacgttctattgggatggtcgaagttaatacagtagacaaataccaaggaagggacaaaagtattgtcctagtatcttttgttagaagtaataaggatggaactgttggtgaactcttgaaagattggcgacgtcttaatgttgctataaccagagccaaacataaactgattcttctggggtgtgtgccctcactaaattgctatcctcctttggagaagctgcttaatcatttaaactcagaaaaattaatcattgatcttccatcaagagaacatgaaagtctttgccacatattgggtgactttcaaagagaataaaacactatttcccttgccttttcatactagggcagtatctcctctagctagtgcccatacagaaaattctatcaccatacaaaatttaatgcagtatttatgttttaaagcacaggtgtaccgaaaactgtgaaaagtctgaatttatgggttctatgcatgcatttttgcctaacctagagaaagagtttgataaatttttaccagctttgaagatggattaacttttgactttgagctttaaacttttaagtcagacatttcaggactaatttgattttgtagatatcattgtaagaactttatttgaaagactgaataaagggatttgatttgttttcatcatttaagcacagtcttgtgatgatgagaacataagtgtgattcttttctgtattttgaggtccctaatccaaagcccattttgctaggattttttctgctatcagatgtgttttcactctaaacctagtcttttatgacatgaattgattacttcctgttaattttctatcctcccttactatcctccttttttgttttcagtattcagtatttcagtattctagagtagattttgatataaaagaaaataattcttacatcatcttttgcaacaaattttgttttctgaattgataataaatttaaaaagttgattcctattttcacatatgttcatatgcccctatgtttgggggtatcactcagttttcccttttttgtgtaaagatgttttgtaaaacaaaattgtctcaaagtgattatattatatatataaaaagtaacagattttaacaaaggttaaaagattcttggggtaacagattcttctggggcttggaaatcttccatttctcttgagggttttttttaatgagtgttaaatatgttaaaatttttatttctacctcatgtgtttttttaaattattacttgaagttttttatttaataaattttttctactaatgg

SEQ ID NO: 8632 - DNA, 3702 bp, Homo sapiens
atgaagactccctgtattcccagtcctaagcaagggagcaaaggcaggggacagagccctgctgctcaggtgaggggccccacgtggaacgcgccggcgcgggaggggcggcctggcgcaggtcatttgggacatctgcgggttggcgcatgcgcgcgaggtgcgcaggctcgcgcctttttcccttttctaagctttctgtgttacccccggttccgctgtcttttctgtctacagtttgcgatccccgcgtccaggatggagcagctgaacgaactggagctgctgatggagaagagtttttgggaggaggcggagctgccggcggagctatttcagaagaaagtggtagcttcctttccaagaacagttctgagcacaggaatggataaccggtacctggtgttggcagtcaatactgtacagaacaaagagggaaactgtgaaaagcgcctggtcatcactgcttcacagtcactagaaaataaagaactatgcatccttaggaatgactggtgttctgttccagtagagccaggagatatcattcatttggagggagactgcacatctgacacttggataatagataaagattttggatatttgattctgtatccagacatgctgatttctggcaccagcatagccagtagtattcgatgtatgagaagagctgtcctgagtgaaacttttaggagctctgatccagccacacgccaaatgctaattggtacggttctccatgaggtgtttcaaaaagccataaataatagctttgccccagaaaagctacaagaacttgcttttcaaacaattcaagaaataagacatttgaaggaaatgtaccgcttaaatctaagtcaagatgaaataaaacaagaagtagaggactatcttccttcgttttgtaaatgggcaggagatttcatgcataaaaacacttcgactgacttccctcagatgcagctctctctgccaagtgataatagtaaggataattcaacatgtaacattgaagtcgtgaaaccaatggatattgaagaaagcatttggtcccctaggtttggattgaaaggcaaaatagatgttacagttggtgtgaaaatacatcgagggtataaaacaaaatacaagataatgccgctggaacttaaaactggcaaagaatcaaattctattgaacaccgtagtcaggttgttctgtacactctactaagccaagagagaagagctgatccagaggctggcttgcttctctacctcaagactggtcagatgtaccctgtgcctgccaaccatctagataaaagagaattattaaagctaagaaaccagatggcattctcattgtttcaccgtattagcaaatctgctactagacagaagacacagcttgcttctttgccacaaataattgaggaagagaaaacttgtaaatattgttcacaaattggcaattgtgctctttatagcagagcagttgaacaacagatggattgtagttcagtcccaattgtgatgctgcccaaaatagaagaagaaacccagcatctgaagcaaacacacttagaatatttcagcctttggtgtctaatgttaaccctggagtcacaatcgaaggataataaaaagaatcaccaaaatatctggctaatgcctgcttcggaaatggagaagagtggcagttgcattggaaacctgattagaatggaacatgtaaagatagtttgtgatgggcaatatttacataatttccaatgtaaacatggtgccatacctgtcacaaatctaatggcaggtgacagagttattgtaagtggagaagaaaggtcactgtttgctttgtctagaggatatgtgaaggagattaacatgacaacagtaacttgtttattagacagaaacttgtcggtccttccagaatcaactttgttcagattagaccaagaagaaaaaaattgtgatatagataccccattaggaaatctttccaaattgatggaaaacacgtttgtcagcaaaaaacttcgagatttaattattgactttcgtgaacctcagtttatatcctaccttagttctgttcttccacatgatgcaaaggatacagttgcctgcattctaaagggtttgaataagcctcagaggcaagcgatgaaaaaggtacttctttcaaaagactacacactcatcgtgggtatgcctgggacaggaaaaacaactacgatatgtactctcgttccagcgccagaacaagttgaaaaaggtggtgtgagcaatgtaacagaagccaaactcatagttttcctaacctccatttttgttaaggctggatgcagtccctctgatattggtattattgcaccgtacaggcagcaattaaagatcatcaatgatttattggcacgttctattgggatggtcgaagttaatacagtagacaaataccaaggaagggacaaaagtattgtcctagtatcttttgttagaagtaataaggatggaactgttggtgaactcttgaaagattggcgacgtcttaatgttgctataaccagagccaaacataaactgattcttctggggtgtgtgccctcactaaattgctatcctcctttggagaagctgcttaatcatttaaactcagaaaaattaatcattgatcttccatcaagagaacatgaaagtctttgccacatattgggtgactttcaaagagaataaaacactatttcccttgccttttcatactagggcagtatctcctctagctagtgcccatacagaaaattctatcaccatacaaaatttaatgcagtatttatgttttaaagcacaggtgtaccgaaaactgtgaaaagtctgaatttatgggttctatgcatgcatttttgcctaacctagagaaagagtttgataaatttttaccagctttgaagatggattaacttttgactttgagctttaaacttttaagtcagacatttcaggactaatttgattttgtagatatcattgtaagaactttatttgaaagactgaataaagggatttgatttgttttcatcatttaagcacagtcttgtgatgatgagaacataagtgtgattcttttctgtattttgaggtccctaatccaaagcccattttgctaggattttttctgctatcagatgtgttttcactctaaacctagtcttttatgacatgaattgattacttcctgttaattttctatcctcccttactatcctccttttttgttttcagtattcagtatttcagtattctagagtagattttgatataaaagaaaataattcttacatcatcttttgcaacaaattttgttttctgaattgataataaatttaaaaagttgattcctattttcacatatgttcatatgcccctatgtttgggggtatcactcagttttcccttttttgtgtaaagatgttttgtaaaacaaaattgtctcaaagtgattatattatatatataaaaagtaacagattttaacaaaggttaaaagattcttggggtaacagattcttctggggcttggaaatcttccatttctcttgagggttttttttaatgagtgttaaatatgttaaaatttttatttctacctcatgtgtttttttaaattattacttgaagttttttatttaataaattttttctactaatgga

SEQ ID NO: 8633 - DNA, 4416 bp, Homo sapiens
atgaagactccctgtattcccagtcctaagcaagggagcaaaggcaggggacagagccctgctgctcaggtgaggggccccacgtggaacgcgccggcgcgggaggggcggcctggcgcaggtcatttgggacatctgcgggttggcgcatgcgcgcgaggtgcgcaggctcgcgcctttttcccttttctaagctttctgtgttacccccggttccgctgtcttttctgtctacagtttgcgatccccgcgtccaggatggagcagctgaacgaactggagctgctgatggagaagagtttttgggaggaggcggagctgccggcggagctatttcagaagaaagtggtagcttcctttccaagaacagttctgagcacaggaatggataaccggtacctggtgttggcagtcaatactgtacagaacaaagagggaaactgtgaaaagcgcctggtcatcactgcttcacagtcactagaaaataaagaactatgcatccttaggaatgactggtgttctgttccagtagagccaggagatatcattcatttggagggagactgcacatctgacacttggataatagataaagattttggatatttgattctgtatccagacatgctgatttctggcaccagcatagccagtagtattcgatgtatgagaagagctgtcctgagtgaaacttttaggagctctgatccagccacacgccaaatgctaattggtacggttctccatgaggtgtttcaaaaagccataaataatagctttgccccagaaaagctacaagaacttgcttttcaaacaattcaagaaataagacatttgaaggaaatgtaccgcttaaatctaagtcaagatgaaataaaacaagaagtagaggactatcttccttcgttttgtaaatgggcaggagatttcatgcataaaaacacttcgactgacttccctcagatgcagctctctctgccaagtgataatagtaaggataattcaacatgtaacattgaagtcgtgaaaccaatggatattgaagaaagcatttggtcccctaggtttggattgaaaggcaaaatagatgttacagttggtgtgaaaatacatcgagggtataaaacaaaatacaagataatgccgctggaacttaaaactggcaaagaatcaaattctattgaacaccgtagtcaggttgttctgtacactctactaagccaagagagaagagctgatccagaggctggcttgcttctctacctcaagactggtcagatgtaccctgtgcctgccaaccatctagataaaagagaattattaaagctaagaaaccagatggcattctcattgtttcaccgtattagcaaatctgctactagacagaagacacagcttgcttctttgccacaaataattgaggaagagaaaacttgtaaatattgttcacaaattggcaattgtgctctttatagcagagcagttgaacaacagatggattgtagttcagtcccaattgtgatgctgcccaaaatagaagaagaaacccagcatctgaagcaaacacacttagaatatttcagcctttggtgtctaatgttaaccctggagtcacaatcgaaggataataaaaagaatcaccaaaatatctggctaatgcctgcttcggaaatggagaagagtggcagttgcattggaaacctgattagaatggaacatgtaaagatagtttgtgatgggcaatatttacataatttccaatgtaaacatggtgccatacctgtcacaaatctaatggcaggtgacagagttattgtaagtggagaagaaaggtcactgtttgctttgtctagaggatatgtgaaggagattaacatgacaacagtaacttgtttattagacagaaacttgtcggtccttccagaatcaactttgttcagattagaccaagaagaaaaaaattgtgatatagataccccattaggaaatctttccaaattgatggaaaacacgtttgtcagcaaaaaacttcgagatttaattattgactttcgtgaacctcagtttatatcctaccttagttctgttcttccacatgatgcaaaggatacagttgcctgcattctaaagggtttgaataagcctcagaggcaagcgatgaaaaaggtacttctttcaaaagactacacactcatcgtgggtatgcctgggacaggaaaaacaactacgatatgtactctcgtaagaattctctacgcctgtggttttagcgttttgttgaccagctatacacactctgctgttgacaatattcttttgaagttagccaagtttaaaataggatttttgcgtttgggtcagattcagaaggttcatccagctatccagcaatttacagagcaagaaatttgcagatcaaagtccattaaatccttagctcttctagaagaactctacaatagtcaacttatagttgcaacaacatgtatgggaataaaccatccaatattttcccgtaaaatttttgatttttgtattgtggatgaagcctctcaaattagccaaccaatttgtctgggccccctttttttttcacggagatttgtgttagtgggggaccatcagcagcttcctcccctggtgctaaaccgtgaagcaagagctcttggcatgagtgaaagcttattcaagaggctggagcagaataagagtgctgttgtacagttaaccgtgcagtacagaatgaacagtaaaattatgtccttaagtaataagctgacctatgagggcaagctggagtgtggatcagacaaagtggccaatgcagtgataaacctacgtcactttaaagatgtgaagctggaactggaattttatgctgactattctgataatccttggttgatgggagtatttgaacccaacaatcctgtttgtttccttaatacagacaaggttccagcgccagaacaagttgaaaaaggtggtgtgagcaatgtaacagaagccaaactcatagttttcctaacctccatttttgttaaggctggatgcagtccctctgatattggtattattgcaccgtacaggcagcaattaaagatcatcaatgatttattggcacgttctattgggatggtcgaagttaatacagtagacaaataccaaggaagggacaaaagtattgtcctagtatcttttgttagaagtaataaggatggaactgttggtgaactcttgaaagattggcgacgtcttaatgttgctataaccagagccaaacataaactgattcttctggggtgtgtgccctcactaaattgctatcctcctttggagaagctgcttaatcatttaaactcagaaaaattaatcattgatcttccatcaagagaacatgaaagtctttgccacatattgggtgactttcaaagagaataaaacactatttcccttgccttttcatactagggcagtatctcctctagctagtgcccatacagaaaattctatcaccatacaaaatttaatgcagtatttatgttttaaagcacaggtgtaccgaaaactgtgaaaagtctgaatttatgggttctatgcatgcatttttgcctaacctagagaaagagtttgataaatttttaccagctttgaagatggattaacttttgactttgagctttaaacttttaagtcagacatttcaggactaatttgattttgtagatatcattgtaagaactttatttgaaagactgaataaagggatttgatttgttttcatcatttaagcacagtcttgtgatgatgagaacataagtgtgattcttttctgtattttgaggtccctaatccaaagcccattttgctaggattttttctgctatcagatgtgttttcactctaaacctagtcttttatgacatgaattgattacttcctgttaattttctatcctcccttactatcctccttttttgttttcagtattcagtatttcagtattctagagtagattttgatataaaagaaaataattcttacatcatcttttgcaacaaattttgttttctgaattgataataaatttaaaaagttgattcctattttcacatatgttcatatgcccctatgtttgggggtatcactcagttttcccttttttgtgtaaagatgttttgtaaaacaaaattgtctcaaagtgattatattatatatataaaaagtaacagattttaacaaaggttaaaagattcttggggtaacagattcttctggggcttggaaatcttccatttctcttgagggttttttttaatgagtgttaaatatgttaaaatttttatttctacctcatgtgtttttttaaattattacttgaagttttttatttaataaattttttctactaatgga

SEQ ID NO: 8634 - DNA, 3519 bp, Homo sapiens
gggaaggccagagcgggcgtccccgccagtgaccccacgccgcccgtccgcgcccaacccggcctccgccgagtgtccaaaccaaaagcgaaaggaacccgaccccgcgtcccctccggcggctccgtagtcgcgtccgcttggagctcgccgggcgcctccgaccctgccgggccgctttgtgacttcactcgtttcgcaacaagcccgggcagcccgcgccccacccactctggcccggcagcctcgccgcccgcagcctcgctccgctcctcgcgcttcccctccctccggggctgggcctgccccggccgtcgcggagcctcccctcccaccgtccgtgagtgtacgcgcccggccgccgcctccaggcagcccggagcaacccggcgcccggccccgctgggcgcagcactccgtcggcggcggcggcggcgcgatgctgtgcttcctgaggggaatggctttcgtccccttcctcttggtgacctggtcgtcagccgccttcattatctcctacgtggtcgccgtgctctccgggcacgtcaaccccttcctcccgtatatcagtgatacgggaacaacacctccagagagtggtatttttggatttatgataaacttctctgcatttcttggtgcagccacgatgtatacaagatacaaaatagtacagaagcaaaatcaaacctgctatttcagcactcctgtttttaacttggtgtctttagtgcttggattggtgggatgtttcggaatgggcattgtcgccaattttcaggagttagctgtgccagtggttcatgacgggggcgctcttttggcctttgtctgtggtgtcgtgtacacgctcctacagtccatcatctcttacaaatcatgtccccagtggaacagtctctcgacatgccacatacggatggtcatctctgccgtttcttgcgcagctgtcatccccatgattgtctgtgcttcactaatttccataaccaagctggagtggaatccaagagaaaaggattatgtatatcacgtagtgagtgcgatctgtgaatggacagtggcctttggttttattttctacttcctaactttcatccaagatttccagagtgtcaccctaaggatatccacagaaatcaatggtgatatttgaagaaagaagaattcagtctcactcagtgaatgtcgcaggccatttctaaaagtgctacagaggacagacagggttttgaggccaccctgattattgggatgcatctgcagcacatccaggacttgaatttcattacgagttcctaatagttgtatttctaaagatgtgtttcctagagaatgtacagccttatgacactgtagtgatgtttttataattttctaagtagatttttttatattaacaaattcatatacagaaaaaataaggtgttacaaaaaatggagagctcttatttttgtacagattctgtcgtttttgttttatttgtgtgagatttatggaaatacactaaatgagtaattcaggttcagtacatttattacaaagtgaaatcaggggatattcatttgtaaattttattcttagtgaatgaactgtataattttttttatcaggagagcacttataaaattcaatttataaagatcatatacccaaatcataaagatttagttgatacattaacactaagatactctgatttttagccgaactaaacaaagtgcttctactgagaggcctttataccaccatgtacagtaactctaagtgaatacggaagaccttggttttgaaattctgccaccttgtttctccctgctcatgaggtcgcaccttttgctcttgctgctaattgcccattcgtagtgggtgtaatgccaggtggaatggtttcaacaagtcaggtgaaaaccatcctttattgttgctggcacaacttgatatatagtctgactcagaactgaagctcacatctcaaattcatttcatgccagtaaatgtggcaaagagaagaaaggcccaagagcgagacaagaagaatggagaagggggcagccaagaagaacttctgggttcagggtactgtttatttgctccttctcttcatgcctgtggctggatgtcccacaacactataagaaatataagtcaagccctttgtgttaagcaagaactacagactccatcttttcacccaaatcatgaatgaccaataaaaagcaagttattccagaggaagaagcagcccttgaaatgttaaggcttaggcttgaaaggtgaagagcaggaattctctctttcaaatcctagagcataaacccatgtgtggccaagtgagatcagccctcaagggcacatgccaagggcagagcagcccatgtagacagcttcggagggcatgggggtgtagggagttcggggtagctcctcattaactatttgttgggtgagtaaaggggtgaggctcagtggcaggtacctctgcaatgacaagctgcctcccctctatgtgtttagcatatgttattagaacatgtccgacacccctaccgctgccatttgggccctttaataaagccaagtagagaaatctggcaataaaaggcaaatgtaagcatgctttctttaagacgcatcataaatggttttctttaagtgaatggaagagtttgacagagatacacctttgtaagaaaacattaagaatgctggctggctgtggtggctcacacctgtattcccagcactttgggaggcctaggcaggaggattgcttgagcctgggacttcgagaccagactgggaaacatggcaaaatcccatctctacaacaaaaatacaaaaattagccaagtgcggtggtgtgcctgtagtcctagttacttgggaggctgaggtgggagaatcacctgagcccaggaggtggaggctgcagtgagccatgccaatgcactccagtctgggcaacagagtgagaccctgtctcaaaaataaataaataaataaatgaataaagagaatgctaatcatttctgggttcactgcgactcactgtagtgctggggatcccccttgtaacactggaactgaaagacagtgatgaaagctatgtcaagcattcattattctgaagaggaggagaaatgccacatacctttcccatgggacctgtggtggaatgaatccatacttctgcctcacttcgagcagacttttgttctcggcgctcctcacgatggagtttcatgcttcattttcacatctctctgcacaattagattgggagctccttgagggcagagtacgtgccttaatctttatctttgtaatgccacaatgaacagagtgcctcctggtacactgtaggagcttaagaaatactcactgaatgcatgaatgaatgaatgaacaaatgaaggaatgactaaggatgtttgtagtgctataatatagaatgggatttactctgctttaccagttagtttcataataaacaaatagtctgtatcgcctggtaa

SEQ ID NO: 8635 - DNA, 2246 bp, Homo sapiens
aaggtaagtcgaagtaggggagaagggacaggccccagcgcttgcagcccgctccctctagaagggtgcgtcagagggtgggatctggcagctcggggaagtgggcgcagcctggagcccccttacccgcgtcgcaggcgcgcgagactcctgctggccctcattgcctccgggggctaccttatgccaggcgccagaggggggctggttggggcgggagctgcgggggtttccgggggcggggatgagtgcagctgggctcagctccccgtgccctacctttctgttctcttccttggtttcccctactctcctcctgccccaagcagtgcctgatgccgagttccgtctctcgcgtcttttcctggtcccaggcaaagcggagcggagatcctcaaacggcctagtgcttcgcgcttccggagaaaatcagcggtctaattaattcctctggtttgttgaagcagttaccaagaatcttcaaccctttcccacaaaagctaattgagtacacgttcctgttgagtacacgttcctgttgatttacaaaaggtgcaggtatgagcaggtctgaagactaacattttgtgaagttgtaaaacagaaaacctgttagaaatgtggtggtttcagcaaggcctcagtttccttccttcagcccttgtaatttggacatctgctgctttcatattttcatacattactgcagtaacactccaccatatagacccggctttaccttatatcagtgacactggtacagtagctccagaaaaatgcttatttggggcaatgctaaatattgcggcagttttatgcattgctaccatttatgttcgttataagcaagttcatgctctgagtcctgaagagaacgttatcatcaaattaaacaaggctggccttgtacttggaatactgagttgtttaggactttctattgtggcaaacttccagaaaacaaccctttttgctgcacatgtaagtggagctgtgcttacctttggtatgggctcattatatatgtttgttcagaccatcctttcctaccaaatgcagcccaaaatccatggcaaacaagtcttctggatcagactgttgttggttatctggtgtggagtaagtgcacttagcatgctgacttgctcatcagttttgcacagtggcaattttgggactgatttagaacagaaactccattggaaccccgaggacaaaggttatgtgcttcacatgatcactactgcagcagaatggtctatgtcattttccttctttggttttttcctgacttacattcgtgattttcagaaaatttctttacgggtggaagccaatttacatggattaaccctctatgacactgcaccttgccctattaacaatgaacgaacacggctactttccagagatatttgatgaaaggataaaatatttctgtaatgattatgattctcagggattggggaaaggttcacagaagttgcttattcttctctgaaattttcaaccacttaatcaaggctgacagtaacactgatgaatgctgataatcaggaaacatgaaagaagccatttgatagattattctaaaggatatcatcaagaagactattaaaaacacctatgcctatacttttttatctcagaaaataaagtcaaaagactatgatatcatagttttttataccttatttaagagaaacaacctgacgtgcaccaatcagtctgcacatcccaacccttcacattttataaattattgtagatcatgttttgttaggagcacttttatgagagacattttccatgactaaataatcagcattagtcagtaaatcctttagaactgggttttgaaatgggagttttatcatattaaatcatttcttgtagtcttacattttttgttgttgttctggaatctacctgtaaaggaaagtagacctggattcatgtgggctcttccatggcttaagtgttgcccaagagattttgtaggtaacgatttttttttttctggccacaatgccagatactaagctaattggtctatcatacacatgcttgcagtagtttcatgaagtttagtctctggcgtgaaattttaatcaccaatgaaggagagaggcacctgtaggtaaatttactttagtcatattttatataaaacaagggttagtattcatgtaacattgagaagtttgggaataacagcagatatgattaataaaagtcataaccat

SEQ ID NO: 8636 - DNA, 1883 bp, Homo sapiens
gcgattgccgtaaaggggaacaaggtttgaacgagcagcgccgcaggcgcgctcctcggtgccgtgagcgcgccccggggccggccggtctgctcgggagcgcgccccgtggcccagccctgtctccttttagcataggggcttcggcgccagcggccagcgctagtcggtctggtaaggatttacaaaaggtgcaggtatgagcaggtctgaagactaacattttgtgaagttgtaaaacagaaaacctgttagaaatgtggtggtttcagcaaggcctcagtttccttccttcagcccttgtaatttggacatctgctgctttcatattttcatacattactgcagtaacactccaccatatagacccggctttaccttatatcagtgacactggtacagtagctccagaaaaatgcttatttggggcaatgctaaatattgcggcagttttatgcattgctaccatttatgttcgttataagcaagttcatgctctgagtcctgaagagaacgttatcatcaaattaaacaaggctggccttgtacttggaatactgagttgtttaggactttctattgtggcaaacttccagaaaacaaccctttttgctgcacatgtaagtggagctgtgcttacctttggtatgggctcattatatatgtttgttcagaccatcctttcctaccaaatgcagcccaaaatccatggcaaacaagtcttctggatcagactgttgttggttatctggtgtggagtaagtgcacttagcatgctgacttgctcatcagttttgcacagtggcaattttgggactgatttagaacagaaactccattggaaccccgaggacaaaggttatgtgcttcacatgatcactactgcagcagaatggtctatgtcattttccttctttggttttttcctgacttacattcgtgattttcagaaaatttctttacgggtggaagccaatttacatggattaaccctctatgacactgcaccttgccctattaacaatgaacgaacacggctactttccagagatatttgatgaaaggataaaatatttctgtaatgattatgattctcagggattggggaaaggttcacagaagttgcttattcttctctgaaattttcaaccacttaatcaaggctgacagtaacactgatgaatgctgataatcaggaaacatgaaagaagccatttgatagattattctaaaggatatcatcaagaagactattaaaaacacctatgcctatacttttttatctcagaaaataaagtcaaaagactatgatatcatagttttttataccttatttaagagaaacaacctgacgtgcaccaatcagtctgcacatcccaacccttcacattttataaattattgtagatcatgttttgttaggagcacttttatgagagacattttccatgactaaataatcagcattagtcagtaaatcctttagaactgggttttgaaatgggagttttatcatattaaatcatttcttgtagtcttacattttttgttgttgttctggaatctacctgtaaaggaaagtagacctggattcatgtgggctcttccatggcttaagtgttgcccaagagattttgtaggtaacgatttttttttttctggccacaatgccagatactaagctaattggtctatcatacacatgcttgcagtagtttcatgaagtttagtctctggcgtgaaattttaatcaccaatgaaggagagaggcacctgtaggtaaatttactttagtcatattttatataaaacaagggttagtattcatgtaacattgagaagtttgggaataacagcagatatgattaataaaagtcataacc

SEQ ID NO: 8637 - DNA, 1748 bp, Homo sapiens
gggcgcagcaggccaagggggaggtgcgagcgtggacctgggacgggtctgggcggctctcggtggttggcacgggttcgcacacccattcaagcggcaggacgcacttgtcttagcagttctcgctgaccgcgctagctgcggcttctacgctccggcactctgagttcatcagcaaacgccctggcgtctgtcctcaccatgcctagcctttgggaccgcttctcgtcgtcgtccacctcctcttcgccctcgtccttgccccgaactcccaccccagatcggccgccgcgctcagcctgggggtcggcgacccgggaggaggggtttgaccgctccacgagcctggagagctcggactgcgagtccctggacagcagcaacagtggcttcgggccggaggaagacacggcttacctggatggggtgtcgttgcccgacttcgagctgctcagtgaccctgaggatgaacacttgtgtgccaacctgatgcagctgctgcaggagagcctggcccaggcgcggctgggctctcgacgccctgcgcgcctgctgatgcctagccagttggtaagccaggtgggcaaagaactactgcgcctggcctacagcgagccgtgcggcctgcggggggcgctgctggacgtctgcgtggagcagggcaagagctgccacagcgtgggccagctggcactcgaccccagcctggtgcccaccttccagctgaccctcgtgctgcgcctggactcacgactctggcccaagatccaggggctgtttagctccgccaactctcccttcctccctggcttcagccagtccctgacgctgagcactggcttccgagtcatcaagaagaagctgtacagctcggaacagctgctcattgaggagtgttgaacttcaacctgagggggccgacagtgccctccaagacagagacgactgaacttttggggtggagactagaggcaggagctgagggactgattcctgtggttggaaaactgaggcagccacctaaggtggaggtgggggaatagtgtttcccaggaagctcattgagttgtgtgcgggtggctgtgcattggggacacatacccctcagtactgtagcatgaaacaaaggcttaggggccaacaaggcttccagctggatgtgtgtgtagcatgtaccttattatttttgttactgacagttaacagtggtgtgacatccagagagcagctgggctgctcccgccccagcccggcccagggtgaaggaagaggcacgtgctcctcagagcagccggagggaggggggaggtcggaggtcgtggaggtggtttgtgtatcttactggtctgaagggaccaagtgtgtttgttgtttgttttgtatcttgtttttctgatcggagcatcactactgacctgttgtaggcagctatcttacagacgcatgaatgtaagagtaggaaggggtgggtgtcagggatcacttgggatctttgacacttgaaaaattacacctggcagctgcgtttaagccttcccccatcgtgtactgcagagttgagctggcaggggaggggctgagagggtgggggctggaacccctccccgggaggagtgccatctgggtcttccatctagaactgtttacatgaagataagatactcactgttcatgaatacacttgatgttcaagtattaagacctatgcaatattttttacttttctaataaacatgtttgttaaaaca

SEQ ID NO: 8638 - DNA, 2604 bp, Homo sapiens
gctactgcgaggagccggcgcagggtggcccgggaggggtgagcagggtgccgctggctgctggggtctgcaggtcaccgagtccccaggagaggggactcctaagaagccacctgcctgtgtttacccggcagcgagcgcgcaggcccccgcgaactcctggcagcgctcaggaaaggccgttgcgcctcgcgaaggaaacagagccgttgaccatggttgcaactggcagtttgagcagcaagaacccggccagcatttcagaattgctggactgtggctatcacccagagagcctgctaagtgattttgactactgggattatgttgttcctgaacccaacctcaacgaggtaatatttgaggaatcaacttgccagaatttggttaaaatgctggagaactgtctgtccaaatcaaagcaaactaaacttggttgctcaaaggtccttgtccctgagaaactgacccagagaattgctcaagatgtcctgcggctttcctcaacggagccctgcggcttgcgaggttgtgttatgcacgtgaacttggaaattgaaaatgtatgtaaaaagctggataggattgtgtgtgattctagcgtcgtacctacttttgagcttacacttgtgtttaagcaggagaactgctcatggactagcttcagggactttttctttagtagaggtcgcttctcctctggtttcaggagaactctgatcctcagctcaggatttcgacttgttaagaaaaaactttactcactgattggaacaacagtgattgaagggtcctaaaaagggaaaatatataaagattatttcatgattgggtagtaaaactattcagctagtcagctaaagtcatttgtagtttgccccacctgccctaaataagaaaccccaaatgtagtctcttttctttctgtgtttcacattcatagcaactgcagctaacaggctgattttctggcctttggagaagtgattcaaaatagtgtagattttctgcatagatcccatttttgtacagaattgaatgggatggaataggtaagcaaaagtagaagcccatttgagttttacatttgattccacaatttggtttcaggtaggcttggtaatagactatataaaccagatttgcctattttgattttcatatggcttttttttctgtaagttttcagaggattttttaaatcacagaatcatactaaatgatatttagcctatcaaaacttccaaaagcccacaccaccagttcctgactcaaatttgaagggtttttagacaggagggtaggattaagtaggtgagtttaattaaagcttaaccctaggtaagagtaaatgagaaatattacggcaataatggaactgcttcactgtttcttggtgacttcctcactctaatgttttaaagaggcaacaaaagcttgtggtgccatttcagtaaccacggtgttgttttagatgcctttataagctcagtttcccctgttcttaagtgttgaatactgtctttaaactagaaaaatgcaaaatattgaactgatatttttgtgtgtagttgattactcttccattgagtgaatgatgaatacctgtgaggataggaaattagttctgagatctagtccctctctgattcacttagtaatctatcctcttttcagtattacatgtgcttaatctcagatgaaccatttcaccatggcagtgttatctcatctctgggcttttctgggaattgaagtatctctccttaaccccaattgtcaagggtagtagctgtatactaccactttgaattattgaaacgggtcaatttacgaagtctgcattggctatggagatatggtttatagtacagcctagagaatgaaactcaccgtccagataaccatgcatgcacccagattttttccaccttggatacctgtcactagggaataataaaggcctgattttttgtcttattccaactaagtagatcattatctctttccttttttatgttaatgagagaatttagcctccactcaacaatgttcaattcagcaaggctttcatatccttgctgtgggtcgtggataaggagcttattcaggtttcctgccctagctattagctccacttcacatgctggagaccggcgtagggacagatgtattcatcctggtgttactgaaaaacaggtgtgatcctgttactgatactataagtgacctaaaatgtcactgttcaaattagccagtgttctaacaaactaaactcttcaaatgcttggaaagatactacaaagccaatctttatagaattgggccaagataaatctatgttgttttgcatggctattgttaagctccaaaggttcactgtgtttctgccgctgtcctggagttgtcaccactgactgggcaaggcttcttgggcatggatgtagaactgttgtccttttcccactaacagttatctttgactctcttgcctgttatgcttacaaaatggtgatggcttatggaaggctgttaaattaatattcctgttaaaggaaattaaagtttgtctatttttgacaataaaacattatatatttttaa

SEQ ID NO: 8639 - DNA, 852 bp, Homo sapiens
aggtgagcgaagctgcggccttggtgggggcagcggggccggggggcgctccgcggggcaggtcgcttccaagttttgcgaactgttgagttagtttcaggttgcggctccgctcccagggctttgtcaaattgagttgcagaggccggttccacccctttggcaaaggagttcctccgctagttcgctcccgggacgccgggcattttaggagcctctgcacgactcgcctgcttttgcaaatccgtctcttctcgcctcattttttccagcgctcaggaaaggccgttgcgcctcgcgaaggaaacagagccgttgaccatggttgcaactggcagtttgagcagcaagaacccggccagcatttcagaattgctggactgtggctatcacccagagagcctgctaagtgattttgactactgggattatgttgttcctgaacccaacctcaacgaggtaatatttgaggaatcaacttgccagaatttggttaaaatgctggagaactgtctgtccaaatcaaagcaaactaaacttggttgctcaaaggtccttgtccctgagaaactgacccagagaattgctcaagatgtcctgcggctttcctcaacggagccctgcggcttgcgaggttgtgttatgcacgtgaacttggaaattgaaaatgtatgtaaaaagctggataggattgtgtgtgattctagcgtcgtacctacttttgagcttacacttgtgtttaagcaggagaactgctcatggactagcttcagggactttttctttagtagaggtcgcttctcctctggtttcaggagaactctgatcctcagctcaggatttcgacttgtt

SEQ ID NO: 8640 - DNA, 553 bp, Homo sapiens
gagtgtgaaagcgcggacgctcggggaggggtcgcactgaacaatcaggttcaggctttgacgagtcgtgcacccggaattgcggtcccagtggcccgagatctaccctggaagcaacagcgctcaggaaaggccgttgcgcctcgcgaaggaaacagagccgttgaccatggttgcaactggcagtttgagcagcaagaacccggccagcatttcagaattgctggactgtggctatcacccagagagcctgctaagtgattttgactactgggattatgttgttcctgaacccaacctcaacgaggtaatatttgaggaatcaacttgccagaatttggttaaaatgctggagaactgtctgtccaaatcaaagcaaactaaacttggttgctcaaaggtccttgtccctgagaaactgacccagagaattgctcaagatgtcctgcggctttcctcaacggagccctgcggcttgcgaggttgtgttatgcacgtgaacttggaaattgaaaatgtatgtaaaaagctggataggattgtgtgtgattct

SEQ ID NO: 8641 - DNA, 3048 bp, Homo sapiens
gcgctgggtcaaagttcagccccgcccccgcttccccctcgctgtctccctcggcctgtgccgccgccgacgccgcttgtgggcccgactccgctctgtctgcttcgccaccttctccccgagcactgcccggccggccgccatggctaacgtggctgacacgaagctgtacgacatcctgggcgtcccgcccggcgccagcgagaacgagctgaagaaggcatacagaaagttagccaaggaatatcatcctgataagaatccaaatgcaggagacaaatttaaagaaataagttttgcatatgaagtactatcaaatcctgagaagcgtgagttatatgacagatacggagagcaaggtcttcgggaaggcagcggcggaggtggtggcatggatgatattttctctcacatttttggtgggggattgttcggcttcatgggcaatcagagtagaagtcgaaatggcagaagaagaggagaggacatgatgcatccactcaaagtatctttagaagatctgtataatggcaagacaaccaaactacaacttagcaagaatgtgctctgtagtgcatgcagtggccaaggcggaaagtctggagctgtccaaaagtgtagtgcttgtcgaggtcgaggtgtgcgcatcatgatcagacagctggctccagggatggtacaacagatgcagtctgtgtgctctgattgtaatggagaaggagaggtaattaatgaaaaagaccgctgtaaaaaatgtgaagggaagaaggtgattaaagaagtcaagattcttgaagtccacgtagacaaaggcatgaaacatggacagagaattacattcactggggaagcagaccaggccccaggagtggaacccggagacattgttcttttgctacaggagaaagaacatgaggtatttcagagagatgggaatgatttgcacatgacatataaaataggacttgttgaagctctatgtggatttcagttcacatttaagcaccttgatggacgtcagattgtggtgaaatacccccctggcaaagtaattgaaccagggtgtgttcgtgtagttcgaggtgaagggatgccgcagtatcgtaatccctttgaaaaaggtgatctttacataaagtttgatgtgcagtttcctgaaaacaactggatcaacccagacaagctttctgaactagaagatcttctgccatctagaccggaagttcctaacataattggagaaacagaggaggtagagcttcaggaatttgatagcactcgaggctcaggaggtggtcagaggcgtgaagcctataatgatagctctgatgaagaaagcagcagccatcatggacctggagtgcagtgtgcccatcagtaaactctgcaaacaaattgcacaggtggattttctttccacatttgcctgatttgttctcagcaatccagctggagtgtcttatcaatccagatgaactgagggacatctgttggtctatgtataacttttaaaattggtatagtatctacagagtgtataatttaaactaaccacaaagctttacatcttcattttgactgttccatagcagaataaagcacttgaaaggaaacaagactccctttcacacatggattattataagtttcaatcctggtatctgtgcttgatttttatcagttttgtgtagatttttatgtttcatattttaaatttaaatcccacattgtaaagtttgtacaatttgtcctgaagctttgtgtttggctgcacctgcataagctgctacaaatagaataaagaatttcatagcctgtatctatcatttagatgcatggaaaaaaatgggctttgcacacaatgggtttggagctgactgggaacaatggaaaaaattacattagctgtggttgtaaagtttttttgtttttggttttgttttttttttcttttttctttttttttttttttaccatcttgtgaaaggtttctgaaactcgataataaaaagcggttggtgtaaattattcttttgtgtcacatttttagaaggaaaaacataaaagaatgtatccttagtactggttcttaaacagcccataaaaacccattggcctgaagcttatatctcaggcctatgcccatcttatagtcttggaagacaaaaggctggtagagacagtcttcagtggcttcagtgatgctctgtagaggccagggtgtcttgagtgctgtaactcccaagcactgggctagcctgacttctgtatctccctaccaccacccccttaaaaaaataaggtaacagcaaatctatagtaaaaccatgtctgcatagaacgtgttcaaatcctctgttttcattaaatgtaaaagatgctgtctccattaagttgaatatttggaattggagaagccattgattattattttgagtttctgtaatgttttatagaaaagtaagatgcttattcagaatttaagaatgaaggcaactgaaatatgcattgttgtagttatttatatttcaaactaaaaataagcaaaaaaaaaaggctggtttgagaaaaatcaggtaaaattgatgaaacggatgttgtgtttctctttccatcatctggtttttaccatttcactcagtaggtatttttagaacacacttatttgaggaaagagacatcagatgcacaattttacatttataaaggaacaaatggggaaaactgaaaactaaaaattttaaatgtattaaatgccatccctgagcctaaatctagtatttgtagtttatttctaggtctgctagaacctgaaaacctgaatgaaaaaaggtgtgctgacactaatcaagtcctgtgaggtttaaattattgacctatccactctacctccattgtacaaaaaatattttacaacaagcctgggtaagattcaacagcatagtagttttgtatccaaggttacttccccacaaccactttaaacataagaaatgtggtggcaatataaagtttgtagcctttccaataaaggtttataaaacagtt

SEQ ID NO: 8642 - DNA, 2763 bp, Homo sapiens
cgcctctacgcgcgcccgccgttcccgcgaggcccacctagagccgggcggcgcaggcgcagagtccccgggccaagatggctgcgcggtgctccacacgctggttgctggtggttgtggggaccccgcggctgccggctatatcgggtagaggggcccggccgcccagggagggcgtggtgggggcatggctgagccgcaagctgagcgtccccgcctttgcgtcttccctgacctcttgcggcccccgagcgctgctgacattgagacctggtgtcagccttacaggaacaaaacataaccctttcatttgtactgcctccttccacacgagtgcccctttggccaaagaagattattatcagatattaggagtgcctcgaaatgccagccagaaagagatcaagaaagcctattatcagcttgccaagaagtatcaccctgacacaaataaggatgatcccaaagccaaggagaagttctcccagctggcagaagcctatgaggttttgagtgatgaggtgaagaggaagcagtacgatgcctacggctctgcaggcttcgatcctggggccagcggctcccagcatagctactggaagggaggccccactgtggaccccgaggagctgttcaggaagatctttggcgagttctcatcctcttcatttggagatttccagaccgtgtttgatcagcctcaggaatacttcatggagttgacattcaatcaagctgcaaagggggtcaacaaggagttcaccgtgaacatcatggacacgtgtgagcgctgcaacggcaaggggaacgagcccggcaccaaggtgcagcattgccactactgtggcggctccggcatggaaaccatcaacacaggcccttttgtgatgcgttccacgtgtaggagatgtggtggccgcggctccatcatcatatcgccctgtgtggtctgcaggggagcaggacaagccaagcagaaaaagcgagtgatgatccctgtgcctgcaggagtcgaggatggccagaccgtgaggatgcctgtgggaaaaagggaaattttcattacgttcagggtgcagaaaagccctgtgttccggagggacggcgcagacatccactccgacctctttatttctatagctcaggctcttcttgggggtacagccagagcccagggcctgtacgagacgatcaacgtgacgatcccccctgggactcagacagaccagaagattcggatgggtgggaaaggcatcccccggattaacagctacggctacggagaccactacatccacatcaagatacgagttccaaagaggctaacgagccggcagcagagcctgatcctgagctacgccgaggacgagacagatgtggaggggacggtgaacggcgtcaccctcaccagctctggtggcagcaccatggatagctccgcaggaagcaaggctaggcgtgaggctggggaggacgaggagggattcctttccaaacttaagaaaatgtttacctcatgatatcccagccgaggaaaaagatccactggaaactaggccgggaagcagcagcccctccaagggccagggcacctgggagacgggaggattccagaacagcagcactgagctcccacccgcagagcctctggacggccttggcaacagcaaaatcatgggacaacacctctctccacggaaaggtcacagtggacagcccgggcagtaggatgcagccccagaggctggtggcagtttcctgtccattggtaggtgacggcccctggctcaggcagagggagatggttagactcttgcagggctaaaactctaatttggaattgaatattgtggatatcttagttaaaggccatgcttacagcttagaaatgaagccttaagctgcatcaagttacgaagtgattaatttccttctcagcaaacctccgggaggttccagaatgagttcttcctgacaggttgtcttcactgggagcgtggggcccccaggccccaccagcaccgtcctcccctaatgaggggccctgccgaggcatcagctgctctgctcagttagtttttattcccggggtaccaagcagctgcacagtcggtgcctgggaggcacgtagaggcccagagagtccctgggggttctgctctgaccgtgtgggtggtgatccttgtcaggatgtacagtccttgctcccaccccatccgggatggccgcctgtccctgactattgagtcctgttgttgtaagccaggcatggagggctcctgcccttctgctgagccacagcccattgcagcactgtgctggccagacttcagctgccttgggaactgaagccctgccactgttgctagtcaggggcttggttctcccacttacactgttgacatctattttctgaagtgtgtttaaattattcagtgctaatcattgttttttcctttgtaaatgttgattcagaaaaggaaagcacaggctaagcagttgaaggttccccaccattcagtgagagcagaacccccattccccagcctctgctggtagcatgtcgcagtttccatgtgtttcaggatcttcgggctgtcgttagacaggttaatgaagaacacttctcaacagtttcctttttgttttcctttataattcactaaaataaagcatctattagtgtctgatttaggaatgtaaaatgattctgtattaatgtaaataagattatctattgcaaaaagatatttcaaacctaaa

SEQ ID NO: 8643 - DNA, 2591 bp, Homo sapiens
gcaggcgcagagtccccgggccaagatggctgcgcggtgctccacacgctggttgctggtggttgtggggaccccgcggctgccggctatatcgggtagaggggcccggccgcccagggagggcgtggtgggggcatggctgagccgcaagctgagcgtccccgcctttgcgtcttccctgacctcttgcggcccccgagcgctgctgacattgagacctggtgtcagccttacaggaacaaaacataaccctttcatttgtactgcctccttccacacgagtgcccctttggccaaagaagattattatcagatattaggagtgcctcgaaatgccagccagaaagagatcaagaaagcctattatcagcttgccaagaagtatcaccctgacacaaataaggatgatcccaaagccaaggagaagttctcccagctggcagaagcctatgaggttttgagtgatgaggtgaagaggaagcagtacgatgcctacggctctgcaggcttcgatcctggggccagcggctcccagcatagctactggaagggaggccccactgtggaccccgaggagctgttcaggaagatctttggcgagttctcatcctcttcatttggagatttccagaccgtgtttgatcagcctcaggaatacttcatggagttgacattcaatcaagctgcaaagggggtcaacaaggagttcaccgtgaacatcatggacacgtgtgagcgctgcaacggcaaggggaacgagcccggcaccaaggtgcagcattgccactactgtggcggctccggcatggaaaccatcaacacaggcccttttgtgatgcgttccacgtgtaggagatgtggtggccgcggctccatcatcatatcgccctgtgtggtctgcaggggagcaggacaagccaagcagaaaaagcgagtgatgatccctgtgcctgcaggagtcgaggatggccagaccgtgaggatgcctgtgggaaaaagggaaattttcattacgttcagggtgcagaaaagccctgtgttccggagggacggcgcagacatccactccgacctctttatttctatagctcaggctcttcttgggggtacagccagagcccagggcctgtacgagacgatcaacgtgacgatcccccctgggactcagacagaccagaagattcggatgggtgggaaaggcatcccccggattaacagctacggctacggagaccactacatccacatcaagatacgagttccaaagaggctaacgagccggcagcagagcctgatcctgagctacgccgaggacgagacagatgtggaggggacggtgaacggcgtcaccctcaccagctctggaaaaagatccactggaaactaggccgggaagcagcagcccctccaagggccagggcacctgggagacgggaggattccagaacagcagcactgagctcccacccgcagagcctctggacggccttggcaacagcaaaatcatgggacaacacctctctccacggaaaggtcacagtggacagcccgggcagtaggatgcagccccagaggctggtggcagtttcctgtccattggtaggtgacggcccctggctcaggcagagggagatggttagactcttgcagggctaaaactctaatttggaattgaatattgtggatatcttagttaaaggccatgcttacagcttagaaatgaagccttaagctgcatcaagttacgaagtgattaatttccttctcagcaaacctccgggaggttccagaatgagttcttcctgacaggttgtcttcactgggagcgtggggcccccaggccccaccagcaccgtcctcccctaatgaggggccctgccgaggcatcagctgctctgctcagttagtttttattcccggggtaccaagcagctgcacagtcggtgcctgggaggcacgtagaggcccagagagtccctgggggttctgctctgaccgtgtgggtggtgatccttgtcaggatgtacagtccttgctcccaccccatccgggatggccgcctgtccctgactattgagtcctgttgttgtaagccaggcatggagggctcctgcccttctgctgagccacagcccattgcagcactgtgctggccagacttcagctgccttgggaactgaagccctgccactgttgctagtcaggggcttggttctcccacttacactgttgacatctattttctgaagtgtgtttaaattattcagtgctaatcattgttttttcctttgtaaatgttgattcagaaaaggaaagcacaggctaagcagttgaaggttccccaccattcagtgagagcagaacccccattccccagcctctgctggtagcatgtcgcagtttccatgtgtttcaggatcttcgggctgtcgttagacaggttaatgaagaacacttctcaacagtttcctttttgttttcctttataattcactaaaataaagcatctattagtgtctgatttaggaatgtaaaatgattctgtattaatgtaaataagattatctattgcaaaaagatatttcaaacct

SEQ ID NO: 8644 - DNA, 1413 bp, Homo sapiens
agagtccccgggccaagatggctgcgcggtgctccacacgctggttgctggtggttgtggggaccccgcggctgccggctatatcgggtagaggggcccggccgcccagggagggcgtggtgggggcatggctgagccgcaagctgagcgtccccgcctttgcgtcttccctgacctcttgcggcccccgagcgctgctgacattgagacctggtgtcagccttacaggaagatctttggcgagttctcatcctcttcatttggagatttccagaccgtgtttgatcagcctcaggaatacttcatggagttgacattcaatcaagctgcaaagggggtcaacaaggagttcaccgtgaacatcatggacacgtgtgagcgctgcaacggcaaggggaacgagcccggcaccaaggtgcagcattgccactactgtggcggctccggcatggaaaccatcaacacaggcccttttgtgatgcgttccacgtgtaggagatgtggtggccgcggctccatcatcatatcgccctgtgtggtctgcaggggagcaggacaagccaagcagaaaaagcgagtgatgatccctgtgcctgcaggagtcgaggatggccagaccgtgaggatgcctgtgggaaaaagggaaattttcattacgttcagggtgcagaaaagccctgtgttccggagggacggcgcagacatccactccgacctctttatttctatagctcaggctcttcttgggggtacagccagagcccagggcctgtacgagacgatcaacgtgacgatcccccctgggactcagacagaccagaagattcggatgggtgggaaaggcatcccccggattaacagctacggctacggagaccactacatccacatcaagatacgagttccaaagaggctaacgagccggcagcagagcctgatcctgagctacgccgaggacgagacagatgtggaggggacggtgaacggcgtcaccctcaccagctctggaaaaagatccactggaaactaggccgggaagcagcagcccctccaagggccagggcacctgggagacgggaggattccagaacagcagcactgagctcccacccgcagagcctctggacggccttggcaacagcaaaatcatgggacaacacctctctccacggaaaggtcacagtggacagcccgggcagtaggatgcagccccagaggctggtggcagtttcctgtccattggtaggtgacggcccctggctcaggcagagggagatggttagactcttgcagggctaaaactctaatttggaattgaatattgtggatatcttagttaaaggccatgcttacagcttagaaatgaagccttaagctgcatcaagttacgaagtgattaatttccttctcagc

SEQ ID NO: 8645 - DNA, 2233 bp, Homo sapiens
gggacggcgacagcgggtcggcgggccgcaggagggggtcatgggtaaagactactaccagacgttgggcctggcccgcggcgcgtcggacgaggagatcaagcgggcctaccgccgccaggcgctgcgctaccacccggacaagaacaaggagcccggcgccgaggagaagttcaaggagatcgctgaggcctacgacgtgctcagcgacccgcgcaagcgcgagatcttcgaccgctacggggaggaaggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtaccaagaagatgaaaatctcccacaagcggctaaaccccgacggaaagagcattcgaaacgaagacaaaatattgaccatcgaagtgaagaaggggtggaaagaaggaaccaaaatcactttccccaaggaaggagaccagacctccaacaacattccagctgatatcgtctttgttttaaaggacaagccccacaatatctttaagagagatggctctgatgtcatttatcctgccaggatcagcctccgggaggctctgtgtggctgcacagtgaacgtccccactctggacggcaggacgatacccgtcgtattcaaagatgttatcaggcctggcatgcggcgaaaagttcctggagaaggcctccccctccccaaaacacccgagaaacgtggggacctcattattgagtttgaagtgatcttccccgaaaggattccccagacatcaagaaccgtacttgagcaggttcttccaatatagctatctgagctccccaaggactgaccagggacctttccagagctcaaggatttctggacctttctaccagttgtggaccatgagagggtgggagggcccagggagggctttcgtactgctgaatgttttccagagcatatattacaatctttcaaagtcgcacactagacttcagtggtttttcgagctatagggcatcaggtggtgggaacagcaggaaaaggcattccagtctgccccactgggtctggcagccctcccgggatgggcccacatccacctccagtccctggccaggggtgagaggcagaccagcagatggacttgatccctctgtgtctttttgcttctggctggtagataatgtcaacctgcagtcttgattcccagaccctgtacactcctccttttctgttgtgtgatcagtttgtgctttattctgtatttgtctcccatgtcttgctcttctcctggagaattctgtcttctctttggccatctcaaattgagaacctaaactattcctgcagaactgcctggttggcgtccacaagcaatacctctcgttccagcaggaccaagggagccagcctccagtgagtgactccagcaagtgcagccacctctcccttgatggtctgggagcctggcctcagcaaggggccttcctgacctctggctccagtgaagctgaatgtcctcactttgtgggtcacactctttacatttctgtaaggcaatcttggcacacgtggggcttaccagtggcccaggtaattttttgtttcatggactatggactctttcaaagggatctgatccttttgaattttgcacagccctagatacaatcccttttgataaaagggtctttgcttctgattacaggagcactgtggaacgtctgtaaatatgtttttataattccatgtatagttggtgtacactcaaaacctgtccccggcagccagtgctctctgtatagggccataatggaattctgaagaaatcttggggagggaaggggagttggaacaaatgtctgttccctggaggccagtccagtgctcagacctttagactcattgtaagttgccactgccaacatgagaccaaagtgtgtgactagtcaatgaagtgcgacagcattaaagactgatgctaaacctc

SEQ ID NO: 8646 - DNA, 1216 bp, Homo sapiens
aggcggcgccgaaggggtaaattctgagatcctgcccctgagctttcatgagctgttgaaccatctggaattcacaggcctgtcatgagagacacgatgagaagtccttaaaggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtaccaagaagatgaaaatctcccacaagcggctaaaccccgacggaaagagcattcgaaacgaagacaaaatattgaccatcgaagtgaagaaggggtggaaagaaggaaccaaaatcactttccccaaggaaggagaccagacctccaacaacattccagctgatatcgtctttgttttaaaggacaagccccacaatatctttaagagagatggctctgatgtcatttatcctgccaggatcagcctccgggaggctctgtgtggctgcacagtgaacgtccccactctggacggcaggacgatacccgtcgtattcaaagatgttatcaggcctggcatgcggcgaaaagttcctggagaaggcctccccctccccaaaacacccgagaaacgtggggacctcattattgagtttgaagtgatcttccccgaaaggattccccagacatcaagaaccgtacttgagcaggttcttccaatatagctatctgagctccccaaggactgaccagggacctttccagagctcaaggatttctggacctttctaccagttgtggaccatgagagggtgggagggcccagggagggctttcgtactgctgaatgttttccagagcatatattacaatctttcaaagtcgcacactagacttcagtggtttttcgagctatagggcatcaggtggtgggaacagcaggaaaaggcattccagtctgccccactgggtctggcagccctcccgggatgggcccacatccacctccagtccct

SEQ ID NO: 8647 - DNA, 4360 bp, Homo sapiens
gttggcgcatactcaactctaagacctccggaacatggaatctgggcgtgcaccattattgacacctacaccagccgtccctttcttagaagacatacggtagcacttccaccctcgctcaaaactcgggaaaggaggggcggagggtggatgtcatcactccgcgcccggctgcccgcgacgcgccggcgggtggcgcagcccttcgctcgcccggcctccccctccctggttccgcgttctggttccgccatggaatccaacaaggatgaagctgagcgctgtatcagcatcgccctcaaggccatccagagcaaccagcccgaccgggcgctccgcttcctggagaaggcacagcggctgtatccgacgccgcgagttcgcgccctgattgagtccctcaaccagaaaccacagactgccggtgaccaacccccacccacagacacaacccatgccacccacaggaaagcaggtgggaccgatgccccctcggccaacggtgaagctggaggagagagcaccaaaggctacactgcagaacaggttgcagctgtgaaaagggtcaagcaatgtaaagattactatgagatcctgggggtgagcagaggggcctcggatgaggacctgaagaaggcctaccgcagactggccctcaaattccacccagacaagaaccacgcacctggtgccactgaagccttcaaagccattggcacagcatatgcggtactcagcaacccggagaagaggaagcagtatgaccagttcggcgatgacaagagccaggcggcccggcacggccatgggcatggggatttccaccgtggctttgaggccgacatctcccctgaagacctcttcaacatgttctttggcggcggcttcccttctagtaacgtccacgtctacagcaacggccgcatgcgctatacctaccagcaaaggcaggaccgcagggacaaccagggtgatggcgggctaggggtgtttgtgcagctgatgcctatcctcatcctgattctcgtgtcagctctcagccagctcatggtctccagtccaccctacagtctgagtccaagaccgtccgtgggccacatccacaggcgagtcactgaccacctgggtgtcgtctactatgtgggagacactttctccgaagagtacacaggctccagcctcaaaacagtcgagcggaatgtggaagatgattatatcgccaacctccggaacaactgctggaaggagaagcagcagaaggaaggcttgctgtaccgggcacgctactttggcgacacagatatgtaccacagagcacagaagatgggcacccccagctgcagccgactgtcagaggtgcaggcctccctgcatggatagtcctgggccagccacaccaccgaggtccaagtatgagccagggctgcctccaccctgcaactcctggcagctttggccctggtcatgagcagaggagggagggggagaaagggaggaagcctggtgattgtggcaaagactcctgtccccagcctgacctccagcctccagagaccgagcagctgtggggcctgctgggaaaccaaggtcggtttccgccctctagcgatgctgtcctccccactcctccgctctgctccctggctccaggggtgtgggggaccccagaaccaggcagagtgggaacttgaaactgttgctgagggccacccggggcttcttggtccactccagccatcagtcagcacggccctttctccagcacagcagactattgtccgtgccctggtatttaggccatcacatatggtggggcccaagagagccccatatgcacactgcctgcctgataccaggaagaaccatgtgggaataggtgggccaagagccctcccctttctccatccctccagctaggaggaaatggagcaagatgaacaggcagccacgaggtgggtgggagctggcagtcttggtggcggcaggggccgcgggccctgaccacccccctctggtgggatctgaggcactctctcgaatgccgtcacacctggcagcctggaagccacaggcatccggccttgcccaggcatctcgcctgcggtctgaggaagggaacagaaggtcatgagttcagggtcagacgcagccgctcagcacaggaggggtggaggggaaatgagagttgctggtagcaggctccctccttctgcagcccggcgaatgggggcgctgggctctgttcccagcgtttgccagaggtggccacttcagccaagcccagagaagtgtgggcagaagcagtgaaggttcttctctgtgtgggtgccctgcccaccccctcctttgcctgtgtcctcccggcctggatccatggctgactctgcctggaggccatttgtgcctgcctctgtgctgccgcaggagggcaggccgcaagtggggttggtgggggtcgagcgggcagcacggtgcagcggtgcagtggcaaggggggctacttgtgtggcataagctagaggagccggtgccgcctgaatgccgagctaactgttgccactctcctccccagactatgaaatccctggagaatttttggtgacatgcactgagccaaggtgatggactgtatatttgaggaaagacaaacaaagaaacaaaattaaaatggaattggaggccgaacgctgcacagctgccctctctctcacccagtaaatgcagaaagctcttaggacagacagaaaacctgccatggggctgcttccctccctcgcagggctggcggaggctccgcatcgcctctctcctaggatacagaaaccatggcaacgaaagtagaatgtaaaactcgcagcagatatcagtgggaagggctgggggagggggcacccagctgcctttcctccctcacaggagccaccaccagccacctctcaggagaagccagaggccctggccaaagataggaggaagaaagagaactctccatagaatgtaatttatagatgcgtgtatatgtatatatatctatttatatgtaaataggcatatatgaagatatatatatatatagtctactttttaaactctgcagggatttggttaagttgttgagctgatttcttccatgttttagaaaatgaggcctgtttggggaaggtaccctggtgatgtttttgctagacattagctgtagctgacagcataaggagagtcgcatcagagcttttcacagccccccgaaaccccagcctggttttgatggcagcagtaatcatgatagtgtgaacccgcgaaggcctcaggattatggttaacctggagaggagcaggccatggaggcaggtgccaggtcagtattgagtcacagtagaggccccacaaggacctgcttgggtgagaccacctctcccctctcagcagcgctggtgggctctttgtcctggtgcccaggagccctccagccccctgcccacagaagggaaggcctgcagagggggccaggatctacctaaccatttccccacccctaagtccctcagtgggctttgccttataggtgccacagggcacagctccatcattgccactggtttttcctaagtcatgcaccaaggacttcagaaagttcttcctccgagtcagtcagtggtgccgggaccccagggcagcctcctcgactcctgaagaaaaggcagtgcccgtggctgcctctgtcttcactcgctgttgatgtgaccgccaggcctcctctcgtaccttggacaaaggatacacctgaaccagaatagttttcttaccctcacattgaaatgaggattttgcttaaaacagcacttgccgccagtgggaggagggaggttttatttattcccacagtttctcctgggccttctggaatgaccatgttttcctgtggcggtgggtgtgtcattgcgcccgccgtcttccaaagccttacttccccaagctgccagccaggaggtgataaccaccctcccagagtttctctcggctctttttttaaaagtcccccaacaaataggattcttgctgggaaaggaagttcggtaaggaaatgtcaaatctggtttttaaacaaggtccaaccctgcaatgaagcagccacttcagcccagagagattataagaactgatgtggccagagtgcctacccactgtggccccggtgctctgcccccacgccccgaccatctggtcttggtagatgtccctagacgggctgagccatgtgcaataagaacatagatcctaaaggatcctctggaagctgtatttcttgaattagaattctcaaattgtacatctgttaatatatgtttattatgtgactggc

SEQ ID NO: 8648 - DNA, 3198 bp, Homo sapiens
gttggcgcatactcaactctaagacctccggaacatggaatctgggcgtgcaccattattgacacctacaccagccgtccctttcttagaagacatacggtagcacttccaccctcgctcaaaactcgggaaaggaggggcggagggtggatgtcatcactccgcgcccggctgcccgcgacgcgccggcgggtggcgcagcccttcgctcgcccggcctccccctccctggttccgcgttctggttccgccatggaatccaacaaggatgaagctgagcgctgtatcagcatcgccctcaaggccatccagagcaaccagcccgaccgggcgctccgcttcctggagaaggcacagcggctgtatccgacgccgcgagttcgcgccctgattgagtccctcaaccagaaaccacagactgccggtgaccaacccccacccacagacacaacccatgccacccacaggaaagcaggtgggaccgatgccccctcggccaacggtgaagctggaggagagagcaccaaaggctacactgcagaacaggttgcagctgtgaaaagggtcaagcaatgtaaagattactatgagatcctgggggtgagcagaggggcctcggatgaggacctgaagaaggcctaccgcagactggccctcaaattccacccagacaagaaccacgcacctggtgccactgaagccttcaaagccattggcacagcatatgcggtactcagcaacccggagaagaggaagcagtatgaccagttcggcgatgacaagagccaggcggcccggcacggccatgggcatggggatttccaccgtggctttgaggccgacatctcccctgaagacctcttcaacatgttctttggcggcggcttcccttctagtaacgtccacgtctacagcaacggccgcatgcgctatacctaccagcaaaggcaggaccgcagggacaaccagggtgatggcgggctaggggtgtttgtgcagctgatgcctatcctcatcctgattctcgtgtcagctctcagccagctcatggtctccagtccaccctacagtctgagtccaagaccgtccgtgggccacatccacaggcgagtcactgaccacctgggtgtcgtctactatgtgggagacactttctccgaagagtacacaggctccagcctcaaaacagtcgagcggaatgtggaagatgattatatcgccaacctccggaacaactgctggaaggagaagcagcagaaggaaggcttgctgtaccgggcacgctactttggcgacacagatatgtaccacagagcacagaagatgggcacccccagctgcagccgactgtcagaggtgcaggcctccctgcatggatagtcctgggccagccacaccaccgaggtccaaactatgaaatccctggagaatttttggtgacatgcactgagccaaggtgatggactgtatatttgaggaaagacaaacaaagaaacaaaattaaaatggaattggaggccgaacgctgcacagctgccctctctctcacccagtaaatgcagaaagctcttaggacagacagaaaacctgccatggggctgcttccctccctcgcagggctggcggaggctccgcatcgcctctctcctaggatacagaaaccatggcaacgaaagtagaatgtaaaactcgcagcagatatcagtgggaagggctgggggagggggcacccagctgcctttcctccctcacaggagccaccaccagccacctctcaggagaagccagaggccctggccaaagataggaggaagaaagagaactctccatagaatgtaatttatagatgcgtgtatatgtatatatatctatttatatgtaaataggcatatatgaagatatatatatatatagtctactttttaaactctgcagggatttggttaagttgttgagctgatttcttccatgttttagaaaatgaggcctgtttggggaaggtaccctggtgatgtttttgctagacattagctgtagctgacagcataaggagagtcgcatcagagcttttcacagccccccgaaaccccagcctggttttgatggcagcagtaatcatgatagtgtgaacccgcgaaggcctcaggattatggttaacctggagaggagcaggccatggaggcaggtgccaggtcagtattgagtcacagtagaggccccacaaggacctgcttgggtgagaccacctctcccctctcagcagcgctggtgggctctttgtcctggtgcccaggagccctccagccccctgcccacagaagggaaggcctgcagagggggccaggatctacctaaccatttccccacccctaagtccctcagtgggctttgccttataggtgccacagggcacagctccatcattgccactggtttttcctaagtcatgcaccaaggacttcagaaagttcttcctccgagtcagtcagtggtgccgggaccccagggcagcctcctcgactcctgaagaaaaggcagtgcccgtggctgcctctgtcttcactcgctgttgatgtgaccgccaggcctcctctcgtaccttggacaaaggatacacctgaaccagaatagttttcttaccctcacattgaaatgaggattttgcttaaaacagcacttgccgccagtgggaggagggaggttttatttattcccacagtttctcctgggccttctggaatgaccatgttttcctgtggcggtgggtgtgtcattgcgcccgccgtcttccaaagccttacttccccaagctgccagccaggaggtgataaccaccctcccagagtttctctcggctctttttttaaaagtcccccaacaaataggattcttgctgggaaaggaagttcggtaaggaaatgtcaaatctggtttttaaacaaggtccaaccctgcaatgaagcagccacttcagcccagagagattataagaactgatgtggccagagtgcctacccactgtggccccggtgctctgcccccacgccccgaccatctggtcttggtagatgtccctagacgggctgagccatgtgcaataagaacatagatcctaaaggatcctctggaagctgtatttcttgaattagaattctcaaattgtacatctgttaatatatgtttattatgtgactggc

SEQ ID NO: 8649 - DNA, 3278 bp, Homo sapiens
actccgaaggccccagtctcatcccgacggctaccacgtgaccttcctgagcttgggtttcctcctccggaagattagagggttggcgcatactcaactctaagacctccggaacatggaatctgggcgtgcaccattattgacacctacaccagccgtccctttcttagaagacatacggtagcacttccaccctcgctcaaaactcgggaaaggaggggcggagggtggatgtcatcactccgcgcccggctgcccgcgacgcgccggcgggtggcgcagcccttcgctcgcccggcctccccctccctggttccgcgttctggttccgccatggaatccaacaaggatgaagctgagcgctgtatcagcatcgccctcaaggccatccagagcaaccagcccgaccgggcgctccgcttcctggagaaggcacagcggctgtatccgacgccgcgagttcgcgccctgattgagtccctcaaccagaaaccacagactgccggtgaccaacccccacccacagacacaacccatgccacccacaggaaagcaggtgggaccgatgccccctcggccaacggtgaagctggaggagagagcaccaaaggctacactgcagaacaggttgcagctgtgaaaagggtcaagcaatgtaaagattactatgagatcctgggggtgagcagaggggcctcggatgaggacctgaagaaggcctaccgcagactggccctcaaattccacccagacaagaaccacgcacctggtgccactgaagccttcaaagccattggcacagcatatgcggtactcagcaacccggagaagaggaagcagtatgaccagttcggcgatgacaagagccaggcggcccggcacggccatgggcatggggatttccaccgtggctttgaggccgacatctcccctgaagacctcttcaacatgttctttggcggcggcttcccttctagtaacgtccacgtctacagcaacggccgcatgcgctatacctaccagcaaaggcaggaccgcagggacaaccagggtgatggcgggctaggggtgtttgtgcagctgatgcctatcctcatcctgattctcgtgtcagctctcagccagctcatggtctccagtccaccctacagtctgagtccaagaccgtccgtgggccacatccacaggcgagtcactgaccacctgggtgtcgtctactatgtgggagacactttctccgaagagtacacaggctccagcctcaaaacagtcgagcggaatgtggaagatgattatatcgccaacctccggaacaactgctggaaggagaagcagcagaaggaaggcttgctgtaccgggcacgctactttggcgacacagatatgtaccacagagcacagaagatgggcacccccagctgcagccgactgtcagaggtgcaggcctccctgcatggatagtcctgggccagccacaccaccgaggtccaaactatgaaatccctggagaatttttggtgacatgcactgagccaaggtgatggactgtatatttgaggaaagacaaacaaagaaacaaaattaaaatggaattggaggccgaacgctgcacagctgccctctctctcacccagtaaatgcagaaagctcttaggacagacagaaaacctgccatggggctgcttccctccctcgcagggctggcggaggctccgcatcgcctctctcctaggatacagaaaccatggcaacgaaagtagaatgtaaaactcgcagcagatatcagtgggaagggctgggggagggggcacccagctgcctttcctccctcacaggagccaccaccagccacctctcaggagaagccagaggccctggccaaagataggaggaagaaagagaactctccatagaatgtaatttatagatgcgtgtatatgtatatatatctatttatatgtaaataggcatatatgaagatatatatatatatagtctactttttaaactctgcagggatttggttaagttgttgagctgatttcttccatgttttagaaaatgaggcctgtttggggaaggtaccctggtgatgtttttgctagacattagctgtagctgacagcataaggagagtcgcatcagagcttttcacagccccccgaaaccccagcctggttttgatggcagcagtaatcatgatagtgtgaacccgcgaaggcctcaggattatggttaacctggagaggagcaggccatggaggcaggtgccaggtcagtattgagtcacagtagaggccccacaaggacctgcttgggtgagaccacctctcccctctcagcagcgctggtgggctctttgtcctggtgcccaggagccctccagccccctgcccacagaagggaaggcctgcagagggggccaggatctacctaaccatttccccacccctaagtccctcagtgggctttgccttataggtgccacagggcacagctccatcattgccactggtttttcctaagtcatgcaccaaggacttcagaaagttcttcctccgagtcagtcagtggtgccgggaccccagggcagcctcctcgactcctgaagaaaaggcagtgcccgtggctgcctctgtcttcactcgctgttgatgtgaccgccaggcctcctctcgtaccttggacaaaggatacacctgaaccagaatagttttcttaccctcacattgaaatgaggattttgcttaaaacagcacttgccgccagtgggaggagggaggttttatttattcccacagtttctcctgggccttctggaatgaccatgttttcctgtggcggtgggtgtgtcattgcgcccgccgtcttccaaagccttacttccccaagctgccagccaggaggtgataaccaccctcccagagtttctctcggctctttttttaaaagtcccccaacaaataggattcttgctgggaaaggaagttcggtaaggaaatgtcaaatctggtttttaaacaaggtccaaccctgcaatgaagcagccacttcagcccagagagattataagaactgatgtggccagagtgcctacccactgtggccccggtgctctgcccccacgccccgaccatctggtcttggtagatgtccctagacgggctgagccatgtgcaataagaacatagatcctaaaggatcctctggaagctgtatttcttgaattagaattctcaaattgtacatctgttaatatatgtttattatgtgactgg

SEQ ID NO: 8650 - DNA, 3176 bp, Homo sapiens
gtgtgcccaaaatagccggctccgccctcttctcccggcagcccctgcaggcccccacccccccaggggacaggcggagccggccttctccccgtctctagtagtttccgcaccgctgacgcatgcctgcgcgcacagctgggccgggcgcgtcctacgcagcagccgcgagccgggctgcgggtgccagacggttcccggcggggggcaggggcggggcgccgcaggaggccgggactcctggcggaggagccccaaggaggcccgcctgacgactgaccagttgccatggcatcctactacgagatcctagacgtgccgcgaagtgcgtccgctgatgacatcaagaaggcgtatcggcgcaaggctctccagtggcacccagacaaaaacccagataataaagagtttgctgagaagaaatttaaggaggtggccgaggcatatgaagtgctgtctgacaagcacaagcgggagatttacgaccgctatggccgggaagggctgacagggacaggaactggcccatctcgggcagaagctggcagtggtgggcctggcttcaccttcaccttccgcagccccgaggaggtcttccgggaattctttgggagtggagacccttttgcagagctctttgatgacctgggccccttctcagagcttcagaaccggggttcccgacactcaggccccttctttaccttctcttcctccttccctgggcactccgatttctcctcctcatctttctccttcagtcctggggctggtgcttttcgctctgtttctacatctaccacctttgtccaaggacgccgcatcaccacacgcagaatcatggagaacgggcaggagcgggtggaagtggaggaggatgggcagctgaagtcagtcacaatcaatggtgtcccagatgacctggcactgggcttggagctgagccgtcgcgagcagcagccgtcagtcacttccaggtctgggggcactcaggtccagcagacccctgcctcatgccccttggacagcgacctctctgaggatgaggacctgcagctggccatggcctacagcctgtcagagatggaggcagctgggaagaaacccgcaggtgggcgggaggcacagcaccgacggcaggggcggcccaaggcccagcaccaagatccaggcttgggggggacccaggagggtgcgaggggtgaagcaaccaaacgcagtccatccccagaggagaaggcctctcgctgcctcatcctctgaacaccgggcccaacctgatctgatccagatcttgactggggggtctgactcactgtgggaagagaagaggggagtatcctgagttgtaggaactgctttccaactccaagctccctccacaagtttccctcccaggccccccacaccccagtgtggacttgggatttgctgtgctcagcccagggctgataggtccctggtgaagcccagggtggggggtgtcagggcagtggaggggcccgaggagccaggttgcatttattggatggggagctccaaggggcattagtggtttgggctgggccttttgtgccctggtactctgccacctgtgttgctgatggtgtcaaggaaggaggacttggcctagggttgtctgagccggagccggcagctccactggagagcagtgcaggcagagtggagcctcctgctctcctggaccagctgcagacccccaaccctggtttctgtgccatgttgcgctctgaccgtctctgttgcttctcttctggtgttgcttctcctccctcccattctctctgcaactccctgcgggccgcatcgcttgctttcactgccgtctggctaggactcccttcttccttccttccccgagaaggcctcaatgtggcgaggaagatgctggggccggtagggctgtgagatcttctggggaggctagccgggtggggcgggagcctctcagctgtccagattcagaactggagcccactcctcctccctctcgttgcctcagcctgccctcaccctcaggactaggcagaggtgaggctggctcaccctgaagaggtgggataggaccgggggaccccagagggaggcctaggaggggactgcacccatactgcttccctaccacaaatcagggctcagggagaggccatgcggccagcccaggtctgcatgctgagccccatcctccacagcttgccgctgacgctctctcctgtcaccccgcccctgctctctccccagatgtgttctgagctggatgccgggttccagaatcgctgcacagttccaacaggacagcgccttcccccatgcgctgggaggggaccctccatttctccccctcacccatgctgagtgtagagccggggcctgggtggcgggtgggggccgggtgggaggtggcagtagtcttagcctgtgcactctcttccttgggtgtttggtgctggctcctggggactacaaatcccagagtgcggtgtgcccggcctcatttctgatagatcccgcttgggggaggtggtgtatggttacggagctgtgcatcttgggacatgtagtagcccaggtcggcttgtcactcgctgtgagatggggagattttgtcttttgatttatccctgtagggctggcagggttgtagatgaagggggaatgatctgagccttggttcccctgacacgtcttgctagccccagggttagagtgggcagggcagagccgcgcagcacctgggagcggtacctttcccttgggcagcctggggtcccaggaacaagccagggcgagtggcatgtctgcctgagcagggtgtggccccagaaagctgaggagtgtgggctggcagagagcttcgagggcaaggccacccgcgggggcgtgtgtgtggtggggcttggcatgtgatggcagctccaggcatgccgctgcttgtatggctttctttggcctctgaccctgctgcccattctttccaacatcacagatgaactgcctctcctcctccctgcctggggagcccagtggccagggaggggagtggtggagccagtcgctgtaacactgagcctcagagacgaaccaaaaccagctgggctgagctcagatccagggggaaatgctggaagtcaataaaactgagttttgagagcttg

SEQ ID NO: 8651 - DNA, 1946 bp, Homo sapiens
agccggccttctccccgtctctagtagtttccgcaccgctgacgcatgcctgcgcgcacagctgggccgggcgcgtcctacgcagcagccgcgagccgggctgcgggtgccagacggttcccggcggggggcaggggcggggcgccgcaggaggccgggactcctggcggaggagccccaaggaggcccgcctgacgactgaccagttgccatggcatcctactacgagatcctagacgtgccgcgaagtgcgtccgctgatgacatcaagaaggcgtatcggcgcaaggctctccagtggcacccagacaaaaacccagataataaagagtttgctgagaagaaatttaaggaggtggccgaggcatatgaagtgctgtctgacaagcacaagcgggagatttacgaccgctatggccgggaagggctgacagggacaggaactggcccatctcgggcagaagctggcagtggtgggcctggcttcaccttcaccttccgcagccccgaggaggtcttccgggaattctttgggagtggagacccttttgcagagctctttgatgacctgggccccttctcagagcttcagaaccggggttcccgacactcaggccccttctttaccttctcttcctccttccctgggcactccgatttctcctcctcatctttctccttcagtcctggggctggtgcttttcgctctgtttctacatctaccacctttgtccaaggacgccgcatcaccacacgcagaatcatggagaacgggcaggagcgggtggaagtggaggaggatgggcagctgaagtcagtcacaatcaatggtgtcccagatgacctggcactgggcttggagctgagccgtcgcgagcagcagccgtcagtcacttccaggtctgggggcactcaggtccagcagacccctgcctcatgccccttggacagcgacctctctgaggatgaggacctgcagctggccatggcctacagcctgtcagagatggaggcagctgggaagaaacccgcagatgtgttctgagctggatgccgggttccagaatcgctgcacagttccaacaggacagcgccttcccccatgcgctgggaggggaccctccatttctccccctcacccatgctgagtgtagagccggggcctgggtggcgggtgggggccgggtgggaggtggcagtagtcttagcctgtgcactctcttccttgggtgtttggtgctggctcctggggactacaaatcccagagtgcggtgtgcccggcctcatttctgatagatcccgcttgggggaggtggtgtatggttacggagctgtgcatcttgggacatgtagtagcccaggtcggcttgtcactcgctgtgagatggggagattttgtcttttgatttatccctgtagggctggcagggttgtagatgaagggggaatgatctgagccttggttcccctgacacgtcttgctagccccagggttagagtgggcagggcagagccgcgcagcacctgggagcggtacctttcccttgggcagcctggggtcccaggaacaagccagggcgagtggcatgtctgcctgagcagggtgtggccccagaaagctgaggagtgtgggctggcagagagcttcgagggcaaggccacccgcgggggcgtgtgtgtggtggggcttggcatgtgatggcagctccaggcatgccgctgcttgtatggctttctttggcctctgaccctgctgcccattctttccaacatcacagatgaactgcctctcctcctccctgcctggggagcccagtggccagggaggggagtggtggagccagtcgctgtaacactgagcctcagagacgaaccaaaaccagctgggctgagctcagatccagggggaaatgctggaagtcaataaaactgagttttgagagct

SEQ ID NO: 8652 - DNA, 828 bp, Homo sapiens
ggagccggccttctccccgtctctagtagtttccgcaccgctgacgcatgcctgcgcgcacagctgggccgggcgcgtcctacgcagcagccgcgagccgggctgcggccccaaggaggcccgcctgacgactgaccagttgccatggcatcctactacgagatcctagacgtgccgcgaagtgcgtccgctgatgacatcaagaaggcgtatcggcgcaaggctctccagtggcacccagacaaaaacccagataataaagagtttgctgagaagaaatttaaggaggtggccgaggcatatgaagtgctgtctgacaagcacaagcgggagatttacgaccgctatggccgggaagggctgacagggacaggaactggcccatctcgggcagaagctggcagtggtgggcctggcttcaccttcaccttccgcagccccgaggaggtcttccgggaattctttgggagtggagacccttttgcagagctctttgatgacctgggccccttctcagagcttcagaaccggggttcccgacactcaggccccttctttaccttctcttcctccttccctgggcactccgatttctcctcctcatctttctccttcagtcctggggctggtgcttttcgctctgtttctacatctaccacctttgtccaaggacgccgcatcaccacacgcagaatcatggagaacgggcaggagcgggtggaagtggaggaggatgggcagctgaagtcagtcacaatcaatggtgtcccagatgacctggcactgggcttggagctgagccgtcgcgagcagcagccgtcagtcact

SEQ ID NO: 8653 - DNA, 652 bp, Homo sapiens
aggtgcggccgggggcccgggtcaggctgggggccctggatcggactgctggagttggggggccccgatagggctcctgggcctgggcgtcgagatagctcttggccccggcctgcgggggcagataaggctgccggagggagcctagtcaccggccgcaagcagagcccgccccaaggaggcccgcctgacgactgaccagttgccatggcatcctactacgagatcctagacgtgccgcgaagtgcgtccgctgatgacatcaagaaggcgtatcggcgcaaggctctccagtggcacccagacaaaaacccagataataaagagtttgctgagaagaaatttaaggaggtggccgaggcatatgaagtgctgtctgacaagcacaagcgggagatttacgaccgctatggccgggaagggctgacagggacaggaactggcccatctcgggcagaagctggcagtggtgggcctggcttcaccttcaccttccgcagccccgaggaggtcttccgggaattctttgggagtggagacccttttgcagagctctttgatgacctgggccccttctcagagcttcagaaccggggttcccgacactcaggccccttctttaccttctcttcctccttccctgggcactccg

SEQ ID NO: 8654 - DNA, 686 bp, Homo sapiens
gaggtgcggccgggggcccgggtcaggctgggggccctggatcggactgctggagttggggggccccgatagggctcctgggcctgggcgtcgagatagctcttggccccggcctgcgggggcagataaggctgccggagggagcctagtcaccggccgcaagcagagcccggtgtgctccgcttccaactgggagcgccttccgccacccggggagggggactgctgcagccacagggtggggctcttggttctttccgcctgactccttctcttctgcagccccaaggaggcccgcctgacgactgaccagttgccatggcatcctactacgagatcctagacgtgccgcgaagtgcgtccgctgatgacatcaagaaggcgtatcggcgcaaggctctccagtggcacccagacaaaaacccagataataaagagtttgctgagaagaaatttaaggaggtggccgaggcatatgaagtgctgtctgacaagcacaagcgggagatttacgaccgctatggccgggaagggctgacagggacaggaactggcccatctcgggcagaagctggcagtggtgggcctggcttcaccttcaccttccgcagccccgaggaggtcttccgggaattctttgggagtggagacccttttgcagagctctttgatgacctgggcccctt

SEQ ID NO: 8655 - DNA, 2527 bp, Homo sapiens
agttgacgccgccgtgccgccgccgcgtgacgcatttcctgtttgttgttggagaaaggagagaaaggaaagcgcgaggagccgccgccaccaccagcgcagcagtcctggagctgtgaggagattcgggccgtcaccctgcctcccctgcgtcccgccaccggccgcttctgtcctcggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttgaagacccttttgaggacttctttgggaatcgaaggggtccccgaggaagcagaagccgagggacggggtcgtttttctctgcgttcagtggatttccgtcttttggaagtggattttcttcttttgatacaggatttacttcatttgggtcactaggtcacgggggcctcacttcattctcttccacgtcatttggtggtagtggcatgggcaacttcaaatcgatatcaacttcaactaaaatggttaatggcagaaaaatcactacaaagagaattgtcgagaacggtcaagaaagagtagaagttgaagaagatggccagttaaagtccttaacaataaatggtgtggccgacgacgatgccctcgctgaggagcgcatgcggagaggccagaacgccctgccagcccagcctgccggcctccgcccgccgaagccgccccggcctgcctcgctgctgagacacgcgcctcactgtctctctgaggaggagggcgagcaggaccgacctcgggcacccgggccctgggaccccctcgcgtccgcagcaggattgaaagaaggtggcaagaggaagaagcagaagcagagagaggagtcgaagaagaagaagtcgaccaaaggcaatcactagaccggacttgaggcacgcggtgcacccccagacgctggcgctccaccgtgctcggcatgcggtcgtgcacacgcgctaggtagcagcgtcggtcaggactgtctcgaggccacactcgctcggcaggattatgcgatcacggatcagtcagagcagggtcaggagacggggctgacggcacgggtggcggggacagacgtttgggacttggccgcgactctctgcttctctccagctctcaatctgctgcattttcctctagtgcttccggatcctcttcattcttttcggctactcaaccactccgcatgctgctggaatatttctggctttagaagtacaggagggcgcagatggctaactgagtaacattcatgaaatgaggctttctgtggcggcgtagtgtttggaattagaaggtaattcagtagagtgtaacttagagaatattgcaagtgacacattgaatcctgcccgtcagggcaccttttcctcagagcaatccggccacacgaatagaaggctgtcgtgaatcacatcagatgtaaaatcattccttctgtttactcttttaattttcatcctttgcaggtagtgcaaattcaacttcaaatatggtgtaggttttgctagattccatatttttttcttggatttttgctaattatttttagcaaaaaatttttgctcagtggcactctccctagtgtccatgggttagggccatgctggggaaaacgggccggtatttacacacgcgcaaaacacccagagacggcacaaggaggttgaactcatgtttcagttcgcgaacattgactccttacgaaagtcacttcattctaactagatgcgcccacttccggtcattatttcgtttgcatgatgtattgcttcttcacgttttgtttttattgagcacggagtagaattccagggctgccttgacttcttccctgcatgctccctcccagtgactttccttccctttcacatgaggatctgccgttcatgttgctttctcctttgtcctcttggacttgagggcattgtgaaaagctttgctgtgatttaaaaatgccagcaattttaatctagcagtgttgaagctgggaattttttggcgcaatccatgtagcagtgacccaggcttgggagccagaaacaagtgtgacctgggattttatttaacacaactgttgccaaagagttggctttgtttatttggttttggcggggagaggagtggtatttgatgctttctgtggacaatgtaaccctaaacacatcatgtattttaaatgccacctacataaataaaacataagcatattgaataca

SEQ ID NO: 8656 - DNA, 506 bp, Homo sapiens
tttttctaaggctcccgcactcgcgtctgaaaccagaaacgggagtggcttgcggagcaggaatgccgcagccgtgccgccaagttcggagggagaagaagcaggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttgaagacccttttgaggacttctttgggaatc

SEQ ID NO: 8657 - DNA, 852 bp, Homo sapiens
gttgttggagaaaggagagaaaggaaagcgcgaggagccgccgccaccaccagcgcagcagtcctggagctgtgaggagattcgggccgtcaccctgcctcccctgcgtcccgccaccggccgcttctgtcctcggtgagggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttgaagacccttttgaggacttctttgggaatcgaaggggtccccgaggaagcagaagccgagggacggggtcgtttttctctgcgttcagtggatttccgtcttttggaagtggattttcttcttttgatacaggatttacttcatttgggtcactaggtcacgggggcctcacttcattctcttccacgtcatttggtggtagtggcatgggcaacttcaaatcgatatcaacttcaactaaaatggttaatggcagaaaaatcactacaaagagaattgtcgagaacggtcaagaaagagtagaagttgaagaagatggccagttaaagtccttaacaa

SEQ ID NO: 8658 - DNA, 972 bp, Homo sapiens
ccaccaccagcgcagcagtcctggagctgacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttgaagacccttttgaggacttctttgggaatcgaaggggtccccgaggaagcagaagccgagggacggggtcgtttttctctgcgttcagtggatttccgtcttttggaagtggattttcttcttttgatacaggatttacttcatttgggtcactaggtcacgggggcctcacttcattctcttccacgtcatttggtggtagtggcatgggcaacttcaaatcgatatcaacttcaactaaatggttaatggcagaaaaatcactacaaagagaattgtcgagaacggtcaagaaagagtagaagttgaagaagatggccagttaaagtccttaacaataaatggtaaggagcagctgctgcgcttggataacaagtaattcaacgcacgcacttaacagaaatgttaaactataacaagcaccatttgaggattaacaggaacatttttttgaagatttcaaacgaactcgactttcagtataattgtacctaaagtatttataaacagctcatcggagcctctatttgtcatagacttttgagttgattgttgggaccacataataggac

SEQ ID NO: 8659 - DNA, 1609 bp, Homo sapiens
agttgacgccgccgtgccgccgccgcgtgacgcatttcctgtttgttgttggagaaaggagagaaaggaaagcgcgaggagccgccgccaccaccagcgcagcagtcctggagctgtgaggagattcgggccgtcaccctgcctcccctgcgtcccgccaccggccgcttctgtcctcggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttgaagacccttttgaggacttctttgggaatcgaaggggtccccgaggaagcagaagccgagggacggggtcgtttttctctgcgttcagtggatttccgtcttttggaagtggattttcttcttttgatacaggatttacttcatttgggtcactaggtcacgggggcctcacttcattctcttccacgtcatttggtggtagtggcatgggcaacttcaaatcgatatcaacttcaactaaaatggttaatggcagaaaaatcactacaaagagaattgtcgagaacggtcaagaaagagtagaagttgaagaagatggccagttaaagtccttaacaataaatggtaaggagcagctgctgcgcttggataacaagtaattcaacgcacgcacttaacagaaatgttaaactataacaagcaccatttgaggattaacaggaacatttttttgaagatttcaaacgaactcgactttcagtataattgtacctaaagtatttataaacagctcatcggagcctctatttgtcatagacttttgagttgattgttgggaccacataataggaccattttttttttgtctttaaaattgttgtaaatctctgtatgcactttgcttttttattaaacgtactccaaggtgagtcttgactctttagtgtaggacaagattgtacactaacaccagcatggacctgcttttcattgtgtctgaaatgtgagccacgtagtgtcggcctgctgtgaagttaacattgccaggacgattcttctacagaaataatttcaatttttttcagtatttagtagtgaaagatattaatacattaatggtaatacatttctggtttaatataaattaaggatgttttctagttgtgcatgaatgctggcaacttagtaagttttgacaattgtttaaatatgtaatgttaagcttaggtttaaaaaagtaaagctggtaaactgggtctttgtcatttgctttaaaaaaaaaaaaaaagaaaataaatgcgaatgtgttggtgcattcttcctgagtgggatctgga

SEQ ID NO: 8660 - DNA, 566 bp, Homo sapiens
accaccagcgcagcagtcctggagctgtgaggagattcgggccgtcaccctgcctcccctgcgtcccgccaccggccgcttctgtcctcgaaacgggagtggcttgcggagcaggaatgccgcagccgtgccgccaagttcggagggagaagaagcaggtgggggaccgcaaagccctgtttctagaactccggacggattgttcagaagtttgtggaagagcaggctgcctttctcactcagaatgtttgtctgctttgctttgcgttaaagaatctgcaccgtagttgatgcaactgaagtttatataagaagtttacattaactcttacctaaggaaggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgaca

SEQ ID NO: 8661 - DNA, 398 bp, Homo sapiens
ttcactatgttgttcaggctggtctcgaactcctgacctcaggtgatccacccgcctcggcttcgcaaagtgctggattacaggtgtgagcccgcgcgtccggctgtcactttaaagagtattataagagggcacttcataacttgggcaggtatttttagtcatcctgaacgtgtcgctgtggactgggtgtcaccgcgggaccgcacagacaccttactgtcgtctgctgtaaaggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaa

SEQ ID NO: 8662 - DNA, 1022 bp, Homo sapiens
atactaatgtggtaatcagtgaactatttgcttccgtttccttcagtcactattccctggcgaagtctccacgcgctcccgttcgccggggaacttagggtatccgggcttccctaaattgacaagcgggggccggcgccttcgcccgccttcgctggccgccgcttggtttgttcttcttctccttcggggacttctccgcccgcgcccgcgcccgcgccccagctttcgtcccgctgtgcggagatgccacccagctccaccgcaggaccgcggagcgagaggcggcagacgcgctccgggggccgccggtcaagaggaagatgaagggcgcgacgacttcgcggtttccagaatgggctccttctggcccaacaataagtgccatttggaatcttctcggccttctctgtgccttccgcgcgtctgggctccccggagagaaaggaaagcgcgaggagccgccgccaccaccagcgcagcagtcctggagctgtgaggagattcgggccgtcaccctgcctcccctgcgtcccgccaccggccgcttctgtcctcggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttgaagacccttttgaggacttctttgggaatcgaaggggtccccgaggaagcagaagccgagggacggggtcgtttttctctgcgttcagtgg

SEQ ID NO: 8663 - DNA, 1159 bp, Homo sapiens
agagaaaggaaagcgcgaggagccgccgccaccaccagcgcagcagtcctggagctgtgaggagattcgggccgtcaccctgcctcccctgcgtcccgccaccggccgcttctgtcctcggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttggtgtggccgacgacgatgccctcgctgaggagcgcatgcggagaggccagaacgccctgccagcccagcctgccggcctccgcccgccgaagccgccccggcctgcctcgctgctgagacacgcgcctcactgtctctctgaggaggagggcgagcaggaccgacctcgggcacccgggccctgggaccccctcgcgtccgcagcaggattgaaagaaggtggcaagaggaagaagcagaagcagagagaggagtcgaagaagaagaagtcgaccaaaggcaatcactagaccggacttgaggcacgcggtgcacccccagacgctggcgctccaccgtgctcggcatgcggtcgtgcacacgcgctaggtagcagcgtcggtcaggactgtctcgaggccacactcgctcggcaggattatgcgatcacggatcagtcagagcagggtcaggagacggggctgacggcacgggtggcggggacagacgtttgggacttggccgcgactctctgcttctctccagctctcaatctgctgcattttcctctagtgcttccggatcctcttcattcttttcggctactcaaccactccgcatgctgctggaatatttctggctttagaagtacaggagggcgcagatggctaactgagtaacattcatg

SEQ ID NO: 8664 - DNA, 2180 bp, Homo sapiens
ggagaaaggagagaaaggaaagcgcgaggagccgccgccaccaccagcgcagcagtcctggagctgtgaggagattcgggccgtcaccctgcctcccctgcgtcccgccaccggccgcttctgtcctcggacccattccaacaatctcgtaaaacatggtggattactatgaagttctaggcgtgcagagacatgcctcacccgaggatattaaaaaggcctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttgaagacccttttgaggacttctttgggaatcgaaggggtccccgaggaagcagaagccgagggacggggtcgtttttctctgcgttcagtggatttccgtcttttggaagtggattttcttcttttgatacaggatttacttcatttgggtcactaggtcacgggggcctcacttcattctcttccacgtcatttggtggtagtggcatgggcaacttcaaatcgatatcaacttcaactaaaatggttaatggcagaaaaatcactacaaagagaattgtcgagaacggtcaagaaagagtagaagttgaagaagatggccagttaaagtccttaacaataaatggtgtggccgacgacgatgccctcgctgaggagcgcatgcggagaggccagaacgccctgccagcccagcctgccggcctccgcccgccgaagccgccccggcctgcctcgctgctgagacacgcgcctcactgtctctctgaggaggagggcgagcaggaccgacctcgggcacccgggccctgggaccccctcgcgtccgcagcaggattgaaagaaggtggcaagaggaagaagcagaagcagagagaggagtcgaagaagaagaagtcgaccaaaggcaatcactagaccggacttgaggcacgcggtgcacccccagacgctggcgctccaccgtgctcggcatgcggtcgtgcacacgcgctaggtagcagcgtcggtcaggactgtctcgaggccacactcgctcggcaggattatgcgatcacggatcagtcagagcagggtcaggagacggggctgacggcacgggtggcggggacagacgtttgggacttggccgcgactctctgcttctctccagctctcaatctgctgcattttcctctagtgcttccggatcctcttcattcttttcggctactcaaccactccgcatgctgctggaatatttctggctttagaagtacaggagggcgcagatggctaactgagtaacattcatgaaatgaggctttctgtggcggcgtagtgtttggaattagaaggtaattcagtagagtgtaacttagagaatattgcaagtgacacattgaatcctgcccgtcagggcaccttttcctcagagcaatccggccacacgaatagaaggctgtcgtgaatcacatcagatgtaaaatcattccttctgtttactcttttaattttcatcctttgcaggtagtgcaaattcaacttcaaatatggtgtaggttttgctagattccatatttttttcttggatttttgctaattatttttagcaaaaaatttttgctcagtggcactctccctagtgtccatgggttagggccatgctggggaaaacgggccggtatttacacacgcgcaaaacacccagagacggcacaaggaggttgaactcatgtttcagttcgcgaacattgactccttacgaaagtcacttcattctaactagatgcgcccacttccggtcattatttcgtttgcatgatgtattgcttcttcacgttttgtttttattgagcacggagtagaattccagggctgccttgacttcttccctgcatgctccctcccagtgactttccttccctttcacatgaggatctgccgttcatgttgctttctcctttgtcctcttggacttgagggcattgtgaaaagctttgctgtgatttaaaaatgccagcaattttaatctagcagtgttgaagctgggaattttttggcgcaatccatgtagcagtgacccaggcttg

SEQ ID NO: 8665 - DNA, 590 bp, Homo sapiens
actcgcgtctgaaaccagaaacgggagtggcttgcggagcaggaatgccgcagccgtgccgccaagttcggagggagaagaagcaggtgggggaccgcaaagccctgtttctagaactccggacggattgttcagaagtttgtggaagagcaggctgcctttctcactcagaatgtttgtctgctttgctttgcgttaaagaatctgcaccgtagttgatgcaactgaagtttatataagaagtttacattaactcttacctaaggaaggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatg

SEQ ID NO: 8666 - DNA, 2715 bp, Homo sapiens
atgactcgggtgaggcccctggagaccggggccggcgacggatgcagggcggccctcctcactgaggatgcgccacaggtccaggcctctcgagcccctgcgcctgcgctagcattctgccgggaaagccgcctcgtctgtcgactcacttccgcctcctccggtttaagcaccgccttttcgggggttgaagccggaagtggcgcacagccctagcagcaacaacagttttccacgtgcgcgtagggcgccgggatcacgtggggaggcagaagccaatggggaagcgtttcgtgtaggtcttctgaggtggtggcgccagcggctacctcctgcctgtgaggagctggctgagaggggactgggcgccggcggggaaggaggagcgctaggtcggtgtacgaccgagattagggtgcgtgccagctccgggaggccgcggtgaggggccgggcccaagctgccgacccgagccgatcgtcagggtcgccagcgcctcagctctgtggaggagcagcagtagtcggagggtgcaggatattagaaatggctactccccagtcaattttcatctttgcaatctgcattttaatgataacagaattaattctggcctcaaaaagctactatgatatcttaggtgtgccaaaatcggcatcagagcgccaaatcaagaaggcctttcacaagttggccatgaagtaccaccctgacaaaaataagagcccggatgctgaagcaaaattcagagagattgcagaagcatatgaaacactctcagatgctaatagacgaaaagagtatgatacacttggacacagtgcttttactagtggtaaaggacaaagaggtagtggaagttcttttgagcagtcatttaacttcaattttgatgacttatttaaagactttggcttttttggtcaaaaccaaaacactggatccaagaagcgttttgaaaatcatttccagacacgccaggatggtggttccagtagacaaaggcatcatttccaagaattttcttttggaggtggattatttgatgacatgtttgaagatatggagaaaatgttttcttttagtggttttgactctaccaatcagcatacagtacagactgaaaatagatttcatggatctagcaagcactgcaggactgtcactcaacgaagaggaaatatggttactacatacactgactgttcaggacagtagttcttattctattctcactaaatccaactggttgactcttcctcattatctttgatgctaaacaattttctgtgaactattttgacaagtgcatgatttcactttaaacaatttgatatagctattaaatatatttaagggttttttttttttgacaaattcaacattcaacgagtagacaaaatgctaattatttccctgattaggaaagtttctttaaaaaacacgtaattttgcctagtgctttttctctacctgcccttgggctcactaatatcaccagtattattaccaagaaaatattgagtttacctgattaaactttaaaagttaattgtagatttaaattgtgtgaacctaatgatttttgcagtgaaacctttactaattcaaagttgcatgttctatgacatctgtgacttgcgttgcagagtgtacatgaaactgtataattgagtcattcagtaaaggagaacagtatcttggttaattgctactgaaaggttgagaaaggaatggtttgatatttaccacagcgctgtgcctttctacagtagaactggggtaaaggaaatggttttattgcccatagtcatttaggctggaaaaaagttgaaaacttaacgaaatattgccaagagattgttatgtgtttggttccagcctaaaaatgattttgtagtgttgaaatcatagctacttacatagctttttcatatttctttcttagttgttggcactcttaggtcttagtatggatttatgtgtttgtgtgtgtgtagtttatcctctctctcatctttatctagagattgactgatacctcattctgtttgtaaaaccagccagtaatttctgtgcaaccttactatgtgcaatatttttaaatcctgagaaatgtgtgcttttgttttcggatagacttatttctttagttctgcacttttccacattatactccatatgagtattaatcctatggatacatattaaaacaagtgtctcatacaacattgtatgtgagagaaatataaatatttacaacctgatattcgttgttgttttattgttaaaagtttattatgcaactctggaggtatagagggcatataagctatgggacatatgctgatcacaggctatattcatgaagttacttttgaccaacctgaaaactgataggattttgtttgtcatttggtaatttctactgcattcttaccatccttctctcacaaattttgatagcttgaagatctttttaattataattttgttgtatttgtttcctaggagcaagtgttcctgctgccagttctttcctctttaggcgtggttgagaaaaagcagaaactttacataaagctgtatttcttaatcatctttaatttgaaacttaagaaaatgaatttattctgttatatttatgtaacttatttcctggaagttatatctactagttttgtttgataataataaaattagctataccttgaa

SEQ ID NO: 8667 - DNA, 5272 bp, Homo sapiens
agaccggcgcgtgaggaacctaccggtaccggccgcgcgctggtagtcgccggtgtggctgcacctcaccaatcccgtgcgccgcggctgggccgtcggagagtgcgtgtgcttctctcctgcacgcggtgcttgggctcggccaggcggggtccgccgccagggtttgaggatgggggagtagctacaggaagcgaccccgcgatggcaaggtatatttttgtggaatgaaaaggaagtattagaaatgagctgaagaccattcacagattaatatttttggggacagatttgtgatgcttgattcacccttgaagtaatgtagacagaagttctcaaatttgcatattacatcaactggaaccagcagtgaatcttaatgttcacttaaatcagaacttgcataagaaagagaatgggagtctggttaaataaagatgactatatcagagacttgaaaaggatcattctctgttttctgatagtgtatatggccattttagtgggcacagatcaggatttttacagtttacttggagtgtccaaaactgcaagcagtagagaaataagacaagctttcaagaaattggcattgaagttacatcctgataaaaacccgaataacccaaatgcacatggcgattttttaaaaataaatagagcatatgaagtactcaaagatgaagatctacggaaaaagtatgacaaatatggagaaaagggacttgaggataatcaaggtggccagtatgaaagctggaactattatcgttatgattttggtatttatgatgatgatcctgaaatcataacattggaaagaagagaatttgatgctgctgttaattctggagaactgtggtttgtaaatttttactccccaggctgttcacactgccatgatttagctcccacatggagagactttgctaaagaagtggatgggttacttcgaattggagctgttaactgtggtgatgatagaatgctttgccgaatgaaaggagtcaacagctatcccagcctcttcatttttcggtctggaatggccccagtgaaatatcatggagacagatcaaaggagagtttagtgagttttgcaatgcagcatgttagaagtacagtgacagaactttggacaggaaattttgtcaactccatacaaactgcttttgctgctggtattggctggctgatcactttttgttcaaaaggaggagattgtttgacttcacagacacgactcaggcttagtggcatgttggatggtcttgttaatgtaggatggatggactgtgccacccaggataacctttgtaaaagcttagatattacaacaagtactactgcttattttcctcctggagccactttaaataacaaagagaaaaacagtattttgtttctcaactcattggatgctaaagaaatatatttggaagtaatacataatcttccagattttgaactactttcggcaaacacactagaggatcgtttggctcatcatcggtggctgttattttttcattttggaaaaaatgaaaattcaaatgatcctgagctgaaaaaactaaaaactctacttaaaaatgatcatattcaagttggcaggtttgactgttcctctgcaccagacatctgtagtaatctgtatgtttttcagccgtctctagcagtatttaaaggacaaggaaccaaagaatatgaaattcatcatggaaagaagattctatatgatatacttgcctttgccaaagaaagtgtgaattctcatgttaccacgcttggacctcaaaattttcctgccaatgacaaagaaccatggcttgttgatttctttgccccctggtgtccaccatgtcgagctttactaccagagttacgaagagcatcaaatcttctttatggtcagcttaagtttggtacactagattgtacagttcatgagggactctgtaacatgtataacattcaggcttatccaacaacagtggtattcaaccagtccaacattcatgagtatgaaggacatcactctgctgaacaaatcttggagttcatagaggatcttatgaatccttcagtggtctcccttacacccaccaccttcaacgaactagttacacaaagaaaacacaacgaagtctggatggttgatttctattctccgtggtgtcatccttgccaagtcttaatgccagaatggaaaagaatggcccggacattaactggactgatcaacgtgggcagtatagattgccaacagtatcattctttttgtgcccaggaaaacgttcaaagataccctgagataagattttttcccccaaaatcaaataaagcttatcattatcacagttacaatggttggaatagggatgcttattccctgagaatctggggtctaggatttttacctcaagtatccacagatctaacacctcagactttcagtgaaaaagttctacaagggaaaaatcattgggtgattgatttctatgctccttggtgtggaccttgccagaattttgctccagaatttgagctcttggctaggatgattaaaggaaaagtgaaagctggaaaagtagactgtcaggcttatgctcagacatgccagaaagctgggatcagggcctatccaactgttaaattttatttctacgaaagagcaaagagaaattttcaagaagagcagataaataccagagatgcaaaagcaatcgctgccttaataagtgaaaaattggaaactctccgaaatcaaggcaagaggaataaggatgaactttgataatgttgaagatgaagaaaaagtttaaaagaaattctgacagatgacatcagaagacacctatttagaatgttacatttatgatgggaatgaatgaacattatcttagacttgcagttgtactgccagaattatctacagcactggtgtaaaagaagggtctgcaaactttttctgtaaagggccggtttataaatattttagactttgcaggctataatatatggttcacacatgagaacaagaatagagtcatcatgtattctttgttatttgcttttaacaacctttaaaaaatattaaaacgattcttagctcagagccatacaaaagtaggctggattcagtccatggaccatagattgctgtccccctcgacggacttataatgtttcaggtggctggcttgaacatgagtctgctgtgctatctacataaatgtctaagttgtataaagtccactttcccttcacgttttttggctgacctgaaaagaggtaacttagtttttggtcacttgttctcctaaaaatgctatccctaaccatatatttatatttcgttttaaaaacacccatgatgtggcacagtaaacaaaccctgttatgctgtattattatgaggagattcttcattgttttctttccttctcaaaggttgaaaaaatgcttttaatttttcacagccgagaaacagtgcagcagtatatgtgcacacagtaagtacacaaatttgagcaacagtaagtgcacaaattctgtagtttgccgtatcatccaggaaaacctgagggaaaaaaattatagcaattaactgggcattgtagagtatcctaaatatgttatcaagtatttagagttctatattttaaagatatatgtgttcatgtattttctgaaattgctttcatagaaattttcccactgatagttgatttttgaggcatctaatatttacatatttgccttctgaactttgttttgacctgtatcctttatttacattgggtttttctttcgtagttttggtttttcactcctgtccagtctatttattattcaaataggaaaaattactttacaggttgttttactgtagcttataatgatactgtagttattccagttactagtttactgtcagagggctgcctttttcagataaatattgacataataactgaagttatttttataagaaaatcaagtatataaatctaggaaagggatcttctagtttctgtgttgtttagactcaaagaatcacaaatttgtcagtaacatgtagttgtttagttataattcagagtgtacagaatggtaaaaattccaatcagtcaaaagaggtcaatgaattaaaaggcttgcaactttttcaaaaacctgttagaatatgctttattgtgttttgaggagttttcctttttttcttttcaatatcactttatcctgctcaccagtatttcctcataagggttattatagccataattaatgttaaaatagactttgttcttcatattctcccatctttttcgctactatatactctgtctggattctgctgtatgcctgttggcatatatggaacagtcaccacttgtcacacttaacaccagctttttgaattatgatcagtaatggcaagagcctttcattctcgaatgtttaaagcctaggagttctacaaaattggcttctttctacaagaatcccaaaatggaatgcctaaagaagtcttacttgggtaaatacttactaaaatatactggttatgtgcatatcaccacactggacactgaggagtgttcaaaaggaatctaagacatggtccccatcttccaactgtctgtaattcactgttttgtcattgagctcataaggtacttacattactacctataaatgtttcctgtacttgttagttgttgagaaacattttaggcagtaaataaaatagtaaatattatgtgtcctataatttgacctaagctgtgtgcctttggaatcagctctaagccagggccccctgggagtcatgttaagaaacacgtatcataaagtgacatacatcaaggttatcttatatagtcataacagtattattgggtctttcaaaaacagctggcagattgagcttttaatggctatattgatacagtagatagagcacctctaaggagtaccaggtataatgtgccatttctctcagcaacaccatttttgtgtgcagctgaccctctaacatggtatcaattctagctgaccaaagcacattctatcaggcagccaggcttggaaattaggtccatttaaagtatgtggcttacagtcaggtatggtggtgtgcgcctattgtcccatctacttgagaggctgaggcaggagggattgcttgggctcaggattttgaatccagcctgggcaacatagcaagaccccatctctaataaataaattatgttttgggcattaa

SEQ ID NO: 8668 - DNA, 2644 bp, Homo sapiens
gaggaacctaccggtaccggccgcgcgctggtagtcgccggtgtggctgcacctcaccaatcccgtgcgccgcggctgggccgtcggagagtgcgtgtgcttctctcctgcacgcggtgcttgggctcggccaggcggggtccgccgccagggtttgaggatgggggagtagctacaggaagcgaccccgcgatggcaaggtatatttttgtggaatgaaaaggaagtattagaaatgagctgaagaccattcacagattaatatttttggggacagatttgtgatgcttgattcacccttgaagtaatgtagacagaagttctcaaatttgcatattacatcaactggaaccagcagtgaatcttaatgttcacttaaatcagaacttgcataagaaagagaatgggagtctggttaaataaagatgactatatcagagacttgaaaaggatcattctctgttttctgatagtgtatatggccattttagtgggcacagatcaggatttttacagtttacttggagtgtccaaaactgcaagcagtagagaaataagacaagctttcaagaaattggcattgaagttacatcctgataaaaacccgaataacccaaatgcacatggcgattttttaaaaataaatagagcatatgaagtactcaaagatgaagatctacggaaaaagtatgacaaatatggagaaaagggacttgaggataatcaaggtggccagtatgaaagctggaactattatcgttatgattttggtatttatgatgatgatcctgaaatcataacattggaaagaagagaatttgatgctgctgttaattctggagaactgtggtttgtaaatttttactccccaggctgttcacactgccatgatttagctcccacatggagagactttgctaaagaagtggatgggttacttcgaattggagctgttaactgtggtgatgatagaatgctttgccgaatgaaaggagtcaacagctatcccagcctcttcatttttcggtctggaatggccccagtgaaatatcatggagacagatcaaaggagagtttagtgagttttgcaatgcagcatgttagaagtacagtgacagaactttggacaggaaattttgtcaactccatacaaactgcttttgctgctggtattggctggctgatcactttttgttcaaaaggaggagattgtttgacttcacagacacgactcaggcttagtggcatgttgtttctcaactcattggatgctaaagaaatatatttggaagtaatacataatcttccagattttgaactactttcggcaaacacactagaggatcgtttggctcatcatcggtggctgttattttttcattttggaaaaaatgaaaattcaaatgatcctgagctgaaaaaactaaaaactctacttaaaaatgatcatattcaagttggcaggtttgactgttcctctgcaccagacatctgtagtaatctgtatgtttttcagccgtctctagcagtatttaaaggacaaggaaccaaagaatatgaaattcatcatggaaagaagattctatatgatatacttgcctttgccaaagaaagtgtgaattctcatgttaccacgcttggacctcaaaattttcctgccaatgacaaagaaccatggcttgttgatttctttgccccctggtgtccaccatgtcgagctttactaccagagttacgaagagcatcaaatcttctttatggtcagcttaagtttggtacactagattgtacagttcatgagggactctgtaacatgtataacattcaggcttatccaacaacagtggtattcaaccagtccaacattcatgagtatgaaggacatcactctgctgaacaaatcttggagttcatagaggatcttatgaatccttcagtggtctcccttacacccaccaccttcaacgaactagttacacaaagaaaacacaacgaagtctggatggttgatttctattctccgtggtgtcatccttgccaagtcttaatgccagaatggaaaagaatggcccggacattaactggactgatcaacgtgggcagtatagattgccaacagtatcattctttttgtgcccaggaaaacgttcaaagataccctgagataagattttttcccccaaaatcaaataaagcttatcattatcacagttacaatggttggaatagggatgcttattccctgagaatctggggtctaggatttttacctcaagtatccacagatctaacacctcagactttcagtgaaaaagttctacaagggaaaaatcattgggtgattgatttctatgctccttggtgtggaccttgccagaattttgctccagaatttgagctcttggctaggatgattaaaggaaaagtgaaagctggaaaagtagactgtcaggcttatgctcagacatgccagaaagctgggatcagggcctatccaactgttaaattttatttctacgaaagagcaaagagaaattttcaagaagagcagataaataccagagatgcaaaagcaatcgctgccttaataagtgaaaaattggaaactctccgaaatcaaggcaagaggaataaggatcactta

SEQ ID NO: 8669 - DNA, 934 bp, Homo sapiens
gaggaacctaccggtaccggccgcgcgctggtagtcgccggtgtggctgcacctcaccaatcccgtgcgccgcggctgggccgtcggagagtgcgtgtgcttctctcctgcacgcggtgcttgggctcggccaggcggggtccgccgccagggtttgaggatgggggagtagctacaggaagcgaccccgcgatggcaaggtatatttttgtggaatgaaaaggaagtattagaaatgagctgaagaccattcacagattaatatttttggggacagatttgtgatgcttgattcacccttgaagtaatgtagacagaagttctcaaatttgcatattacatcaactggaaccagcagtgaatcttaatgttcacttaaatcagaacttgcataagaaagagaatgggagtctggttaaataaagatgactatatcagagacttgaaaaggatcattctctgttttctgatagtgtatatggccattttagtgggcacagatcaggatttttacagtttacttggagtgtccaaaactgcaagcagtagagaaataagacaagctttcaagaaattggcattgaagttacatcctgataaaaacccgaataacccaaatgcacatggcgattttttaaaaataaatagagcatatgaagtactcaaagatgaagatctacggaaaaagtatgacaaatatggagaaaagggacttgaggataatcaaggtggccagtatgaaagctggaactattatcgttatgattttggtatttatgatgatgatcctgaaatcataacattggaaagaagagaatttgatgctgctgttaattctggagaactgtggtttgtaaatttttactccccaggctgttcacactgccatgatttagctcccacatggagagactttgctaaagaaagcttaagg

SEQ ID NO: 8670 - DNA, 1669 bp, Homo sapiens
gaacttgcataagaaagagaatgggagtctggttaaataaagatgactatatcagagacttgaaaaggatcattctctgttttctgatagtgtatatggccattttagtgggcacagatcaggatttttacagtttacttggagtgtccaaaactgcaagcagtagagaaataagacaagctttcaagaaattggcattgaagttacatcctgataaaaacccgaataacccaaatgcacatggcgattttttaaaaataaatagagcatatgaagtactcaaagatgaagatctacggaaaaagtatgacaaatatggagaaaagggacttgaggataatcaaggtggccagtatgaaagctggaactattatcgttatgattttggtatttatgatgatgatcctgaaatcataacattggaaagaagagaatttgatgctgctgttaattctggagaactgtggtttgtaaatttttactccccaggctgttcacactgccatgatttagctcccacatggagagactttgctaaagaagtggatgggttacttcgaattggagctgttaactgtggtgatgatagaatgctttgccgaatgaaaggagtcaacagctatcccagcctcttcatttttcggtctggaatggccccagtgaaatatcatggagacagatcaaaggagagtttagtgagttttgcaatgcagcatgttagaagtacagtgacagaactttggacaggaaattttgtcaactccatacaaactgcttttgctgctggtattggctggctgatcactttttgttcaaaaggaggagattgtttgacttcacagacacgactcaggcttagtggcatgttggatggtcttgttaatgtaggatggatggactgtgccacccaggataacctttgtaaaagcttagatattacaacaagtactactgcttattttcctcctggagccactttaaataacaaagagaaaaacagtattttgctgcttcattgagagaatcagaccagcagagagagagagttatatgacaaaatatgctgaggataaaatattgacaaataaagaagatttgttagaagggccttttatactcgtttgtgttttaaataagagactcgggccgaaaacaagtttaagataagatctgtatcattgtattttactctaaaaactcctaagtggtttggtttttagatgaaaacctctataatgagcaaaagtccattccaattttccacttctaagttcctcttaattaatcttaattattggttggggaatgaagtgtctttgatagtctattattcttccttctagtgttataaaaattcttaagtgaatgtgtaaaacattggcattctgtaaaacatgattagcattaaaattaagctaaagataatgtggtttttcttgatgattgggaggtcactcaggatttttctgagcatttttatagaatacacatcatagttaattaaaaattccagttaatgcaacatcttataatggaatttattgtatatcactatttaagaaacagcttagttatataatatttttgataattgccaaaatacactttttttgaaaaaagacatttggaattgtttgaaaaactatttaccttctataatcattttcct

SEQ ID NO: 8671 - DNA, 7730 bp, Homo sapiens
gcgaagatggcggcctccagagtgaaactctgagaggcagagggaggaggcggagggggcggggaggcagcgccgcggcggcaccaggaacccgcggcagcggagctgcagggccccggcgggggaaaggggaagtggtgagggtgaggaggccggagggcgcctcatcccactctggaagctgagccggcggcgggaggagctagggctggagcctctccagcctcccgcgaaggtttgagcacaaaatgaacataattagggaaaataaggatctggcatgtttctacacaacaaaacattcatggagggggaagtataagcgtgtcttttcagttggaactcatgcgattactacatataatcccaataccttagaagtaacaaatcagtggccttatggagacatttgcagcatcagccctgttggaaaaggacaaggaacggagttcaacctcacatttcgtaaaggcagtggaaaaaagtcagaaactttaaaattttctacagagcacagaacagaacttcttacagaagcattgagatttagaactgatttttcagagggaaaaatcacaggaaggagatacaactgctataagcatcactggagtgactcaagaaaacctgtaattttggaagtaactccaggaggctttgaccaaattaatcctgcaaccaacagagtactctgttcctatgactatagaaatattgaaggatttgtagatctctcagattatcaaggaggattttgtatactttatggaggatttagtagattgcatttatttgcgtcagagcaaagagaagagattattaaaagtgcaatagaccatgctggtaactacataggtatttcattgcggatcaggaaagagcctttagaattcgagcaatatttgaatcttcgctttggaaaatacagcactgatgaatccatcacatctttagcagagtttgtagtccaaaaaatatcacctagacattcggagcctgttaaaagagttctagcacttacagaaacatgtttagtagaacgtgatccggcaacctataatattgcaacattgaagcctttaggagaagtatttgcgttggtctgtgactcagaaaatccacaactttttaccattgaatttataaaagggcaagtacggaaatattcttcaacagagagagattccttattagcaagtttgctggatggagtaagagcctctggtaatagagatgtttgtgtaaaaatgacaccaacccataaaggtcagcgatgggggttactcagcatgcctgttgatgaggaagtagagagccttcacctcaggttcttagctacgcctccaaatggcaactttgcagatgctgtattcaggttcaatgctaatatttcatacagtggagtcctacatgcagtaacacaagatggtctcttctcagaaaacaaagaaaaactgatcaataatgccataacagcattactgtcccaagaaggggatgtcgttgcttcaaatgcggaacttgagagtcagttccaggctgtgaggaggcttgtggcatccaaagctggtttcctggctttcactcagcttccaaagtttcgcgagcgtctaggggtgaaggtagtaaaagcactcaaaagaagcaacaacggaataatccatgcagcagttgatatgctttgtgcccttatgtgtcccatgcatgatgactatgacttaagacaagaacagttgaacaaagcttctcttctctcgtcaaagaagtttctggaaaacttactggagaaatttaattcccatgtggatcatgggactggtgccctagttattagttcgctcttggacttccttacctttgccctctgtgctccatatagtgagacaactgaagggcagcagtttgatatgctcttggagatggtagcatccaatggaagaaccctttttaaactttttcagcatccttccatggcaataataaaaggagctgggttggttatgaaggcaataatagaggaaggtgataaagaaattgctacaaaaatgcaggagcttgccctaagtgaaggtgccttacctcgacacttgcatactgcgatgtttacaataagctcagatcaaaggatgcttacaaatagacagctaagtagacatttagtgggactctggacagctgataatgcaactgcaacaaacttgttgaaacgcattttgccgccaggcttgctggcatacttggaaagctcagatctcgtacctgagaaggatgctgatcggatgcatgttagagacaatgtgaaaatagcaatggatcagtatggaaaatttaataaagttccagagtggcaaagactagctggaaaagctgctaaagaagttgaaaaatttgccaaagaaaaagtggatcttgtattgatgcactggagggataggatgggcattgctcaaaaagagaatataaatcagaagccagtggttcttcgaaagagaagacaaagaataaaaatagaagcaaattgggatctcttctattataggtttggtcaagaccatgccaggtcaaaccttatttggaatttcaaaacacgagaagaactgaaagatactcttgaatctgaaatgagagcatttaatattgacagagaacttggaagtgcaaatgtgatctcctggaaccaccatgagtttgaggttaaatatgagtgcctggcagaggaaattaaaataggagactattacctgagattactattggaggaagatgagaatgaagaaagtggatcaattaagagatcgtatgaatttttcaatgagctttatcatcgcttcttgctcaccccaaaagtaaacatgaagtgtttatgtttacaagcccttgctattgtttatggcagatgtcacgaagaaataggaccttttacagataccagatatatcattggaatgttagagaggtgcacagataaacttgaacgagataggttgattctcttccttaacaagttgatccttaataagaaaaatgttaaggatctcatggattcaaatggaataagaatccttgtggacttgcttacccttgcacatctccatgtaagccgagctacagtaccactgcaaagcaatgtaattgaagctgctccagatatgaaaagagagagtgaaaaggaatggtattttggcaacgcagacaaagaaaggagtggcccgtatggatttcatgagatgcaagaattgtggaccaaaggaatgttaaatgcaaaaaccagatgctgggctcaaggcatggatggatggcgaccacttcagtccataccccagcttaagtggtgtctcttagccagtggacaggctgtcctgaatgaaactgaccttgctacccttatattgaacatgttgatcacaatgtgtggatattttccaagcagggatcaagacaatgccatcattcggcctctacccaaagtgaaaagactgctgtcagatagcacttgccttccccatattattcagctactgctgacctttgaccctatccttgttgagaaggttgctattttgttataccatatcatgcaagataacccacagttaccccgcctttatctgagtggagtatttttctttatcatgatgtacacaggttccaatgtgcttcctgttgctcgatttttgaaatacacacataccaaacaggctttcaagtcagaagagacaaaaggacaagatatttttcagagaagtatacttgggcacattctacctgaagcaatggtttgttacttagaaaattatgaacctgaaaagttttctgagatttttctaggagaatttgatactccagaagcaatctggagcagtgaaatgaggcgcctgatgatagagaagattgctgcccatctcgcggatttcacacctcgtcttcagagtaacacaagagcactttatcagtattgccccattcctataatcaactatccacaactcgaaaatgaactattttgtaatatttattacctcaaacaactgtgtgatacactccggtttccagattggccaattaaagacccggttaagcttctaaaagatacccttgatgcctggaagaaagaagtagaaaagaagccacctatgatgtcaatagatgatgcttatgaagtgcttaatctgcctcaaggacagggaccgcatgatgagagcaagattaggaaagcttacttcagacttgcacaaaagtaccaccctgataagaatccagaagggagggacatgtttgaaaaagtaaataaagcatatgaatttttatgtaccaaatcagcaaaaatagtggatgggccagatccagagaatataattttaattctaaaaacacagagcatcctcttcaaccgtcataaagaagatttacagccttataaatatgcaggataccccatgcttattcggactataacaatggaaacttcagatgacctccttttctcaaaagaatcaccattgttgcctgcggctacagagctagctttccatactgtcaactgttcagccctcaatgctgaagagctcagaagagagaatggactagaggtgttacaagaggcatttagtcgctgtgtggctgtcttgactcgtgctagtaaaccaagtgacatgtcagtacaggtgtgtggatacataagtaaatgctacagtgtggctgctcagtttgaggaatgccgagagaagatcacggaaatgcctagcatcatcaaggatctctgtcgggtactatattttggcaagagtattccccgcgtagctgctcttggggtagaatgtgtcagttcttttgctgtggatttctggctacagacacacctatttcaggctggaattttgtggtatctccttggttttctgtttaattatgactacacactagaagagagtggcattcagaaaagtgaagaaacaaaccagcaggaggtagcaaacagccttgccaaactgagtgtccatgctctgagtcgccttggagggtatttggctgaagaacaagcaactccagaaaatccaaccataaggaaaagcttagctggcatgctgacaccctatgttgctagaaaacttgctgtggctagtgtgactgagattttgaagatgcttaacagcaacacagaaagtccatatttgatatggaacaattctacaagagcagaattacttgaatttcttgaatcccaacaagaaaacatgattaaaaaaggtgattgtgacaaaacttatggatcagaatttgtctacagtgatcatgccaaagaacttattgtaggggagatttttgttagggtgtataatgaagttcctactttccaactggaggttccaaaagcatttgctgcaagtctcttggattatataggctcgcaggcccaatacttgcacacattcatggccatcacacacgcggcaaaagtggagtcagagcaacatggagatcgcttaccgagagtagaaatggctttggaggctctgagaaatgtcataaaatacaatccaggttctgagagtgaatgcattgggcactttaagttgatattttctcttctccgagttcatggagctggtcaagtgcagcagttggctttagaggttgtgaatatagtgacatctaaccaagactgtgtcaacaatattgctgaatcaatggttttgtccagtttattggctcttctacattcattgccatcaagtcgtcagcttgttctggaaactctttatgctttgacatcgagtacaaaaataatcaaagaagcaatggcaaagggtgctttgatctatttactggatatgttctgcaattcaacacatccacaggttcgagcccaaacagcagaactttttgccaaaatgacagcagataaactgataggtccaaaggttcgaattacgttaatgaaatttctaccaagcgttttcatggatgctatgagagacaatcctgaagctgctgtacatatttttgaaggaactcatgaaaatcctgagttaatttggaatgataattccagagataaagtgtccacaacagttagggaaatgatgctagagcactttaaaaatcagcaggacaaccctgaggcaaactggaagttgcctgaagattttgctgtggtgtttggagaagcagagggtgaacttgctgttggaggagtcttcttgaggatctttattgcacaaccagcctgggttctaagaaagcctagagaatttcttattgccctgttagaaaaattaactgagctcctagagaagaacaatcctcatggagaaactctggaaaccttgacaatggcaacagtgtgtctcttcagcgcacaacctcagctggcagatcaggtcccgccattgggccatcttcccaaagttatccaggcaatgaatcataggaacaatgccattcctaagagtgccattcgggttatccatgccttgtctgaaaatgagctgtgtgttcgagccatggcatctttagagaccattggcccactgatgaatggaatgaaaaagcgagcagatactgttggtctagcctgtgaagcaattaatcgaatgtttcagaaggagcagagtgaattagtagcacaagccctgaaagcagatttggttccatacctcttaaaattactcgaaggcattggccttgaaaacctggacagcccagcagccactaaggctcagattgttaaagctctcaaggcaatgactcgaagtttgcagtatggagaacaggtgaatgaaatcctgtgccgttcttcagtctggagtgccttcaaagatcagaaacatgatttgttcatttctgagtcacaaacagcaggatacctcacaggacctggagttgctggctaccttaccgcaggtacatctacatcagtcatgtctaacctgccacctcctgtagaccatgaggcaggcgaccttggctatcagacttgaaatattcacgagagacaataaacgctgaaaggccagtgccaagtccacattcctccagctgatacgttgaagcaaactcttactgcctttctcctggtttcatgacagtgttattcctttttctataaatatatttttaggaaaaaaagtcagtgatcctaattgtatcacattataagaaagcactctgtggatcaacataagtgggtacacaagaattttttttttcttggtgtatgtaagcacatttgttcctttatatctgtttacaaaactgtgaatcaaaaagacaaaactttcttcctagtttttgtaattttttttttgaactagcatgactgtagggttgagctacagtcaacaaaaattgggctaagtcacttttccccaggaaagaatatttccctctcctgcatcaagtctgcgtggccatcctccccccaccatccaagactattaggttttgtccctgcacccttcactggcatcctcaatcattaaccttctgaaagctcacagtacacattagtatgtataactggctttaccaaattgaatgaaaaggagcttgtgcaaaaaaatttaaaaatggatgtcaagatgttatgtaaaagatgagtgtaattgtgaaatgttctatacactatcaaatatataaagctttctatattgaatgtacattatacagatcattcatatgtgtacataaaattttaaaaataaagggaattgactgctttgttaatgaga

SEQ ID NO: 8672 - DNA, 3972 bp, Homo sapiens
gcacattctacctgaagcaatggtttgttacttagaaaattatgaacctgaaaagttttctgagatttttctaggagaatttgatactccagaagcaatctggagcagtgaaatgaggcgcctgatgatagagaagattgctgcccatctcgcggatttcacacctcgtcttcagagtaacacaagagcactttatcagtattgccccattcctataatcaactatccacaactcgaaaatgaactattttgtaatatttattacctcaaacaactgtgtgatacactccggtttccagattggccaattaaagacccggttaagcttctaaaagatacccttgatgcctggaagaaagaagtagaaaagaagccacctatgatgtcaatagatgatgcttatgaagtgcttaatctgcctcaaggacagggaccgcatgatgagagcaagattaggaaagcttacttcagacttgcacaaaagtaccaccctgataagaatccagaagggagggacatgtttgaaaaagtaaataaagcatatgaatttttatgtaccaaatcagcaaaaatagtggatgggccagatccagagaatataattttaatctaaaaacacagagcatcctcttcaaccgtcataaagaagatttacagccttataaatatgcaggataccccatgcttattcggactataacaatggaaacttcagatgacctccttttctcaaaagaatcaccattgttgcctgcggctacagagctagctttccatactgtcaactgttcagccctcaatgctgaagagctcagaagagagaatggactagaggtgttacaagaggcatttagtcgctgtgtggctgtcttgactcgtgctagtaaaccaagtgacatgtcagtacaggtgtgtggatacataagtaaatgctacagtgtggctgctcagtttgaggaatgccgagagaagatcacggaaatgcctagcatcatcaaggatctctgtcgggtactatattttggcaagagtattccccgcgtagctgctcttggggtagaatgtgtcagttcttttgctgtggatttctggctacagacacacctatttcaggctggaattttgtggtatctccttggttttctgtttaattatgactacacactagaagagagtggcattcagaaaagtgaagaaacaaaccagcaggaggtagcaaacagccttgccaaactgagtgtccatgctctgagtcgccttggagggtatttggctgaagaacaagcaactccagaaaatccaaccataaggaaaagcttagctggcatgctgacaccctatgttgctagaaaacttgctgtggctagtgtgactgagattttgaagatgcttaacagcaacacagaaagtccatatttgatatggaacaattctacaagagcagaattacttgaatttcttgaatcccaacaagaaaacatgattaaaaaaggtgattgtgacaaaacttatggatcagaatttgtctacagtgatcatgccaaagaacttattgtaggggagatttttgttagggtgtataatgaagttcctactttccaactggaggttccaaaagcatttgctgcaagtctcttggattatataggctcgcaggcccaatacttgcacacattcatggccatcacacacgcggcaaaagtggagtcagagcaacatggagatcgcttaccgagagtagaaatggctttggaggctctgagaaatgtcataaaatacaatccaggttctgagagtgaatgcattgggcactttaagttgatattttctcttctccgagttcatggagctggtcaagtgcagcagttggctttagaggttgtgaatatagtgacatctaaccaagactgtgtcaacaatattgctgaatcaatggttttgtccagtttattggctcttctacattcattgccatcaagtcgtcagcttgttctggaaactctttatgctttgacatcgagtacaaaaataatcaaagaagcaatggcaaagggtgctttgatctatttactggatatgttctgcaattcaacacatccacaggttcgagcccaaacagcagaactttttgccaaaatgacagcagataaactgataggtccaaaggttcgaattacgttaatgaaatttctaccaagcgttttcatggatgctatgagagacaatcctgaagctgctgtacatatttttgaaggaactcatgaaaatcctgagttaatttggaatgataattccagagataaagtgtccacaacagttagggaaatgatgctagagcactttaaaaatcagcaggacaaccctgaggcaaactggaagttgcctgaagattttgctgtggtgtttggagaagcagagggtgaacttgctgttggaggagtcttcttgaggatctttattgcacaaccagcctgggttctaagaaagcctagagaatttcttattgccctgttagaaaaattaactgagctcctagagaagaacaatcctcatggagaaactctggaaaccttgacaatggcaacagtgtgtctcttcagcgcacaacctcagctggcagatcaggtcccgccattgggccatcttcccaaagttatccaggcaatgaatcataggaacaatgccattcctaagagtgccattcgggttatccatgccttgtctgaaaatgagctgtgtgttcgagccatggcatctttagagaccattggcccactgatgaatggaatgaaaaagcgagcagatactgttggtctagcctgtgaagcaattaatcgaatgtttcagaaggagcagagtgaattagtagcacaagccctgaaagcagatttggttccatacctcttaaaattactcgaaggcattggccttgaaaacctggacagcccagcagccactaaggctcagattgttaaagctctcaaggcaatgactcgaagtttgcagtatggagaacaggtgaatgaaatcctgtgccgttcttcagtctggagtgccttcaaagatcagaaacatgatttgttcatttctgagtcacaaacagcaggatacctcacaggacctggagttgctggctaccttaccgcaggtacatctacatcagtcatgtctaacctgccacctcctgtagaccatgaggcaggcgaccttggctatcagacttgaaatattcacgagagacaataaacgctgaaaggccagtgccaagtccacattcctccagctgatacgttgaagcaaactcttactgcctttctcctggtttcatgacagtgttattcctttttctataaatatatttttaggaaaaaaagtcagtgatcctaattgtatcacattataagaaagcactctgtggatcaacataagtgggtacacaagaattttttttttcttggtgtatgtaagcacatttgttcctttatatctgtttacaaaactgtgaatcaaaaagacaaaactttcttcctagtttttgtaattttttttttgaactagcatgactgtagggttgagctacagtcaacaaaaattgggctaagtcacttttccccaggaaagaatatttccctctcctgcatcaagtctgcgtggccatcctccccccaccatccaagactattaggttttgtccctgcacccttcactggcatcctcaatcattaaccttctgaaagctcacagtacacattagtatgtataactggctttaccaaattgaatgaaaaggagcttgtgcaaaaaaatttaaaaatggatgtcaagatgttatgtaaaagatgagtgtaattgtgaaatgttctatacactatcaaatatataaagctttctatattgaatgtacattatacagatcattcatatgtgtacataaaattttaaaaataaagggaattgactgctttgttaatg

SEQ ID NO: 8673 - DNA, 1453 bp, Homo sapiens
cgacagttttccggcctagtttgcggctgctcctgccgtgttgcgtagggcgcctgtgcttgaggttgggggttgcgtcgctctctggtaaaggcgtgcaggtgttggccgcggcctctgagctgggatgagccgtgctcccggtggaagcaagggagcccagccggagccatggccagtacagtggtagcagttggactgaccattgctgctgcaggatttgcaggccgttacgttttgcaagccatgaagcatatggagcctcaagtaaaacaagtttttcaaagcctaccaaaatctgccttcagtggtggctattatagaggtgggtttgaacccaaaatgacaaaacgggaagcagcattaatactaggtgtaagccctactgccaataaagggaaaataagagatgctcatcgacgaattatgcttttaaatcatcctgacaaaggaggatctccttatatagcagccaaaatcaatgaagctaaagatttactagaaggtcaagctaaaaaatgaagtaaatgtatgatgaattttaagttcgtattagtttatgtatatgagtactaagtttttataataaaatgcctcagagctacaattttaaaaaatgatttagcacaagctaaatctcaaagccttggtataattttcttgtttaaatttggggattttaaatcagattatagtttagaatatttgcgtattaattatgggcaagcacacaccttctgaatagaaatattgttcattactcatttagcagataatttgggacctatgtctacttttcaaggcaaagtgaagatgacagtccttgctctcagggagcccccactttaatgggagactgataaactggtaattagactgtgataaatagtatgatggaaattagcttaagctgtttaagtagggactcttcttattcggtggaaaggctgttccaggtacaggcaactggcctggcaacttggatacttggaaccttgtatttaaaagtgaatttaaccacaactgagacctaagaaattgacctaggggtgtgtgtgtgtgtgtattctatgtacatataaaccatttttatttcatgcattaaaaatagtatgataaagatttcagagtacaggtctggtacaatcacagttcattgcagcctcaacctcctgggtttaagcagtcctcccgcctcagcctcccaaagtactgggattacaggcatgagtatttacattgtattcagctagccccttaaaggtaatgaccatttataaattattccttcagttggctatttcttgacataatcaaacttctgcaattgttatgattaagcttaaaccctgttagcaaaactgaaaactgaaatgttctcaatatcaacatatttaatttggactctttagaatttatacactaataaatttaaatgatgtttaaaggcaaa

SEQ ID NO: 8674 - DNA, 1846 bp, Homo sapiens
gggacgtgagccgctgcgcccaccgggctagacccggcgccatcatgctgcttctgccaagcgccgcggacggccggggcaccgccatcacccacgctctgacctctgcctctacactctgtcaagttgaacctgtgggaagatggtttgaagcttttgttaagaggagaaacagaaatgcttctgcctcttttcaggaactggaggataagaaagagttatccgaggaatcagaagatgaagaattgcagttggaagagtttcccatgctgaaaacacttgatcccaaagactggaagaaccaagatcattatgcagttcttggacttggccatgtgagatacaaggctacacagagacagatcaaagcagctcataaagcaatggttttaaaacatcacccagacaaacggaaagcagctggtgaaccaataaaagaaggagataatgactacttcacttgcataactaaagcttatgaaatgttatctgatccagtgaaaagacgagcatttaacagtgtagatcctacttttgataactcagttccttctaaaagtgaagcaaaggataatttcttcgaagtgtttaccccagtgtttgaaaggaattccagatggtcaaataaaaaaaatgttcctaaacttggtgatatgaattcatcatttgaagatgtagatatattttattctttctggtataattttgattcttggagagaattttcttatttagatgaagaagaaaaagaaaaagcagaatgtcgtgatgagaggagatggattgaaaagcagaacagagcaacaagagcacaaagaaaaaaagaagaaatgaacagaataagaacattagttgacaatgcatacagctgtgatccaaggataaaaaagttcaaggaagaagaaaaagccaagaaagaagcagaaaagaaagcaaaagcagaagctaaacggaaggagcaagaagctaaagaaaaacaaagacaagctgaattagaagctgctcggttagctaaggagaaagaagaggaggaagtcagacagcaagcattgctggcaaagaaggaaaaagatatccagaaaaaagccattaagaaggaaaggcaaaaacttcgaaactcatgcaagatagaagaaataaatgagcaaatcagaaaagagaaagaggaagctgaggctcgtatgcgacaagcatctaagaacacagagaaatcaactggtggaggtggaaatggaagtaaaaattggtcagaagatgatctacaattactaattaaagctgtgaatctgttccctgctggaacaaattcaagatgggaagttattgctaattacatgaacatacattcttcctctggagtcaaaagaactgccaaagatgttattggcaaagcaaagagtctccaaaaacttgaccctcatcaaaaagatgacataaataaaaaggcatttgataagttcaaaaaagaacatggagtggtacctcaagcagacaacgcaacgccttcagaacgatttgaaggtccatatacagacttcaccccttggacaacagaagaacagaagcttttggaacaagctttgaaaacatacccagtaaatacacctgaaagatgggaaaaaatagcagaagcggtgcctggcaggacaaagaaggactgcatgaaacgatacaaggaacttgtcgagatggtaaaagcaaagaaagctgctcaagaacaagtgctgaatgcaagtagagccaagaaatgacaatctttgttgtgtgtgcatttttataataaaactgaaaatactgtaaacattttcattcttaaaattatactcatggtaataatttgaaagta

SEQ ID NO: 8675 - DNA, 2167 bp, Homo sapiens
agccggatctcagtcagtatagaactaggttaccgcacacgttggcgggggtgggagggtgtgagactggcctccacaccacgaaagatccatcccggaagtgcttactggtcgtctccatgcgccggttcctgggcgtcttagagccaaggcgcgaggctcggagtgagaggtagagctggaggggaccctaagcgccctccgcccgggacgtgagccgctgcgcccaccgggctagacccggcgccatcatgctgcttctgccaagcgccgcggacggccggggcaccgccatcacccacgctctgacctctgcctctacactctgtcaagttgaacctgtgggaagatggtttgaagcttttgttaagaggagaaacagaaatgcttctgcctcttttcaggaactggaggataagaaagagttatccgaggaatcagaagatgaagaattgcagttggaagagtttcccatgctgaaaacacttgatcccaaagactggaagaaccaagatcattatgcagttcttggacttggccatgtgagatacaaggctacacagagacagatcaaagcagctcataaagcaatggttttaaaacatcacccagacaaacggaaagcagctggtgaaccaataaaagaaggagataatgactacttcacttgcataactaaagcttatgaaatgttatctgatccagtgaaaagacgagcatttaacagtgtagatcctacttttgataactcagttccttctaaaagtgaagcaaaggataatttcttcgaagtgtttaccccagtgtttgaaaggaattccagatggtcaaataaaaaaaatgttcctaaacttggtgatatgaattcatcatttgaagatgtagatatattttattctttctggtataattttgattcttggagagaattttcttatttagatgaagaagaaaaagaaaaagcagaatgtcgtgatgagaggagatggattgaaaagcagaacagagcaacaagagcacaaagaaaaaaagaagaaatgaacagaataagaacattagttgacaatgcatacagctgtgatccaaggataaaaaagttcaaggaagaagaaaaagccaagaaagaagcagaaaagaaagcaaaagcagaagctaaacggaaggagcaagaagctaaagaaaaacaaagacaagctgaattagaagctgctcggttagctaaggagaaagaagaggaggaagtcagacagcaagcattgctggcaaagaaggaaaaagatatccagaaaaaagccattaagaaggaaaggcaaaaacttcgaaactcatgcaagacctggaatcatttttctgataatgaggcagagcgggttaaaatgatggaagaagtggaaaaactttgtgatcggcttgaactggcaagcttacagtgcttgaatgaaacactcacatcatgcacaaaagaagtaggaaaggctgctttggaaaaacagatagaagaaataaatgagcaaatcagaaaagagaaagaggaagctgaggctcgtatgcgacaagcatctaagaacacagagaaatcaactggtggaggtggaaatggaagtaaaaattggtcagaagatgatctacaattactaattaaagctgtgaatctgttccctgctggaacaaattcaagatgggaagttattgctaattacatgaacatacattcttcctctggagtcaaaagaactgccaaagatgttattggcaaagcaaagagtctccaaaaacttgaccctcatcaaaaagatgacataaataaaaaggcatttgataagttcaaaaaagaacatggagtggtacctcaagcagacaacgcaacgccttcagaacgatttgaaggtccatatacagacttcaccccttggacaacagaagaacagaagcttttggaacaagctttgaaaacatacccagtaaatacacctgaaagatgggaaaaaatagcagaagcggtgcctggcaggacaaagaaggactgcatgaaacgatacaaggaacttgtcgagatggtaaaagcaaagaaagctgctcaagaacaagtgctgaatgcaagtagagccaagaaatgacaatctttgttgtgtgtgcatttttataataaaactgaaaatactgtaaa

SEQ ID NO: 8676 - DNA, 857 bp, Homo sapiens
agccggatctcagtcagtatagaactaggttaccgcacacgttggcgggggtgggagggtgtgagactggcctccacaccacgaaagatccatcccggaagtgcttactggtcgtctccatgcgccggttcctgggcgtcttagagccaaggcgcgaggctcggagtgagaggtagagctggaggggaccctaagcgccctccgcccgggacgtgagccgctgcgcccaccgggctagacccggcgccatcatgctgcttctgccaagcgccgcggacggccggggcaccgccatcacccacgctctgacctctgcctctacactctgtcaagttgaacctgtgggaagatggtttgaagcttttgttaagaggagaaacagaaatgcttctgcctcttttcaggaactggaggataagaaagagttatccgaggaatcagaagatgaagaattgcagttggaagagtttcccatgctgaaaacacttgatcccaaagactggaagaaccaagatcattatgcagttcttggacttggccatgtgagatacaaggctacacagagacagatcaaagcagctcataaagcaatggttttaaaacatcacccagacaaacggaaagcagctggtgaaccaataaaagaaggagataatgactacttcacttgcataactaaagcttatgaaatgttatctgatccagtgaaaagacgagcatttaacagtgtagatcctacttttgataactcagttccttctaaaagtgaagcaaaggataatttcttcgaagtgtttaccccagtgtttgaaaggaattccagagtctccatctcaaaaaaaaaaaaaaaaaaaaga

SEQ ID NO: 8677 - DNA, 4992 bp, Homo sapiens
gtctccctcccccggctccccacgctcccaaccgcccgcgcctgctgccaggcagcggcggggatggcgagcagcggaggcgaggcggtgacgagagcagcggctccgccattggacgaggaggcctgagggacgggccagcggtgcacaagaagagaccgaggcgggtggccccgagagagccagggccatggaggccaacatgccgaagcggaaggagcccggcaggtctctccgcatcaaagtcatctccatgggcaacgccgaagtggggaaaagctgtattataaagcgatactgtgagaaaagattcgtgtctaaatacctggcaacaattggaattgactatggagtcacaaaggtacacgtcagagacagagaaatcaaagttaacatctttgatatggctggacatcccttcttctatgaggttcgaaatgagttttacaaggacacacagggtgtgatactggtctatgatgttgggcagaaagactcctttgacgcccttgatgcgtggctggcagaaatgaagcaagagcttggacctcatggaaacatggaaaatattatatttgtagtttgtgccaacaagattgattgtaccaaacatcgctgtgtagatgaaagtgaaggacgtctttgggctgaaagcaaagggttcctgtactttgaaacttcagcacaaactggagaaggcattaatgagatgttccagaccttttatatatccatagttgatttatgtgaaaatggcgggaaacgccctaccaccaatagcagtgctagtttcaccaaagaacaagcagatgccattcgcagaattcgaaatagtaaagacagttgggacatgctgggagtcaaacctggggcctcaagggatgaagtcaataaagcgtatcggaaacttgctgtgcttcttcaccctgacaaatgtgtagcacctggcagtgaagatgccttcaaagcagttgtgaatgctcggacagccctcctgaaaaacatcaagtagaaagtacagaaaaaagccacatgtgggactcaaatgcaaacagactttccctagaggtgaaataaccaacgtggagttttccttcccagaatctcactgctcttttcattcatgtgttgtcatttgtatatcagtaattcaggtacccatttcatagacattttactgagaaatgacctgcatttgtatgaagtgaactgagcgtcacaccctgtacttcatttcatatttctagataattctgaatttttttctcattcgtcagctctgtaattatagtatcacttagacatttcacttggggaaatccacaaggttcctggaggagggaagagaggacaagaggaccctttcactttttcttttttacggaattcatcatcagagaagaaaataacaaaaatggaagcaaacaacatcagaacccctgtaagtttggtgtgaccttacagacaagttgctgcttttacaatgagttccttaggtggtattttaacccatcgatctataatgatgactcttggcagccctttgggagtttgtaaaatgaggtgatacagttctgaattgagcattcctttatgatattcactctgttcctcttctgcagccaccagtgggagagacaagccagtcctaagagaaaaggtggtggcagccacaaattctaggtacactggctgctgcctatcctgtccctggatctgaggcctttcccttgccatagaaatggttgctggtagcagtagagagcactgtgcacctgggaatgaggaatcaggccccaagacagaagtacttggaggagccagctgcagtagtatccgcctgtagtcccagctactcaggaggctgagacaggaggattgcttaagcccaggagctcaagtcccacctgggcaacatagtaagatcttgtctcttaaagaaaaaaaaaaaaggtacttagaggtcgcacttaaagattatgcacatcagcagaggaaaggccagccaagcttggggcaagcttgatgcagtaggagagactccttatgaggcttagcccttgtcttactgccagcctttgccacaggcaggtgagaaaggcagggccactcctcagcaaagttggcctcttctacacttcctcaccagtgttgtttcttccttttttcccctcttccccttcccgtcttgtgttttttctgaaccccacatctgccatcatttctctcctctagagtccctggcttctggccactgcctcctccctcttctaagccttggcctgaatctggttgatcagaggcaagtgtggatcctttgggtggcagtcaggggagatctcagggcctctgttgggaggaatctctgtaattcctgcttgggctccaaatttctgaagagtaatatttttaaactatagcttacaaaatacattctctgaccacagtctcctccttgatatacaagggatggatgaagttcatgtattaggactggcactccttacggtgcttatagaactagtctcaccacttgactcattacgtcgtcattcttgttacatcactcatacttttagctgcaaccacactaattcacatttttatatactttcaattagctgtactaattggggcttgaaagtatataaaatcttcctgtcctgtgaattttaaaaagctatcccatatcgattgccaaagagcatctaccttacctcctaagaagaaaagccactttcttccaatccaagcccactgcagccttgtggattttccacacagcagcttttcactgtatgcctgtacttgggctgcactgagcttgtcttcaggaaaccagagcgttgctttatcatcgcacttttcatcttggtaatatcaaaacaactttttaaatgaactgattgatatatgttatttcttgcgaggttttcctctggcctttaactggcttctgaggctacagaactccaacccagagttcttcgggacctaaattttgcttaaggaaggcctttatcatgctgaaagcactcagacatgtctgtcctcacagcagaatgtagaagtcatatgaatgagggatcgtgcacggtagcgtcagcccgaattgacacgacaactctgaatgtgtggccctctatgaaagctggtgccagttttcatcactgttattaaatactagattgggaacctcattcagccgtattgcacagatgagcaattacagcagagaaaattcattagtgctcccactcatatccttatgtgtgagttggtgaaatttagcctgagcttgattcttaggtcttgagactcagtttccaacaccttcattattaatgttaagaatggccatataccacttcatttacgtaaaaggaataaaataagcaagttaagcttcagggtcctagaatttttctgatttctataatccttcagcagaatattaagaaataaagcatgatctgcaatggaaaggtttttttggcactaacttcatgcagaatttcacagacatctatgcattaatttaaattcttggtgcaaatgtgtgctttgtagttcaaccttattaaaaattcttcagccagttaggatttcaaaatacattagtgagagtaacagctagcagaataattacaatggctaaaacgtttttatagagaatcttgtttttcaaaaaagaataaaaagtttgaatagctattattaaagaaaagccatgtcttcaacatctgagtcaccaagaagtaacactttttaaacttgttagaaatccctggaggcatttcaaattcatcttctaacctacctaagcactttaaaatacagcctccttctgttcctctgttccccttcatgcctccttttgaattgatatctcagctgtcaatatttctttgacttcagcattgttattttatttctctatatcaatgtgtccttagttttcttagcctgttaatttaaaaatccagacttgggggtcattgtgttgctacccaagagaaaatgctacagttttatagattgcacatcattctttaaggcatacttttacctcaggaaacttactctagtatgttctcatatattgaattctcaactaagtaactatttctttatacctataaactagtacctaattcactgttagttaaatgagctatagataaggcagctaaatttctgaaagatagccagagtaagtaagcagccactgcaagctctgaatcagttttttaaaaaaaagaaaaaaaaaaaaaaggagctgtgccccattgaacaatgacaacatcacaaggggaagggagggattttgccaaaagttagaaaggtggagctgtaagccatgtgcttgttgcctttgacagtgacagtgcgcgtcttacaactaattccactaggcatgggaatgtcacctcctttgccactgtaccccatcaagcttactctgaatcaaaggttttgtaaaacttttgaaaatgaacttagctgcaaaatatagctaaccactttccattgcaagctttgcaaagtgaagagaggttcgtacttctcataattggtatttagcacaattgtaagatacagttttactgtttgtacatcgtttttttccattaaacttttctagagaagacaaaagcttacactggtgacatggataagtgagatggtgtctaacgagcagtgcaatattaggcggtgcaatagaggccctgttggcaagatgagttttgctggagagctggacagtgttggttagcttcctgcattgattgcccctgggcgttcttcccccttaactgtgaaagcagagtctataaatgaactctttgctcttacaaggtaatttacatattttctttctgttgaaataactgaaaatgttaaatctaccagtttatgtcttgtaaacagagtgtcatatgtatttaagttgtgtatttttataaagtaaagccaagtatcaaacaccgg

SEQ ID NO: 8678 - DNA, 1415 bp, Homo sapiens
gtcactcttccggagatggtgtctggggtggcctctaagccttgaatgtacccccaaaagaagctgtattataaagcgatactgtgagaaaagattcgtgtctaaatacctggcaacaattggaattgactatggagtcacaaaggtacacgtcagagacagagaaatcaaagttaacatctttgatatggctggacatcccttcttctatgaggttcgaaatgagttttacaaggacacacagggtgtgatactggtctatgatgttgggcagaaagactcctttgacgcccttgatgcgtggctggcagaaatgaagcaagagcttggacctcatggaaacatggaaaatattatatttgtagtttgtgccaacaagattgattgtaccaaacatcgctgtgtagatgaaagtgaaggacgtctttgggctgaaagcaaagggttcctgtactttgaaacttcagcacaaactggagaaggcattaatgagatgttccagaccttttatatatccatagttgatttatgtgaaaatggcgggaaacgccctaccaccaatagcagtgctagtttcaccaaagaacaagcagatgccattcgcagaattcgaaatagtaaagacagttgggacatgctgggagtcaaacctggggcctcaagggatgaagtcaataaagcgtatcggaaacttgctgtgcttcttcaccctgacaaatgtgtagcacctggcagtgaagatgccttcaaagcagttgtgaatgctcggacagccctcctgaaaaacatcaagtagaaagtacagaaaaaagccacatgtgggactcaaatgcaaacagactttccctagaggtgaaataaccaacgtggagttttccttcccagaatctcactgctcttttcattcatgtgttgtcatttgtatatcagtaattcaggtacccatttcatagacattttactgagaaatgacctgcatttgtatgaagtgaactgagcgtcacaccctgtacttcatttcatatttctagataattctgaatttttttctcattcgtcagctctgtaattatagtatcacttagacatttcacttggggaaatccacaaggttcctggaggagggaagagaggacaagaggaccctttcactttttcttttttacggaattcatcatcagagaagaaaataacaaaaatggaagcaaacaacatcagaacccctgtaagtttggtgtgaccttacagacaagttgctgcttttacaatgagttccttaggtggtattttaacccatcgatctataatgatgactcttggcagccctttgggagtttgtaaaatgaggtgatacagttctgaattgagcattcctttatgatattcactctgttcctcttctgcagccaccagtg

SEQ ID NO: 8679 - DNA, 1631 bp, Homo sapiens
gcgagagccgacggcgggcgggcgcagctgctgccggagcgccggcgcgtgctggtgggccacacacctttcctcctcttcactcgcgagccctcggacatggtggcccccggctccgtgaccagccggctgggctcggtattccccttcctgctagtcctggtggatctgcagtacgaaggtgctgaatgtggagtaaatgcagatgttgagaaacatcttgaattgggcaagaaattacttgcagctggacagctagctgatgctttatctcagtttcatgctgccgtagatggtgaccctgataactatattgcttattatcggagggctactgtctttttagctatgggcaaatcaaaagctgcacttcctgatttaactaaagtgattcaattgaagatggacttcactgcagcaagattacagagaggtcacttattactcaaacaaggaaaacttgatgaagcagaagatgattttaaaaaagtgctcaaatctaatccaagtgaaaatgaagaaaaggaagcacagtctcaacttataaaatctgatgaaatgcagcgtttgcgttcacaagcacttaacgcttttggaagtggagattatactgctgctatagccttccttgataagattttagaggtttgtgtttgggatgcagaactacgggaacttcgagctgaatgttttataaaagaaggagaacctaggaaagctataagtgacttaaaagctgcgtcaaagttgaagaatgataatactgaagcgttttataaaataagcacactgtactaccaactaggagaccacgaactgtccctcagtgaagttcgggaatgtcttaaacttgaccaggatcataaaaggtgttttgcacactataaacaagtaaagaaacttaataagctgattgagtcagctgaagagctcatcagagatggcagatacacagatgctaccagcaaatatgaatctgtcatgaaaacagagccaagcattgctgaatatacagttcgttcaaaggagaggatttgccactgcttttctaaggacgagaagcctgttgaagctattagggtttgttctgaagttttacagatggaacctgacaatgtgaatgccctgaaagatcgagcagaggcctatttgatagaggaaatgtatgatgaagctattcaggattatgaaactgctcaggaacacaatgaaaatgatcagcagattcgagaaggtctagagaaagcacaaagattattgaaacagtcgcagaaacgagattattataaaatcttgggagtaaaaagaaatgccaaaaagcaagaaattattaaagcataccgaaaattagcactgcagtggcacccagataacttccagaatgaagaagaaaagaaaaaagctgagaaaaagttcattgatatagcagctgctaaagaagtcctctctgatccagaaatgagaaagaagtttgacgacggagaagatcctttggatgcagagagccagcaaggaggcggcggcaaccctttccacagaagctggaactcatggcaagggttcaatcccttcagctcaggcggaccatttagatttaaattccacttcaattaaaccaactgtttttctgc

SEQ ID NO: 8680 - DNA, 5213 bp, Homo sapiens
acccgcgccctctgccgccgccgccgccgccgcccggggtctccaggctgaggagtgcgtcggccgctgcccagcagcgccgcgaatcggggagcggagccgcggagccggcgggagggcgggcgggcgggcggacgggcagaatagcctaacatggcagaccagagacagcgctcactgtctacctctggggagtcattgtaccacgtccttgggttggacaagaacgcaacctcagatgacattaaaaagtcctatcggaagcttgccttgaaatatcaccccgacaagaaccccgacaacccggaggccgcggacaagtttaaggagatcaacaacgcgcacgccatcctcacggacgccacaaaaaggaacatctacgacaagtacggctcgctgggtctctacgtggccgagcagtttggggaagagaacgtgaacacctacttcgtgctgtccagctggtgggccaaggccctgtttgtcttctgcggcctcctcacgtgctgctactgctgctgctgtctgtgctgctgcttcaactgctgctgcgggaagtgtaagcccaaggcgcctgaaggcgaggagacggagttctacgtgtcccccgaggatctggaggcacagctgcagtctgacgagagggaggccacagacacgccgatcgtcatacagccggcatccgccaccgagaccacccagctcacagccgactcccaccccagctaccacactgacgggttcaactaaatccaggaggagctgtggtcagaggaggagccggcgcctggccacgccaaccttagaatcatgaactgtagtcacagagatgggaaggcagcctcctgcctgccctggccttgctggggcccctcctgcctccacgcccacccagcgtcgacccttgacccacgaagtgcgtagcatgcagtatttaaagcagtgtagctacggtcttctgtttttttcccttttttaatagcatgtatggggttctgttccatgtctgtgttgtggacattccgcggcatgaccgcgtgaactgcacggtggagctgcctcagggctgtcggtcaggttggtccagtgaggggtgactgcagccggtcaggtgggcgaggagaaggggggctgcccctttcctacctgtgcttgaggggccggaggcaggtgctgcctggcagagctgtgttaccgtcttggcctcggggtctggtccacactctgtgctcccagccttgaggctgcagtaggactctgatctcacctgccagaagagaggcggggccgcgtcctcctggcgtcaccggcgtcactgtcattccttggtgtctgtgctgggcatggttggcttgggggtctgtggtttcctgggccttgtggcagggtttctcccgtgggagaatttggtgtggaaagcataggaggccccttccgaggttgacaccgtgtcctccgcggtgtttctcgcctggtcgtctcgtcgtgtggacgctgccgttctggttctcggaggtgtgtccttcgccgtgttggggttatttgtctgtgttcctgcacttttcccgggctctgagctggattgatggggccagtctcccccctcccatcttgaggtcgttctccacattccttccagcacacctgtcctttccatagccctttttggacctttagaaccacagatgataggaccagcccaatgagccacagtcagagagtagattgtgcatgtgtgagcacccagctactggggacgggggctctcccacgacccctcctcctgtgtttgccagagctcccatctgccccactcgcctttgccccgtcatcgatgattcaggcagagccagattcgttaggtccctggaggaaggactgactggaccagagggaccctctggctcaggagggttgggtccctgggaggccggcagccaggccacagaatccacacgtggaccattgtgggtccctgggaggccggcagccaggccacggaatccacacgtggaccattgtgggtcccttgggaggccagcagccagactacggaatccacatgtggaccatgggaagtcagtctcttgcgtgtcctagaccttgtgggtggcgccctgcataggggagcagggggaacgggtctgatgtccctgtgctggctgagggctcagagctgcccgcactccgtagctcatgggatgtgctgggcctgcctttggcgccatgctgcagactccagtgggcctggtttctgcagaatgtccatggtggccgctgcagagttgcagaggtccctgtagagataaagctgaggaggaggctgtgtgtgatggctctggctcggaccaaccagatgagcctcctgaagcccccttccctgcctgcctgctgacccgtggccccagctcactcattgccctcagcagccacccgaggctgtgcagaagggtaggttcaggttgaccaggaagctgccaaaagggacatggatatgaggatacatctggacgtgcttaggaacagggtgctggttgagggcccccagctgacccctactgcagatccgcatgtggaccatgagccggctgccagcactaggtcctgggcagctttgtttgtcccacttttctttgtttcttctcactaaaatgatcacgaagacctttgacaagaggagagatatgcactgtgatattaaattagaaataatttatcaaaatcagacctctcctaaaagaataagaaattcattgtttggcccatcctgaaaggtgaggtggcgagacagtggggtgcctccgtgccgcttcgtgcagcagcaagttcagcctgagatgctggctgtactcagcctttgcaatttttgtagatgtagcttaggacgtgagttatttttccgcagactggccaagagccaggttctaagcttggacctaaggtagaaagctgcccatcgggggccctagctcagccccaccaggccctctgttgggcctgcacacagctctgtggctagaacactccaaggcccttcggtacccatcagagtgggccccttgccaggtggcttttcagttacagagtccagtggaccattttgtagaaccatgcagctccctgcggaaggtggggtagggtgggaaagaggagcaggtctggaggtttgtggaacccagtcccctgcagaatctgtaaaacctaataaatcatggttgtggccattctcacggtggtgattgtgattagacgacccccgggaagcccagacactcggggcctggagttcctccccctgcctgacctagaagcagaaccgttttcagcgctctgccctgttggctttaaggctttgtcttaatttaaggaaaaagatcctcccgggttttatttctctctttcttgagtggactgtttccctataattaaaagaggtggtgagtcctggggcagcttccgcgcctccctgtccacgtgctaacagatcaggacgcccccagcacccctgcctgcttttgctggtggcagtgacgggaccccgactcctcactctcgggccgcagacaatgctgtgagcaagtgtggccatgggcacagaatgtccctttggacgccgctgctgggggctgccaggggccctctggggtcgtgctttgaggcccgtccggttcacgagggggtccgggcagcactgactgcttccgacctgcaggaggcgtaggagcggccctgcgggccctttcacggcagctgctgctgtatagatttgtctccactcagtgacgtgggatttttttgtcttccttttggctttatttttaaactgctttagatattactgctcagtgtttgtgaactttcctagttctctatgttgttagtgcagccagcacccagtggggacctactagaaaaaggaactggcatgcacacgtgcccagcaggaaaagcttcgtcttcacgtcggctgctgccatccagaagaggccctggagcctcacgccgtcgaggctgctctcaggcgttctgttccgggcgaggcttgtgctgcaaggaagggcaccagcatgcaggctgccactggagggtccgggtgctgcgggcagagttcagcgcttgtccaccctcccttagctctgactcagtgcatcctactgtggggacatctcgtgaggggacacgaaatgactgatctcaccctttcccagtattcagagctgtgaacccctgtggcgcaggactggcctgtgtctgttattttggttgtaaatcattctcctgtggaattggcaaaagctacatttttactgtccttaccagcaacagtttgcgtcgtcacatgctgtgagtgtgggctgtggtgtgtccgtgtgtgtacatatgtgtatatgtatatatcacgcagcaggagtgtcattcatgctgctgtcccctggtgaagtgacaagtacaattaaaggtggctctgaaatggcctctggtttcttgggagtcgggcagggacctgcaggaggctttcccagcaggtgcacagaaggaagcgctgagcccactgtgtgcagagggtgtgtgcccagggcactgccacggcccccaccagcattggcctctgctctgcagggtggggtgcccatcctgggggctgtgtgtcatgctcacctgacccaggtgtgtgtcccggtgtgaaatcgaggaggggactggaagcccttccctgccttgaaacatgaaagctgattttctgagcagcagatacggtcagtggcaaagctgcatctgaagggcggcctgggaaggggccctgtgctggccccgggtccgccccagaggagtccacacagcaccacctccagaaggggctgggcccggggtcctgcaggcggcaccttttggtagagtttgtttccctggaaaatggggaaaatgtttcaagccaggtgaggggggaagttaacactgaaatatgtattgtttttaaaaatcaaatgcacacgcatggaagctgcttgtccatgcactggttttgtcactggcgtcctggaatccgaccgtgttggggtgcaggcgctgtcagactccggctgatcctggctcgagcacacacatctaagggccaggctggttccgcatggtgatctccgtcttgtatgtctgaatgttggcctaaaataaagattactgttgtaaaataaatgttttcactgcggacccca

SEQ ID NO: 8681 - DNA, 674 bp, Homo sapiens
gccgctgccggtgccgcacccgcgccctctgccgccgccgccgccgccgcccggggtctccaggctgaggagtgcgtcggccgctgcccagcagcgccgcgaatcggggagcggagccgcggagccggcgggagggcgggcgggcgggcggacgggcagaatagcctaacatggcagaccagagacagcgctcactgtctacctctggggagtcattgtaccacgtccttgggttggacaagaacgcaacctcagatgacattaaaaagtcctatcggaagcttgccttgaaatatcaccccgacaagaaccccgacaacccggaggccgcggacaagtttaaggagatcaacaacgcgcacgccatcctcacggacgccacaaaaaggaacatctacgacaagtacggctcgctgggtctctacgtggccgagcagtttggggaagagaacgtgaacacctacttcgtgctgtccagctggtgggccaaggccctgtttgtcttctgcggcctcctcacgtgctgctactgctgctgctgtctgtgctgctgcttcaactgctgctgcgggaagtgtaagcccaaggcgcctgaaggcgaggagacggagttctacgtgtcccccgaggatctggaggcacagctgcagtctgacgagaggggagggcactga

SEQ ID NO: 8682 - DNA, 1372 bp, Homo sapiens
gcagttactgatatagccaaggtgggacactactggagggagctagaagggatcagccagccatgcctccagttcaggtacttggcattgctaagctcagaacaggacttgccagtgtctagatgaaaaagaggagagatctcaagagggataaccaattggctggcaaagtaacaaatgaaaagtaacctgactctattgacctgcttaaccctgcatgggggggaaggatggaaaggagcagctgtttgctttgaaacggtggaacagttttgcagccttagaaaatggcatgtaacatacctaaccaaagacagcggactctgtcaacaacaggagaagctctatacgaaattcttggtctgcataagggagcatcaaatgaagaaattaagaaaacctacagaaaattggccctgaaacaccatccagacaagaatccagatgatccagctgctactgagaagtttaaagaaatcaacaacgcccacgcaatacttaccgacatttcaaagagaagcatatacgacaagtacggatcgctgggactctacgtggccgagcagtttggagacgaaaacgttaacacctacttcatgctgtcgagctggtgggcaaaggccctgtttgtcatcgttggcctcttgacgggctgctacttttgctgctgcctgtgctgctgctgcaactgctgctgtggacactgccggcccgagtcatcagtgccagaagaggacttctatgtgtccccagaggatctggaggagcagatcaagtctgacatggaaaaagatgtggactttccagtttttctccagcctacaaatgcaaatgagaaaacacagctaatcaaagaaggatctcgaagttattgcacagactcttgatattgagccctcagagagtccacagtccctcctctcagttcagtcttgtctccagatggtcgtaggggagcgtgtggggcataaagtgctgtgaacttttccatcttgttgttttatttttgggttaggaaaacatgattgctatataattttctcagtatgcagactttctctctgagtagaatttcttatgaaacacattcaatttgggtgaataaaggcctgaagagttattttaccctccttgcctgatgtaggacagtggaattgtacagcctttatgaacctgccctttatgtgtggcagatctgattcctaactgaccaaagtaatattccagaacaaaagccacttttcttacatttaacacaatattcatatctaccacgaacatgatcatcaaaatatatgagaacttataaagagtttttgtgtgtggagcctcttccgtgtcaatattcaataaagttatagaaatgtttcaa

SEQ ID NO: 8683 - DNA, 2008 bp, Homo sapiens
aaaaaacgacctgcccagaccctcagcgtcgacgctgcgcacaagcgcagtcaactgctggacccggccggtgtgaagtttcacacccaaaaggatgaagggcacccacctggcttaagagaacgactcccagaaaattagccgggcgtggtggcgtgcacctgtaatctcagctactcgggaggctgaggcaggaaaatcgcttgcacccaggaggtggaggttgcagtgagccgagatcgcgccattacacttcagcctgggcaacaagagcaaaaaactccgtcaaaaaaaaaaaaaagaagaagaagttgtggagctgtctgattcctgatcctgtccgttcaggctggggccgccctggtctttcaaacccagcagtgagcttggacagacccagaggtgtttactccagatcatgtctactgtgaaggaagcagcacaccggctgtccaaaagtgagatgagcctctatgcagtgctggatcttaagaagggcgcctcacctgaagacttcaaaaaatcctacagccattccgcattgcttccccaccctccttttgagtatcacctgggtaggaaactggccttgcggtatcatcccgacaagaatccagggaatgctcaagcagcagaaatattcaaagagatcaacgcagctcatgccatactgagcgactctaagaagcggaaaatttacgaccagcatggctcattgggaatatatctgtatgatcactttggtgaagaaggcgtcagatactattttattctgaatagttgttggttcaagacacttgtcatcctgtgtactctgctcacttgttgctgtttctgttgttgctgctgtttttgctgtggagcacttaaaccaccacctgagcaggatagtgggagaaaatatcagcagaatgtccagagtcagcctccaaggtcaggagccaaatgtgattttagaagcgaggaaaatagcgaagatgatttttaagagatgaagaaggatgaggtgctgacccagtgagggtgccttctgctgcccagtcccctggacacattgaagagaggagcaagtagccctgtcctgacattgaccctgatttgacccctcttcttataaggatctcaagaatctcttcagaagcactgatgacgttgatcccagtaaggacatcacctctacccttggtaccacaactctgtatggggttgcccagctactcttcctttcagttgcagtcccaattttactccgtcagaaagcagccctcccctccctccccttatgaggtctcaggcagtggtggcagatttttcctgaagagtctttttcctgtgtctgccttgttattggaaccaatgccagctggtaggatccctgagccccttgcgatatcaccaccaagagcctgataactgagcagggtggatcctgtccctggagctgctgcacccattaattctcccttgttgcaactctgtgtaccaagaacccctagcatcagcctcattcctaagccaataacgcctgtatggagttggtttcatcttctggtgcccacggccattggcattgccagcctcattccatgccactatgagtcaactcaggaaaactgcgagtgcatttgaggcttaggggtagtcattccatctttagattatccttggacttcagctaccagcacagcatgcattagccttggtcctgtaggttaactgaagttcaaacatcagtgccagcttgcctccatccttttcacatattatgcaggccaattgacatataatttgttcttaaaaataggggcatgaaatatgtgatctggaaaagattgtactttctggactcttttcccactcttgcctctttgtgctgctgtttcgtatcctcctcacaccgtgtatttcccacccactcagggtcacagcctactaattcctcaaacttctctccctggactaggagaaaggctaaagaatgtcagtaaataaaagagctttcatccaa

SEQ ID NO: 8684 - DNA, 1904 bp, Homo sapiens
aagcgcagtcaactgctggacccggccggtgtgaagtttcacacccaaaaggatgaagggcacccacctggcttaagagaacgactcccaggtaaagggccagacccaggaggtggaggttgcagtgagccgagatcgcgccattacacttcagcctgggcaacaagagcaaaaaactccgtcaaaaaaaaaaaaaagaagaagaagttgtggagctgtctgattcctgatcctgtccgttcaggctggggccgccctggtctttcaaacccagcagtgagcttggacagacccagaggtgtttactccagatcatgtctactgtgaaggaagcagcacaccggctgtccaaaagtgagatgagcctctatgcagtgctggatcttaagaagggcgcctcacctgaagacttcaaaaaatcctacagccattccgcattgcttccccaccctccttttgagtatcacctgggtaggaaactggccttgcggtatcatcccgacaagaatccagggaatgctcaagcagcagaaatattcaaagagatcaacgcagctcatgccatactgagcgactctaagaagcggaaaatttacgaccagcatggctcattgggaatatatctgtatgatcactttggtgaagaaggcgtcagatactattttattctgaatagttgttggttcaagacacttgtcatcctgtgtactctgctcacttgttgctgtttctgttgttgctgctgtttttgctgtggagcacttaaaccaccacctgagcaggatagtgggagaaaatatcagcagaatgtccagagtcagcctccaaggtcaggagccaaatgtgattttagaagcgaggaaaatagcgaagatgatttttaagagatgaagaaggatgaggtgctgacccagtgagggtgccttctgctgcccagtcccctggacacattgaagagaggagcaagtagccctgtcctgacattgaccctgatttgacccctcttcttataaggatctcaagaatctcttcagaagcactgatgacgttgatcccagtaaggacatcacctctacccttggtaccacaactctgtatggggttgcccagctactcttcctttcagttgcagtcccaattttactccgtcagaaagcagccctcccctccctccccttatgaggtctcaggcagtggtggcagatttttcctgaagagtctttttcctgtgtctgccttgttattggaaccaatgccagctggtaggatccctgagccccttgcgatatcaccaccaagagcctgataactgagcagggtggatcctgtccctggagctgctgcacccattaattctcccttgttgcaactctgtgtaccaagaacccctagcatcagcctcattcctaagccaataacgcctgtatggagttggtttcatcttctggtgcccacggccattggcattgccagcctcattccatgccactatgagtcaactcaggaaaactgcgagtgcatttgaggcttaggggtagtcattccatctttagattatccttggacttcagctaccagcacagcatgcattagccttggtcctgtaggttaactgaagttcaaacatcagtgccagcttgcctccatccttttcacatattatgcaggccaattgacatataatttgttcttaaaaataggggcatgaaatatgtgatctggaaaagattgtactttctggactcttttcccactcttgcctctttgtgctgctgtttcgtatcctcctcacaccgtgtatttcccacccactcagggtcacagcctactaattcctcaaacttctctccctggactaggagaaaggctaaagaatgtcagtaaataaaagagctttcatccaa

SEQ ID NO: 8685 - DNA, 3287 bp, Homo sapiens
aaaattataaccccgcacaccgacttgcatgcaattatcatagcccgagtgctcctccgttgagagacttcgcccccgagaccgctgactgtgaatgacaaatcaaaagtcagggttgcagaatcagccggactttcctgctcatttgcagcagagggaggaagcagagaatgaaagattctgaaaataaaggagtggttattattgagtcgagaatttttgggaaaagtaacacgtggagagtcaatttttgagtggaaggagtctgaagagagggtaggaaccaacctcctactacccaccaggtgcctcatctccagacatggagcccagctatgggggaggtctctttgacatggtaaaaggaggtgcagggaggctctttagtaacctaaaggacaacttgaaagacaccctcaaagacacatcttctagagtgatacaatctgtgaccagctacacaaagggagatttagacttcacttatgttacctccagaattattgtgatgtcctttcctctggacaatgttgacataggattcaggaatcaggttgatgacattcgaagctttttggattccagacatcttgaccactacacagtatacaatctgtcacctaagtcttatcgaactgccaagtttcacagccgggtctcagaatgcagttggcccattaggcaggctcccagtctgcacaacctttttgctgtgtgtcggaatatgtataactggctactgcagaatcccaaaaatgtctgtgttgtccactgcttggatggacgggcggcatcatcaattctggttggtgctatgttcattttctgtaatctctactctactcctggcccagccattcgattgctatatgcaaagcgaccaggaattggactttcaccatcccataggagatacctgggctatatgtgtgacctactggcagacaagccctaccgccctcacttcaagcctctcacaattaagtcgatcactgtcagtccaataccctttttcaacaaacagaggaatggatgtcgcccttactgtgatgtactcattggagaaaccaaaatatattcgacttgcacagattttgaacgaatgaaagaatatcgtgtccaagatggaaaaatcttcattcccttgaacatcactgtgcaaggagacgtggttgtttccatgtatcacttgaggtcaaccattgggagccggctacaggctaaggtgaccaacacacagatattccagcttcagtttcacactggattcataccactggacacaacagttttaaagttcaccaagcctgagttagatgcatgtgatgtaccagaaaaatatcctcagctatttcaggtgacactggatgtagaactacagccccatgacaaagtaatagacttaactccaccatgggaacattactgcacaaaagatgtcaatcccagcatcctcttctcttctcaccaggaacatcaagatacgctggccttaggaggacaggctccaatagatatccctccagacaaccccaggcattacggacaaagtggtttctttgcctctctctgttggcaagatcagaaatcggagaagtcattctgtgaggaggaccacgctgccctagtgaatcaggaaagtgagcaatcagatgatgaacttctgacactttccagtccgcatggcaatgccaatggtgacaagcctcatggagtcaagaagcccagcaaaaagcagcaggagccagcagcccctccaccccctgaggatgtggaccttttgggcctggaagggtctgcaatgagtaacagcttctctccgccagcggctcctcccaccaattctgaactactgagtgacctgtttgggggtggaggtgcagctggtcccacccaggctggacagtcaggagtggaagatgtgtttcatcctagtggacctgcgtctacccagtcaacaccacgccgctctgccacctccacctctgcgtctccaaccctaagagtgggagaaggtgccacctttgacccatttggagcaccttctaaaccatcaggtcaggatttgctgggttcttttctgaacacatccagtgcttccagtgacccctttctccagccaacaagaagtccttcgcccacagtacatgcttctagtacgcctgctgtgaacattcagccagatgtttctggaggttgggactggcatgctaaaccaggaggctttggaatgggaagcaagtcagctgccaccagcccaaccggatcctcgcatggtactcccacccatcaaagcaaaccccagactctggatccttttgccgaccttgggacactaggtagttcttcctttgccagcaaacccaccacaccaactggattgggtggaggattcccgcctctcagctcgccacagaaggcgtctccccagcctatgggtggcgggtggcagcagggaggtgcctacaactggcagcagccacagcctaagcctcagcccagcatgccccactcctctccccagaaccgacccaactacaacgtgagcttctcagccatgcctgggggccagaacgaacgtgggaaaggatcaagtaatttggaagggaaacaaaaagcagctgattttgaagacctactctctggtcaaggtttcaatgctcacaaagacaaaaaggggcctcggacaatagctgagatgagaaaggaggaaatggccaaggaaatggatcctgagaaattaaagattctggaatggattgaaggcaaagaaagaaatatcagagcccttctttccacgatgcataccgtactatgggctggggagaccaagtggaaaccagttggcatggcagacctggtaacaccagagcaggtgaagaaggtgtacaggaaggctgtcctggtggtgcacccagataaagctactgggcaaccctatgaacaatacgcaaagatgattttcatggagctcaatgatgcctggtctgaatttgaaaaccaaggccaaaagcccttatattaatttatgagcttttccatctctgctgcagacctgtgctaatgcttagtgtgtgtcacaattctgaggttttcgcagatgaaccaaaaactccagtaacatgttttcagtactaaaccgttaagttactcatgaattaatttctcattgataaggaatgtggatgtttggtttctccaaagttcccaccataaaagatccaaagcatgagaggaacttctagtcagatgaccttgcagaaccaccgcattccaccctgcccttt

SEQ ID NO: 8686 - DNA, 5365 bp, Homo sapiens
gccgagctcagcccagggcggcggcttcgcctcgcccggcgaagcttctctccggtggccgctccttcttttccctcctctttgcgtcatgtcgggcacttaatttttttttttttttaattccttcttcagccctttccaccttccatctcccttttcgcttcccaggttgattattttctcttttctccgggcttgcccatgagcctcctcgggagctaccggaaaaagaccagcaacgatggttatgaatctttgcagctggtggacagtaacggggacttaagtgcgggaagcggcggggttggcggcaagcagagagtgaacgccggggcagcggcgcggagtcccgcccgacagcctccggaccgcgccagcaccatggacagctcaggtgcctcatctccagacatggagcccagctatgggggaggtctctttgacatggtaaaaggaggtgcagggaggctctttagtaacctaaaggacaacttgaaagacaccctcaaagacacatcttctagagtgatacaatctgtgaccagctacacaaagggagatttagacttcacttatgttacctccagaattattgtgatgtcctttcctctggacaatgttgacataggattcaggaatcaggttgatgacattcgaagctttttggattccagacatcttgaccactacacagtatacaatctgtcacctaagtcttatcgaactgccaagtttcacagccgggtctcagaatgcagttggcccattaggcaggctcccagtctgcacaacctttttgctgtgtgtcggaatatgtataactggctactgcagaatcccaaaaatgtctgtgttgtccactgcttggatggacgggcggcatcatcaattctggttggtgctatgttcattttctgtaatctctactctactcctggcccagccattcgattgctatatgcaaagcgaccaggaattggactttcaccatcccataggagatacctgggctatatgtgtgacctactggcagacaagccctaccgccctcacttcaagcctctcacaattaagtcgatcactgtcagtccaataccctttttcaacaaacagaggaatggatgtcgcccttactgtgatgtactcattggagaaaccaaaatatattcgacttgcacagattttgaacgaatgaaagaatatcgtgtccaagatggaaaaatcttcattcccttgaacatcactgtgcaaggagacgtggttgtttccatgtatcacttgaggtcaaccattgggagccggctacaggctaaggtgaccaacacacagatattccagcttcagtttcacactggattcataccactggacacaacagttttaaagttcaccaagcctgagttagatgcatgtgatgtaccagaaaaatatcctcagctatttcaggtgacactggatgtagaactacagccccatgacaaagtaatagacttaactccaccatgggaacattactgcacaaaagatgtcaatcccagcatcctcttctcttctcaccaggaacatcaagatacgctggccttaggaggacaggctccaatagatatccctccagacaaccccaggcattacggacaaagtggtttctttgcctctctctgttggcaagatcagaaatcggagaagtcattctgtgaggaggaccacgctgccctagtgaatcaggaaagtgagcaatcagatgatgaacttctgacactttccagtccgcatggcaatgccaatggtgacaagcctcatggagtcaagaagcccagcaaaaagcagcaggagccagcagcccctccaccccctgaggatgtggaccttttgggcctggaagggtctgcaatgagtaacagcttctctccgccagcggctcctcccaccaattctgaactactgagtgacctgtttgggggtggaggtgcagctggtcccacccaggctggacagtcaggagtggaagatgtgtttcatcctagtggacctgcgtctacccagtcaacaccacgccgctctgccacctccacctctgcgtctccaaccctaagagtgggagaaggtgccacctttgacccatttggagcaccttctaaaccatcaggtcaggatttgctgggttcttttctgaacacatccagtgcttccagtgacccctttctccagccaacaagaagtccttcgcccacagtacatgcttctagtacgcctgctgtgaacattcagccagatgtttctggaggttgggactggcatgctaaaccaggaggctttggaatgggaagcaagtcagctgccaccagcccaaccggatcctcgcatggtactcccacccatcaaagcaaaccccagactctggatccttttgccgaccttgggacactaggtagttcttcctttgccagcaaacccaccacaccaactggattgggtggaggattcccgcctctcagctcgccacagaaggcgtctccccagcctatgggtggcgggtggcagcagggaggtgcctacaactggcagcagccacagcctaagcctcagcccagcatgccccactcctctccccagaaccgacccaactacaacgtgagcttctcagccatgcctgggggccagaacgaacgtgggaaaggatcaagtaatttggaagggaaacaaaaagcagctgattttgaagacctactctctggtcaaggtttcaatgctcacaaagacaaaaaggggcctcggacaatagctgagatgagaaaggaggaaatggccaaggaaatggatcctgagaaattaaagattctggaatggattgaaggcaaagaaagaaatatcagagcccttctttccacgatgcataccgtactatgggctggggagaccaagtggaaaccagttggcatggcagacctggtaacaccagagcaggtgaagaaggtgtacaggaaggctgtcctggtggtgcacccagataaagctactgggcaaccctatgaacaatacgcaaagatgattttcatggagctcaatgatgcctggtctgaatttgaaaaccaaggccaaaagcccttatattaatttatgagcttttccatctctgctgcagacctgtgctaatgcttagtgtgtgtcacaattctgaggttttcgcagatgaaccaaaaactccagtaacatgttttcagtactaaaccgttaagttactcatgaattaatttctcattgataaggaatgtggatgtttggtttctccaaagttcccaccataaaagatccaaagcatgagaggaacttctagtcagatgaccttgcagaaccaccgcattccaccctgccctttggggagcctactcagcattctacctggggaaatggaaaacagaggccaccacccatgaaggcataacacccatcacattgtctgagaataggattaatgagcaaaagttatgataatagagttatatgatggtttaatggtttctagatttttcttggaaagatataatttgagcagtggctttatgcagactccaagaacaaaaccaccaggtatttttttttaagtaaaaatttactaaggcctttagcataatactgtaaatgtcttttggtcaagagaactaacaaatataaaggaacttgaaatgtggggagtgataatagtccagtgattaaactacagtccagtgattaccaccaactttctgactaagctaaaaatgaatgaaaatggtggctaaagaaaatagggactctgaagatgtcgaaatctttattcctggttaggaaggtgggccgctacccttctttccctttagaaaactgtgattaattaaataaaaagtcttactactataacaactctaaacctggtttaaatgaaacatctaattttgctgtaaggcttaatgctcttcttttgtttagccaagaaaacattcttagttggaaacaggtggtaaagtagtttggcctgttcacaacttatcaggaccaatatctagtgtggactcagtgttctctaggtttgtgagcagttgtggtaagagaatggaaggcaacactgaataggagttaagggaatggcacgatcacagtgagagagctgcactcacctgcagacccagtcagatggcttgtcagtatctgctctgaggaaccaggtcccacctccccacaaggcaaatctagacccattaaattattacagtgggcttttttgttttaaaagtggttggggatccacaggaacgacattcatacagggacatttgtgaaagcaaagcaagaatgaatgctttcccgatctcagactggctggattcagatcagtgtgttggctggttctcattttaaggggtaagcagtttgctattctgtgactttagtagatctcttttgtgtgcacatatacaatgtgcattatacatatatattaaatatatccacaaagcagatgggcaaaaagattttcatgctaatcttcaaaggttcatgctcaatattgtgaaaagcttttaaaagttgttttgaaaagacaatcattttttgtttttgttttaactttcttgtggcaagctataccggaaaagcggcatgtcaaaaatactttaggttctacatagatctctttctctcttttgttttgtttgtttgtttgttaaagttcattatttattttaccttttactgacaatgtgaaactcgaagaaaatgttctctttttaaatatacagtcataaactgttcaaggtaaccataacaaactaggtgttatttattaacgtattataaaataatgtttgatccagtatgtgcttgtcttatttaaaattggaatgtgagacatgttgctgtgacctgtttttctttctcattcacatttgtagatattgtgtgaactacagtatataatgataacaattaaaaggatattctgtggatgtcacgtattttgaaatgatagaactacattagctttgtatcatgtttggataattcatcaatgttcacagtttaaaacatcattaaacattatgtaattacaatgagaaagaatcttacttaaatttggagattttcccccacatctcttttccggatacattataattctggacccctatttatctcaaaactcttaatatatgcagaccaacaggtctttgcattccttttaaataactggttgtgacaaagcttgttgttgatcagattcactgtttcatcatatttattgtaatatattttttgttttgtaaatatgttacaacaaaatgtgattggtctaaaatatttgtaatgtatattaaaaggttcaaaaata

SEQ ID NO: 8687 - DNA, 5743 bp, Homo sapiens
cgcacaccgacttgcatgcaattatcatagcccgagtgctcctccgttgagagacttcgcccccgagaccgctgactgtgaatgacaaatcaaaagtcagggttgcagaatcagccggactttcctgctcatttgcagcagagggaggaagcagagaatgaaagattctgaaaataaaggtgcctcatctccagacatggagcccagctatgggggaggtctctttgacatggtaaaaggaggtgcagggaggctctttagtaacctaaaggacaacttgaaagacaccctcaaagacacatcttctagagtgatacaatctgtgaccagctacacaaagggagatttagacttcacttatgttacctccagaattattgtgatgtcctttcctctggacaatgttgacataggattcaggaatcaggttgatgacattcgaagctttttggattccagacatcttgaccactacacagtatacaatctgtcacctaagtcttatcgaactgccaagtttcacagccgggtctcagaatgcagttggcccattaggcaggctcccagtctgcacaacctttttgctgtgtgtcggaatatgtataactggctactgcagaatcccaaaaatgtctgtgttgtccactgcttggatggacgggcggcatcatcaattctggttggtgctatgttcattttctgtaatctctactctactcctggcccagccattcgattgctatatgcaaagcgaccaggaattggactttcaccatcccataggagatacctgggctatatgtgtgacctactggcagacaagccctaccgccctcacttcaagcctctcacaattaagtcgatcactgtcagtccaataccctttttcaacaaacagaggaatggatgtcgcccttactgtgatgtactcattggagaaaccaaaatatattcgacttgcacagattttgaacgaatgaaagaatatcgtgtccaagatggaaaaatcttcattcccttgaacatcactgtgcaaggagacgtggttgtttccatgtatcacttgaggtcaaccattgggagccggctacaggctaaggtgaccaacacacagatattccagcttcagtttcacactggattcataccactggacacaacagttttaaagttcaccaagcctgagttagatgcatgtgatgtaccagaaaaatatcctcagctatttcaggtgacactggatgtagaactacagccccatgacaaagtaatagacttaactccaccatgggaacattactgcacaaaagatgtcaatcccagcatcctcttctcttctcaccaggaacatcaagatacgctggccttaggaggacaggctccaatagatatccctccagacaaccccaggcattacggacaaagtggtttctttgcctctctctgttggcaagatcagaaatcggagaagtcattctgtgaggaggaccacgctgccctagtgaatcaggaaagtgagcaatcagatgatgaacttctgacactttccagtccgcatggcaatgccaatggtgacaagcctcatggagtcaagaagcccagcaaaaagcagcaggagccagcagcccctccaccccctgaggatgtggaccttttgggcctggaagggtctgcaatgagtaacagcttctctccgccagcggctcctcccaccaattctgaactactgagtgacctgtttgggggtggaggtgcagctggtcccacccaggctggacagtcaggagtggaagatgtgtttcatcctagtggacctgcgtctacccagtcaacaccacgccgctctgccacctccacctctgcgtctccaaccctaagagtgggagaaggtgccacctttgacccatttggagcaccttctaaaccatcaggtcaggatttgctgggttcttttctgaacacatccagtgcttccagtgacccctttctccagccaacaagaagtccttcgcccacagtacatgcttctagtacgcctgctgtgaacattcagccagatgtttctggaggttgggactggcatgctaaaccaggaggctttggaatgggaagcaagtcagctgccaccagcccaaccggatcctcgcatggtactcccacccatcaaagcaaaccccagactctggatccttttgccgaccttgggacactaggtagttcttcctttgccagcaaacccaccacaccaactggattgggtggaggattcccgcctctcagctcgccacagaaggcgtctccccagcctatgggtggcgggtggcagcagggaggtgcctacaactggcagcagccacagcctaagcctcagcccagcatgccccactcctctccccagaaccgacccaactacaacgtgagcttctcagccatgcctgggggccagaacgaacgtgggaaaggatcaagtaatttggaagggaaacaaaaagcagctgattttgaagacctactctctggtcaaggtttcaatgctcacaaagacaaaaaggggcctcggacaatagctgagatgagaaaggaggaaatggccaaggaaatggatcctgagaaattaaagattctggaatggattgaaggcaaagaaagaaatatcagagcccttctttccacgatgcataccgtactatgggctggggagaccaagtggaaaccagttggcatggcagacctggtaacaccagagcaggtgaagaaggtgtacaggaaggctgtcctggtggtgcacccagataaagctactgggcaaccctatgaacaatacgcaaagatgattttcatggagctcaatgatgcctggtctgaatttgaaaaccaaggccaaaagcccttatattaatttatgagcttttccatctctgctgcagacctgtgctaatgcttagtgtgtgtcacaattctgaggttttcgcagatgaaccaaaaactccagtaacatgttttcagtactaaaccgttaagttactcatgaattaatttctcattgataaggaatgtggatgtttggtttctccaaagttcccaccataaaagatccaaagcatgagaggaacttctagtcagatgaccttgcagaaccaccgcattccaccctgccctttggggagcctactcagcattctacctggggaaatggaaaacagaggccaccacccatgaaggcataacacccatcacattgtctgagaataggattaatgagcaaaagttatgataatagagttatatgatggtttaatggtttctagatttttcttggaaagatataatttgagcagtggctttatgcagactccaagaacaaaaccaccaggtatttttttttaagtaaaaatttactaaggcctttagcataatactgtaaatgtcttttggtcaagagaactaacaaatataaaggaacttgaaatgtggggagtgataatagtccagtgattaaactacagtccagtgattaccaccaactttctgactaagctaaaaatgaatgaaaatggtggctaaagaaaatagggactctgaagatgtcgaaatctttattcctggttaggaaggtgggccgctacccttctttccctttagaaaactgtgattaattaaataaaaagtcttactactataacaactctaaacctggtttaaatgaaacatctaattttgctgtaaggcttaatgctcttcttttgtttagccaagaaaacattcttagttggaaacaggtggtaaagtagtttggcctgttcacaacttatcaggaccaatatctagtgtggactcagtgttctctaggtttgtgagcagttgtggtaagagaatggaaggcaacactgaataggagttaagggaatggcacgatcacagtgagagagctgcactcacctgcagacccagtcagatggcttgtcagtatctgctctgaggaaccaggtcccacctccccacaaggcaaatctagacccattaaattattacagtgggcttttttgttttaaaagtggttggggatccacaggaacgacattcatacagggacatttgtgaaagcaaagcaagaatgaatgctttcccgatctcagactggctggattcagatcagtgtgttggctggttctcattttaaggggtaagcagtttgctattctgtgactttagtagatctcttttgtgtgcacatatacaatgtgcattatacatatatattaaatatatccacaaagcagatgggcaaaaagattttcatgctaatcttcaaaggttcatgctcaatattgtgaaaagcttttaaaagttgttttgaaaagacaatcattttttgtttttgttttaactttcttgtggcaagctataccggaaaagcggcatgtcaaaaatactttaggttctacatagatctctttctctcttttgttttgtttgtttgtttgttaaagttcattatttattttaccttttactgacaatgtgaaactcgaagaaaatgttctctttttaaatatacagtcataaactgttcaaggtaaccataacaaactaggtgttatttattaacgtattataaaataatgtttgatccagtatgtgcttgtcttatttaaaattggaatgtgagacatgttgctgtgacctgtttttctttctcattcacatttgtagatattgtgtgaactacagtatataatgataacaattaaaaggatattctgtggatgtcacgtattttgaaatgatagaactacattagctttgtatcatgtttggataattcatcaatgttcacagtttaaaacatcattaaacattatgtaattacaatgagaaagaatcttacttaaatttggagattttcccccacatctcttttccggatacattataattctggacccctatttatctcaaaactcttaatatatgcagaccaacaggtctttgcattccttttaaataactggttgtgacaaagcttgttgttgatcagattcactgtttcatcatatttattgtaatatattttttgttttgtaaatatgttacaacaaaatgtgattggtctaaaatatttgtaatgtatattaaaaggttcaaaaatatttgtataaatctaagttatttgggtacttgtaggaatacaatgaggagcttgaatgccaccttctgacatgatttacttttaaggaaagttatgaggagagaatacaaaaagcatgcaccaaaatgtaatctgacaggatttctggatttatacgtaatcactcctgccccaacacacacacacacacacacacacacacacacacacatgcacgcacacatgattttgattatgctacatgatatatgtttcaaaaagaattagcatagaaatcctggtctcctagccaaaaaaatcaaaggattttcaaaaaaacgaatctgtatgttgaggcaaaaggattgaacctggaagtctgggactttatcatagaaacaaagtctcagatattttagttctttggaaacaaatgctgtaattcaaaagcatttgacctgtcactgtactatctacatgtggaagaatgttcaagttgaatcctaatgccgtgaatgaaacacagtctgtgtagggaatgagcaaaaaagttgaattccaattgctttttggccttttggctaaaataaatgtagcatctaattttatcagttt

SEQ ID NO: 8688 - DNA, 3032 bp, Homo sapiens
atttcagtgtgcgatttcaattttccgtagcaaatgtatatatagaaaaatgttaaaatagatgtatttgaataccttaaaaaatacaagaaactggaagaaagataatattgcaaagcatctacatatatcctaggccttttgtgtacaaggttatttgtgacaattgtaaggtattatgaaggcaggtaggattatctccgttttacagatagggaagctgaggcctagaggtggaaacttgcccagtgatgtaagattcatctcccggttatgccctcctggaaagcccttcccaacatattatgttgtccatagagggaaaaatgagcaaagacagatggcttaactctggtgtgtgactaagatataggaaatttatagaggaggttctatcaatgtgccgacttactttgtgttttatgttctgagaacgattaccagccatctcaaattctgtggttgtcaaagctcccctggggttgttgctggttggcccccacttgctttgagactttgatgccagggcaggttgagaggaactgacttcagctgagtttgatcttggatctgggaaagagaaatgctttgaaaatcacggcaactctgggaagtttaaaagatattaatgtatcctggagagtttgaggctttgcagaaacttattggcagagcagaatgattctgaaaaatgctacatcagtgaggggatatttgataaggtattttctgccaactcgggtattcacttagcattgtttatcctttaagatatgtatacacatacttcctctgtgagtttaccctactaacaaagttttatccccagcctcaaccttgctttgggtctccaggcccaagtttctcaccatctcttggatgattgctccagcccactctgctgccacctgggatccaacatgttcaaacccagctgtgaacttcacagagtattaaaagaaagagcctttgcttcagcagtttatgttattaagacggaggcttgggtcatgttatctctctccaccaatgtgtaaggtgaaagtcctattaggtaagagtttttggaagacccgtgttttgtgctttttgggtttcagtatagggttttttcctacagggctagagggaaagtaccccagcatttccaaccagtggggtgcaaaattatttgggtctacagctttacctattcctttcaagaacatttttgaaaaaacacatctgttaagttgaaccatgtgtaactgctgaatgctgatgtttggccgttttctacttaaaaaaataggccagcagtttgtaaattcaagctaatatatgaactttttgaaaaagttgttcttggacactaaaaggtaagacggacgccagatttccagagcaaggggaggagagacccgagcaacatcacttccctgaagacctagctcctgcgcgcggccggggactgtgactccacatgccggcgttacttacccgggcccgcgcctgactcgccacacctcattttgcggccgccgtaaagcgcggatgcgcggcgtggccacgccccttcagtgcttgtgacgcaggcgccctgggctttttgggcgcgaaaaagaagcagtcctgggttgtacccggcgcagctgggagcggctgcttcctccggggtcgtatctccgcccggcatggggctgctggacctttgcgaggaagtgttcggcaccgccgacctttaccgggtgctgggcgtgcgacgcgaggcctccgacggcgaggtccgacgaggctaccacaaggtgtccctgcaggtacacccggaccgggtgggtgagggcgacaaggaggacgccacccgccgcttccagatcctgggaaaagtctattccgttctcagtgacagagaacagagagcagtgtacgatgagcagggaacagtggacgaggactctcctgtgctcacccaagaccgagactgggaggcgtattggcggctactctttaaaaagatatctttagaggacattcaagcttttgaaaagacatacaaaggttcggaagaagagctggctgatattaagcaggcctatctggacttcaagggtgacatggatcagatcatggagtctgtgctttgcgtgcagtacacagaggaacccaggataaggaatatcattcagcaagctattgacgccggagaggtcccatcctataatgcctttgtcaaagaatcgaaacaaaagatgaatgcaaggaaaaggagggctcaggaagaggccaaagaagcagaaatgagcagaaaggagttggggcttgatgaaggcgtggatagcctgaaggcagccattcagagcagacaaaaggatcggcaaaaggaaatggacaattttctggctcagatggaagcaaagtactgcaaatcttccaaaggaggagggaaaaaatctgctctcaagaaagaaaagaaataatggaatttttctcttcaaaggtccttaggtgtaaattgatgccatcgtaggcaaggtgcaggcaggatttgaaggcaaaagtcaattcagctcttgagaaaaggtgtctttccagcctgaatttttcagattgactagaccaagcagaatctctcaacctgatcttagtatttcctagaaagcacttgacattgtgtgaggtctcacctgaaggaacttggtggtgacatttgggagggtggagggaggcagtgtccttcctgacagcacttgcctccatggatcttctgtacacagaactcttatctaggatgtggttctgttcatgctgctttctgcgatgtgcgtgtctgttagaataggctctctacccagctagaacaccttccagacacttgctggacagctatcttccacatacttcccagtttacatttggtcttaatgatcttgaatagatcctctcttcattttactcagccaggttttgtactgatgtacaggtgttaaattacttcaagcatttttgtaagaggtgtatataattcaataaaaaaggtaaaacatgatgattaa

SEQ ID NO: 8689 - DNA, 1955 bp, Homo sapiens
cgctggccggcagcgccagcgctggaatcgcccccgcgcctgggagtggcctcgcgaggccggcgcgcgccccggggccgaggaatccgcctgcccgcccaggcgtcggccacgagagagcgggagcctcgctggtccccatttcagaggtggaggaagacctgggccgtgctctacccggccagtccccacggcgtagcgcggctcgagttctttgaccataaggggtcgagctctgggggtggccgagggagctcgcgccgcctggactgcaaagtgatccgtctggctgagtgtgtgagtgtggcccccgtcaccgtggagaccccccctgagcccggcgccactgccttccgcctggacactgctcagcgctcgcacctgctggcggccgacgcgccgtccagtgcagcctgggtgcagacgctgtgccgaaacgcctttccgaaaggcagctggactctggcgcctaccgataacccacctaagctttctgccctggagatgctggagaactccttgtacagccctacctgggaaggatcccaattctgggtaacggtgcagaggactgaggccgccgagcgctgtggcctgcatggctcctacgtgctgagggtggaggctgaaaggctgactctcctgaccgtgggggcccagagtcagatactggagccactcctgtcctggccctacactctgttgcgtcgctatggccgggacaaggtcatgttctctttcgaggccggccgccgctgcccctcaggccctggaaccttcaccttccagacggcacagggaaatgacatcttccaggcagttgagactgccatccaccggcagaaggcccagggaaaggccggacaggggcacgatgttctcagagctgactcccatgaaggggaggtggcagaggggaagttgccttccccacctggcccccaagagctcctcgacagtcccccagccctgtatgctgagcccttagactccctgcgcattgctccatgcccttcccaggactccctatactcagaccccttggacagcacgtctgctcaggcaggagagggagtacaacggaagaaacctctctattgggacttgtatgagcatgcgcagcagcagttgctgaaggccaagctgacagaccccaaagaggatcccatctatgatgaacctgagggcctggccccagtccctccccagggcctttatgatctgcctcgggagcccaaggatgcatggtggtgccaagctcgggtgaaggaggagggctatgagctcccctacaaccctgccactgatgactacgctgtgccaccccctcggagcacaaagcccctccttgctcccaagccccagggcccagccttccctgaacctggtactgcaactggcagtggcatcaaaagccacaactcagccctgtacagccaggtccagaagagcggggcctcagggagctgggactgtgggctctctagagtagggactgacaagactggggtcaagtcagagggctctacctgagaaggacggcaaggctgaggtggctaagggggaccatggggaggtggcactagggatcaaagaagatggttagaaccagcagaagccagagggtgggaggggccatgctgtgtgagaccaggggaccagagggatgggagagtcaagggaaggacaatcccaggaagtcctaagaagtggggcagatggcagggctgaggatgggctctgcatcccccaaagccatcccttccctacttccccaaatgaagggacggctgtgggaccaggtctgtggaaagtggtgcatggtcagaatgggtgcagtttgaggggcctgtgtggaggcctcagggagatgttggactgtgcctggatccttactcctgcattgttctttgccagagacctatttaaaaattttaaaattctcattaaagtca

SEQ ID NO: 8690 - DNA, 2555 bp, Homo sapiens
ctctgggtcctccctccccgtggagctggccactgccgcgccccctccccctccctggccctcccggctcgttcaatgaagctttctcttcccgcggcatggaggccaggcctctgcggtcagggagctgacatgcaagcggcggccgggcggcggggcggccccggtggtggcgggaagcggttcaaccccagccctccctccgagtcccgggccagcggagtctaaacagcccggctcgggcggggctgggggcgggcccggccagggtaaataaagccccggaggcccgtgtgggtctctccggtgcccggggcgctttcggggtgatgtcatggctttcactctgacgtcaccttgggcatatgacgtcacgcgcagccaccacgcccagaggccagggccctcgcgccaaaaccgaggactttcggtggagccactggcgcgcccccacgacggcgggtaggggcctggggtgctgcagctcccggctaatccgggggtctccaccattccttctcgctcctctccctcaccccaccgcgacccccccagcggctgccggcgggggccggggaggggcggaaactcctccagggaacccggccccgcctcccgccccgcctcccgccgcagggccaggaagcgcggaaggaaccgccgggggccatggacggagcagtgatggaagggccgctttttttgcagagtcagcgctttgggaccaagaggtggaggaagacctgggccgtgctctacccggccagtccccacggcgtagcgcggctcgagttctttgaccataaggggtcgagctctgggggtggccgagggagctcgcgccgcctggactgcaaagtgatccgtctggctgagtgtgtgagtgtggcccccgtcaccgtggagaccccccctgagcccggcgccactgccttccgcctggacactgctcagcgctcgcacctgctggcggccgacgcgccgtccagtgcagcctgggtgcagacgctgtgccgaaacgcctttccgaaaggcagctggactctggcgcctaccgataacccacctaagctttctgccctggagatgctggagaactccttgtacagccctacctgggaaggatcccaattctgggtaacggtgcagaggactgaggccgccgagcgctgtggcctgcatggctcctacgtgctgagggtggaggctgaaaggctgactctcctgaccgtgggggcccagagtcagatactggagccactcctgtcctggccctacactctgttgcgtcgctatggccgggacaaggtcatgttctctttcgaggccggccgccgctgcccctcaggccctggaaccttcaccttccagacggcacagggaaatgacatcttccaggcagttgagactgccatccaccggcagaaggcccagggaaaggccggacaggggcacgatgttctcagagctgactcccatgaaggggaggtggcagaggggaagttgccttccccacctggcccccaagagctcctcgacagtcccccagccctgtatgctgagcccttagactccctgcgcattgctccatgcccttcccaggactccctatactcagaccccttggacagcacgtctgctcaggcaggagagggagtacaacggaagaaacctctctattgggacttgtatgagcatgcgcagcagcagttgctgaaggccaagctgacagaccccaaagaggatcccatctatgatgaacctgagggcctggccccagtccctccccagggcctttatgatctgcctcgggagcccaaggatgcatggtggtgccaagctcgggtgaaggaggagggctatgagctcccctacaaccctgccactgatgactacgctgtgccaccccctcggagcacaaagcccctccttgctcccaagccccagggcccagccttccctgaacctggtactgcaactggcagtggcatcaaaagccacaactcagccctgtacagccaggtccagaagagcggggcctcagggagctgggactgtgggctctctagagtagggactgacaagactggggtcaagtcagagggctctacctgagaaggacggcaaggctgaggtggctaagggggaccatggggaggtggcactagggatcaaagaagatggttagaaccagcagaagccagagggtgggaggggccatgctgtgtgagaccaggggaccagagggatgggagagtcaagggaaggacaatcccaggaagtcctaagaagtggggcagatggcagggctgaggatgggctctgcatcccccaaagccatcccttccctacttccccaaatgaagggacggctgtgggaccaggtctgtggaaagtggtgcatggtcagaatgggtgcagtttgaggggcctgtgtggaggcctcagggagatgttggactgtgcctggatccttactcctgcattgttctttgccagagacctatttaaaaattttaaaattctcattaaagtcagcttgggtttaagaagtt

SEQ ID NO: 8691 - DNA, 1936 bp, Homo sapiens
ctaactcactggaaatgcaggaagcttgagtataaaactcactcagaaaaaaaaaaaaaaaagaaaaaaaagaacacacactcagaagaaaccgcagggcctatcagcctgtcgtcatcgagcagactagaatagtatagaaaaccctaggcagagaggaaatgaacttcagagaagggaaacacacggctaagaagagagaggcaagggcaggagtgaaggagagagctgaagcctggggctccgagatggtcagaggatgggagacggggcagtgaaacaaggcttcttgtatcttcagcagcagcagacgtttggaaagaaatggcgccgcttcggcgcctcactgtatggagggtcggactgcgccttggcccggctggagctgcaggagggcccggagaagcctcgtcggtgtgaggctgcccggaaggtcatccgcctcagtgactgcctgcgggtggccgaggccggcggagaggccagcagcccccgggacaccagtgccttcttcctggagaccaaggagcgcctgtacctcctggcggcccctgcagcggagcgcggcgactgggtgcaggccatctgcctcctggccttccccgggcagaggaaggagctctcggggccagagggaaagcagagccggccctgcatggaggaaaatgaattgtacagcagcgcagtcacagtcggcccccacaaggaatttgctgtgaccatgagacctacagaagccagtgagaggtgccacctgcgggggtcctataccctccgggctggggagagtgccctggagctgtggggtgggcccgagccagggacccagctgtacgactggccctacaggtttctgcggcgctttgggcgggacaaggtaaccttttcctttgaggcaggccgtcgctgcgtctctggagagggcaactttgagttcgaaacccggcaaggcaatgagatcttcttggccctggaagaggccatctctgcccagaagaatgctgcacccgctacaccccaaccgcagccagccacaatccccgcgtcgctgccccggcctgatagcccctactctcggccgcatgactcactgccgccgccttcacccaccacaccggtgcctgctccacggcctcggggccaggagggggagtatgccgtgcccttcgatgcggtggcccgttccttggggaagaacttcaggggcatcttggcagtccctcctcagctcctggccgaccctctgtacgacagcattgaggagaccctgccccctcgacctgaccacatatacgatgagcccgagggagtggctgccctgtccctctatgacagcccgcaggagccccggggtgaggcatggaggaggcaggcgacagctgacagggaccctgctggcctccagcatgtccagccagccgggcaggatttctctgcttctggctggcagccaggaactgagtatgacaatgttgtactaaagaaaggcccaaagtgacagaggcagcagagggatggtccaccgccccttggcttctgctggtgactcctcctggccactgcatcagaagaacctcctctgccccttctggagcccgaggcctggcctgtcttcgttggggctgataaattgcctctcccagggcctgctgggtgagtcaccatcccaaagcaggaagggtgccctggagagaaccaccctcctcctactctttttccacttcctcctctttctttccccagctgaggaggaacctggggcatttagggcagaggacaaaaggatgtcagcaattgcttgggctgcttggctatgcaagcctcctgcctgctgatggccacttcagggacagcctgggcccaggcacccagggggatggcggcagcttcctgcacctttcagatttcttggtggcattaaagcattttcagaaca

SEQ ID NO: 8692 - DNA, 1677 bp, Homo sapiens
agagaagggaaacacacggctaagaagagagaggcaagggcaggagtgaaggagagagctgaagcctggggctccgagatggtcagaggatgggagacggggcagtgaaacaaggcttcttgtatcttcagcagcagcagacgtttggaaagaaatggcgccgcttcggcgcctcactgtatggagggtcggactgcgccttggcccggctggagctgcaggagggcccggagaagcctcgtcggtgtgaggctgcccggaaggtcatccgcctcagtgactgcctgcgggtggccgaggccggcggagaggccagcagcccccgggacaccagtgccttcttcctggagaccaaggagcgcctgtacctcctggcggcccctgcagcggagcgcggcgactgggtgcaggccatctgcctcctggccttcccctcggcccccacaaggaatttgctgtgaccatgagacctacagaagccagtgagaggtgccacctgcgggggtcctataccctccgggctggggagagtgccctggagctgtggggtgggcccgagccagggacccagctgtacgactggccctacaggtttctgcggcgctttgggcgggacaaggtaaccttttcctttgaggcaggccgtcgctgcgtctctggagagggcaactttgagttcgaaacccggcaaggcaatgagatcttcttggccctggaagaggccatctctgcccagaagaatgctgcacccgctacaccccaaccgcagccagccacaatccccgcgtcgctgccccggcctgatagcccctactctcggccgcatgactcactgccgccgccttcacccaccacaccggtgcctgctccacggcctcggggccaggagggggagtatgccgtgcccttcgatgcggtggcccgttccttggggaagaacttcaggggcatcttggcagtccctcctcagctcctggccgaccctctgtacgacagcattgaggagaccctgccccctcgacctgaccacatatacgatgagcccgagggagtggctgccctgtccctctatgacagcccgcaggagccccggggtgaggcatggaggaggcaggcgacagctgacagggaccctgctggcctccagcatgtccagccagccgggcaggatttctctgcttctggctggcagccaggaactgagtatgacaatgttgtactaaagaaaggcccaaagtgacagaggcagcagagggatggtccaccgccccttggcttctgctggtgactcctcctggccactgcatcagaagaacctcctctgccccttctggagcccgaggcctggcctgtcttcgttggggctgataaattgcctctcccagggcctgctgggtgagtcaccatcccaaagcaggaagggtgccctggagagaaccaccctcctcctactctttttccacttcctcctctttctttccccagctgaggaggaacctggggcatttagggcagaggacaaaaggatgtcagcaattgcttgggctgcttggctatgcaagcctcctgcctgctgatggccacttcagggacagcctgggcccaggcacccagggggatggcggcagcttcctgcacctttcagatttcttggtggcattaaagcattttcagaac

SEQ ID NO: 8693 - DNA, 2292 bp, Homo sapiens
cccatgtggactggatgcccagcgtgagtgtataccgtgagggcctttgagctctcggacagcgtggagtggtcaagggaggcctccaggaggaagaggtggccaaccgccccaggcagcacagtggtcttgaagcggcggccctgctcctggccgtgaccatggaccctctggagacccctatcaaggatggcatcctctaccagcagcatgtcaagtttggcaagaagtgctggcggaaggtgtgggctctgctgtatgcaggaggcccatcaggcgtggcacggctggagagctgggaggtccgggatggtggcctgggagcagcgggtgacaggtcggcagggcctggccggcgaggggagcgacgggtcatccgcctggctgactgtgtgtccgtgctgccggctgacggcgagagctgcccccgggacaccggtgccttcctgctcaccaccaccgagcgaagccatctactggctgctcagcaccgccaggcctggatgggccccatctgccagctggccttcccggggacaggggaggcctcctcaggatccacagatgcccagtctcccaagaggggcctggtccccatggaggaaaactccatctactcctcctggcaggaagtgggcgagtttcccgtggtggtgcagaggactgaggccgccacccgctgccagctgaaggggccggccctgctggtgctgggcccagacgccatccagctgagggaggccaagggcacccaggccctctacagctggccctaccacttcctgcgcaagttcggctccgacaagatacttctgggaaccccaggcgtcagtctcctcatctgtaaaggagagagaaccgatgacgtatcaggcataatccttgatgagagtttgctgcgtgcctactcagtgccaggcgctgggggacacagccgtgttcaggacagccttggtcctgttctccgggagccgacattccagggggagagaagtttcctgaagacttccatgctgcgttccctcctctgctcctgctcctggcgccatcctaggagccagccacgcacgcaagcgtcatgcctccagggctctgactgcccagcccctcaccgcaactccacctcagctgcacacacccttggcacatcctgaacctcattttcatgacggacacacaatttttgctctctcctgtccaagcctcatcctctggccgccacctccttccagctcacttcctttagtgcggccagtaccgcccctgcctaggcatgtcgacctgcagggacccttttctggctcttcgaggcctctgcccaccatcccctctttgttctccatagtcccttccccctgttctctctcgtttcatcttactggtctggcaaagtccccggccttgggcgagcccagacctcctcagtgcctgcacacagctgcccacagccagagaaatccatttaagcagactgcctgcatccttcttaacagtgcaaggcaggcactccctgccacaagagaccctgttccctagtagggcagcttttctcctccccagaacctcctgtctatccccacccaatgtctcctcacaggcatattggggaaacaggtcgggctctcccaccgtatctgcaagtgtactggcatccatctgtcttcttcctacccctacagtagaaacagtgtctgtccccagctgtgctctgatcccggctcctttcacctcagagcttggaaaattgagctgtccccactctctcctgcgcccattcatcctaccagcagcttttccagccacacgcaaacatgctctgtaatttcacattttaaaccttcccttgacctcacattcctcttcggccacctctgtttctctgttcctcttcacagcaaaaactgttcaaaagagttgttgattactttcatttccactttctcacccccattctcccctcaattaactctccttcatccccatgatgccattatgtggcttttattagagtcaccaaccttattctccaaaacaaaagcaacaaggactttgacttctcagcagcactcggctctggttcttgaaacacccccgttacttgctattcctcctacctcataacaatctccttcccagcctctactgctgccttctctgagttcttcccagggtcctaggctcagatgtagtgtagctcaaccctgctacacaaagaatctcctgaaagcctgtaaaaatgtccatgcatgttctgtgagtgatctaccaagaaaataaaaaattttaaaaatc

SEQ ID NO: 8694 - DNA, 1729 bp, Homo sapiens
aactcatgactcggggagccagactgcgatcagacgcgcgtgcccagctgaaccagctgtctctagacggagggacgggaagtggccagaaggggaagtgtgaggagttcccgtccagcctgtcatcagtctccccaggtcttgaagcggcggccctgctcctggccgtgaccatggaccctctggagacccctatcaaggatggcatcctctaccagcagcatgtcaagtttggcaagaagtgctggcggaaggtgtgggctctgctgtatgcaggaggcccatcaggcgtggcacggctggagagctgggaggtccgggatggtggcctgggagcagcgggtgacaggtcggcagggcctggccggcgaggggagcgacgggtcatccgcctggctgactgtgtgtccgtgctgccggctgacggcgagagctgcccccgggacaccggtgccttcctgctcaccaccaccgagcgaagccatctactggctgctcagcaccgccaggcctggatgggccccatctgccagctggccttcccggggacaggggaggcctcctcaggatccacagatgcccagtctcccaagaggggcctggtccccatggaggaaaactccatctactcctcctggcaggaagtgggcgagtttcccgtggtggtgcagaggactgaggccgccacccgctgccagctgaaggggccggccctgctggtgctgggcccagacgccatccagctgagggaggccaagggcacccaggccctctacagctggccctaccacttcctgcgcaagttcggctccgacaagggcgtgttctcctttgaggccggccgtcgctgccactcgggtgagggcctctttgccttcagcaccccctgtgcccctgacctgtgcagggctgtggccggggccatcgcccgccagcgggagcggctgccagagctgaccaggccccagccctgccccctgccacgggccacctctctgccctccctggacacccccggagagcttcgggagatgccaccaggacctgagccacccacgtccaggaaaatgcacctggccgagcccggaccccagagcctgccgctactgctaggcccggagcccaacgatctggcgtccgggctctacgcttcagtgtgcaagcgtgccagtgggcccccaggcaatgagcacctctatgagaacctgtgtgtgctggaggccagccccacgctgcacggtggggaacctgagccgcacgagggccccggcagccgcagccccacaaccagtcccatctaccacaacggccaggacttgagctggcccggcccggccaacgacagtaccctggaggcccagtaccggcggctgctggagctggatcaggtggagggcacaggccgccctgaccctcaggcaggtttcaaggccaagctggtgaccctgctgagtcgtgagcggaggaagggcccagccccttgtgaccggccctgaacgcccagcagagtggtggccagaggggagaggtgctccccctgggacaggagggtgggctggtgggcaaacattgggcccatgcagacacacgcctgtgtccaccctggcctgcaggaacaaggcaggccgcctgtggaggacctcagccctgccctgccctcctcatgaatagtgtgcagactcacagataataaagctcagagcagctcccggcaggggcactcacggca

SEQ ID NO: 8695 - DNA, 1884 bp, Homo sapiens
atgtggactggatgcccagcgtgagtgtataccgtgagggcctttgagctctcggacagcgtggagtggtcaagggaggcctccaggaggaagaggtggccaaccgccccaggcagcacagtgctgtctctagacggagggacgggaagtggccagaaggggaagtgtgaggagttcccgtccagcctgtcatcagtctccccaggtcttgaagcggcggccctgctcctggccgtgaccatggaccctctggagacccctatcaaggatggcatcctctaccagcagcatgtcaagtttggcaaggggacaggggaggcctcctcaggatccacagatgcccagtctcccaagaggggcctggtccccatggaggaaaactccatctactcctcctggcaggaagtgggcgagtttcccgtggtggtgcagaggactgaggccgccacccgctgccagctgaaggggccggccctgctggtgctgggcccagacgccatccagctgagggaggccaagggcacccaggccctctacagctggccctaccacttcctgcgcaagttcggctccgacaagatacttctgggaaccccaggcgtcagtctcctcatctgtaaaggagagagaaccgatgacgtatcaggcataatccttgatgagagtttgctgcgtgcctactcagtgccaggcgctgggggacacagccgtgttcaggacagccttggtcctgttctccgggagccgacattccagggggagagaagtttcctgaagacttccatgctgcgttccctcctctgctcctgctcctggcgccatcctaggagccagccacgcacgcaagcgtcatgcctccagggctctgactgcccagcccctcaccgcaactccacctcagctgcacacacccttggcacatcctgaacctcattttcatgacggacacacaatttttgctctctcctgtccaagcctcatcctctggccgccacctccttccagctcacttcctttagtgcggccagtaccgcccctgcctaggcatgtcgacctgcagggacccttttctggctcttcgaggcctctgcccaccatcccctctttgttctccatagtcccttccccctgttctctctcgtttcatcttactggtctggcaaagtccccggccttgggcgagcccagacctcctcagtgcctgcacacagctgcccacagccagagaaatccatttaagcagactgcctgcatccttcttaacagtgcaaggcaggcactccctgccacaagagaccctgttccctagtagggcagcttttctcctccccagaacctcctgtctatccccacccaatgtctcctcacaggcatattggggaaacaggtcgggctctcccaccgtatctgcaagtgtactggcatccatctgtcttcttcctacccctacagtagaaacagtgtctgtccccagctgtgctctgatcccggctcctttcacctcagagcttggaaaattgagctgtccccactctctcctgcgcccattcatcctaccagcagcttttccagccacacgcaaacatgctctgtaatttcacattttaaaccttcccttgacctcacattcctcttcggccacctctgtttctctgttcctcttcacagcaaaaactgttcaaaagagttgttgattactttcatttccactttctcacccccattctcccctcaattaactctccttcatccccatgatgccattatgtggcttttattagagtcaccaaccttattctccaaaacaaaagcaacaaggactttgacttctcagcagcactcggctctggttcttgaaacacccccgttacttgctattcctcc

SEQ ID NO: 8696 - DNA, 545 bp, Homo sapiens
agacgcgcgtgcccagctgaaccaggtgcgtgagaaggctgccttcaggtggccgggggctccctccagtctccccaggtcttgaagcggcggccctgctcctggccgtgaccatggaccctctggagacccctatcaaggatggcatcctctaccagcagcatgtcaagtttggcaagaagtgctggcggaaggtgtgggctctgctgtatgcaggaggcccatcaggcgtggcacggctggagagctgggaggtccgggatggtggcctgggagcagcgggtgacaggtcggcagggcctggccggcgaggggagcgacgggtcatccgcctggctgactgtgtgtccgtgctgccggctgacggcgagagctgcccccgggacaccggtgccttcctgctcaccaccaccgagcgaagccatctactggctgctcagcaccgccaggcctggatgggccccatctgccagctggccttcccggggacaggggaggcctcctcaggatccacagatgcccagtctcccaagaggggcctggtc

SEQ ID NO: 8697 - DNA, 577 bp, Homo sapiens
atcagacgcgcgtgcccagctgaaccaggtgcgtgagaaggctgccttcaggtggccgggggctccctccaggtcttgaagcggcggccctgctcctggccgtgaccatggaccctctggagacccctatcaaggatggcatcctctaccagcagcatgtcaagtttggcaagaagtgctggcggaaggtgtgggctctgctgtatgcaggaggcccatcaggcgtggcacggctggagagctgggaggtccgggatggtggcctgggagcagcgggtgacaggtcggcagggcctggccggcgaggggagcgacgggtcatccgcctggctgactgtgtgtccgtgctgccggctgacggcgagagctgcccccgggacaccggtgccttcctgctcaccaccaccgagcgaagccatctactggctgctcagcaccgccaggcctggatgggccccatctgccagctggccttcccggggacaggggaggcctcctcaggatccacagatgcccagtctcccaagaggggcctggtccccatggaggaaaactccatctactcctcctggcagga

SEQ ID NO: 8698 - DNA, 603 bp, Homo sapiens
actcttcctgtcagggctgtgatgtttcagggacttctcctgaagccccttgggaggctgcttcttgcctcaggacccccacccactgcctgcctgtgccagccacctggagggagccctccattccgttgactgaggaggcagcagatgtcatagaactgccatttaggccacaagctctccctaagcctgctctgtgcccagctctgctgagctgtgaggacctagatgggccagggagatggctgcctgggaagccgtcaggcgaggggagagaaagacgcacacgcagaaacgtggacggcagtcacaagaccgctagcagatgaggcaggatctcagcatctggtgagagctgtctctagacggagggacgggaagtggccagaaggggaagtgtgaggagttcccgtccagcctgtcatcagtctccccaggtcttgaagcggcggccctgctcctggccgtgaccatggaccctctggagacccctatcaaggatggcatcctctaccagcagcatgtcaagtttggcaagaagtgctggcggaaggtgtgggctctgctgtatgcaggaggcccatcaggcgtggcacggctgga

SEQ ID NO: 8699 - DNA, 721 bp, Homo sapiens
cggggagccagactgcgatcagacgcgcgtgcccagctgaaccaggtcttgaagcggcggccctgctcctggccgtgaccatggaccctctggagacccctatcaaggatggcatcctctaccagcagcatgtcaagtttggcaagaagtgctggcggaaggtgtgggctctgctgtatgcaggaggcccatcaggcgtggcacggctggagagctgggaggtccgggatggtggcctgggagcagcgggtgacaggtcggcagggcctggccggcgaggggagcgacgggtcatccgcctggctgactgtgtgtccgtgctgccggctgacggcgagagctgcccccgggacaccggtgccttcctgctcaccaccaccgagcgaagccatctactggctgctcagcaccgccaggcctggatgggccccatctgccagctggccttcccggggacaggggaggcctcctcaggatccacagatgcccagtctcccaagaggggcctggtccccatggaggaaaactccatctactcctcctggcaggaagtgggcgagtttcccgtggtggtgcagaggactgaggccgccacccgctgccagctgaaggggccggccctgctggtgctgggcccagacgccatccagctgagggaggccaagggcacccaggccctctacagctggccctaccacttcctgcgcaagttcggctccga

SEQ ID NO: 8700 - DNA, 543 bp, Homo sapiens
ctgtcagggctgtgatgtttcagggacttctcctgaagccccttgggaggctgcttcttgcctcaggacccccacccactgcctgcctgtgccagccacctggagggagccctccattccgttgactgaggaggcagcagatgtcatagaactgccatttaggccacaagctctccctaagcctgctctgtgcccagctctgctgagctgtgaggacctagatgggccagggagatggctgcctgggaagccgtcaggcgaggggagagaaagacgcacacgcagaaacgtggacggcagtcacaagaccgctagcagatgaggcaggatctcagcatctggtgagagaggtggtgctgaatgacctgaggctgttccagaataaagctgtctctagacggagggacgggaagtggccagaaggggaagtgtgaggagttcccgtccagcctgtcatcagtctccccaggtcttgaagcggcggccctgctcctggccgtgaccatggaccctctggagacccctatcaaggatggcatcctc

SEQ ID NO: 8701 - DNA, 467 bp, Homo sapiens
atgactcggggagccagactgcgatcagacgcgcgtgcccagctgaaccaggtgcgtgagaaggctgccttcaggtggccgggggctccctccagctgtctctagacggagggacgggaagtggccagaaggggaagtgtgaggagttcccgtccagcctgtcatcagtctccccaggtcttgaagcggcggccctgctcctggccgtgaccatggaccctctggagacccctatcaaggatggcatcctctaccagcagcatgtcaagtttggcaagaagtgctggcggaaggtgtgggctctgctgtatgcaggaggcccatcaggcgtggcacggctggagagctgggaggtccgggatggtggcctgggagcagcgggtgacaggtcggcagggcctggccggcgaggggagcgacgggtcatccgcctggctgactgtgtgtccgtgctgccggctgacggc

SEQ ID NO: 8702 - DNA, 2803 bp, Homo sapiens
gtcccagccggagccccagccggagcccgatccctagccctgcggccgcgcctccctcgccgtccccgcctggagcccggcgccgccgccgccctgccgcccccgccagccgcgccgtgacgcgggcatgagcctgctccgcggcgccgctgagcaggcgctcctggcccgggcctcggcgcccagcaggcgcggggcgaaggagctgctagaacaatgctgaggcgggtgaggtgaggagcagcccctcgcggcagccccgacagagtgtctggaacaggtgattggaggagccggagacccaggcacctgggcatccttcccctcgcctctgccaggccccgcgcccctaaaaggtgggaaaaccatggcgaccaatttcagtgacatcgtcaagcaaggctacgtgaagatgaagagcaggaagctcgggatctaccggaggtgctggctggtgttccggaaatcctccagcaaggggccccagcggctggagaagtatccagatgagaagtcggtgtgcctccggggctgccccaaggtgactgagatcagcaacgtcaagtgtgttacgcggctccccaaggagaccaagcggcaggcggtggccatcatattcactgatgactcggcacgtaccttcacctgcgactcagagctagaggcagaggagtggtacaagacactatctgtggagtgtctggggtcccgcctcaacgacatcagtctgggagaacctgacctcctggccccaggggtgcagtgtgaacagacagatcgcttcaatgtcttcctgctgccctgccccaacctggacgtgtatggcgagtgcaagctgcagatcacccacgagaacatctacctctgggacatccacaacccccgtgtgaagctcgtctcgtggcccctctgctcactgcgccgctatggccgggatgccacacgctttaccttcgaggctggccggatgtgtgatgctggggaaggactctataccttccagacacaagagggggagcagatttaccagcgcgtccacagtgccaccctggccatcgcagagcagcacaagcgggtcctgctggaaatggagaagaacgtgaggctgctgaacaagggcacggaacattactcgtatccctgcacacccacgaccatgctgccgcgcagtgcctactggcaccacatcactggttcccagaacatcgccgaagcctccagctatgctggtgaggggtatggggcagcccaggccagctcggaaacagacctcctcaacagattcatcctgctaaagccaaagcccagccagggggacagcagtgaggccaagaccccatcccagtgaccacagtgctggcgagcaccgatgactgctgggggctgcctgctgcggggctggctgcagtgtaccgtggacagcctcagggggctgtcggccaagagcctggagaaagggagcaagctgccccctccttgcccccaaggatgaggctggactgaggcaaagggctggccacaccacctgagcatgtgtgaggggttggagctaccgtgggactatatactgttaatgattttaatatatatggcttatgacatactctgtatcaatgagatcccctcaccctcaccccatccttccccaccaatacacacaaattttttaatcccatgaccaggccacggtcaaggctgtttttgagtatgagtgcagtcgtgtccatcctccatggcacagccctcctgctgccaggacctgcttgaactaccagggccacaggagggggataatcagagcttgaggctggcactctgactgctggcttttcccagacagcccaagggccggaacagcaggtggcttctcagttcctctgggcctggagtgacacaggaaggatctgcacttcctctgtgctgcttgccagccttgcagttggagttttaagcagaggtgacatctggttgacgcctcaggtgaaaatctggttttaaaatgtaacttctgcacaggctccttcctgctttgtaggctgggaagatgcccctggggtaggggtgctgattacctcagccatgtggaggaaggctggagcttgttcctgccccaggaataggccaggagggaaggccgcagcaggactgccgtggggagcacccctgctgcccccctctcactgaccaggggtggacaatgcccaagcagagggagcccccttgccctgtttggccaccctctggccagccaaaagcactctgaaaccaagaccttcccatttcctcctccccacatggtgctgaggctccctgctgcaatgcaattaaagcaattgattttctagtgctggtatttgttgactaccatgcagaagggctatctttctattcacgtcaaacttttggttgtgtggggttttttgttgttttttgggttttgttttttaatactttagggtcctgatttgtgggaacagaccttcttgtaaataaccactatttgagttgtggcaggaggatgataaagcacgcggcccctcccaaaggagcccttgagctagggaggtggtgcagtcagcctcgctctcaacgtgacccggggaatgaccacccagagggatgagctagcctgtagaggggaactggggtccaaaggtctttggggagggaggcagagctggctggctcagctaagtggcacgatgacgcatgaaggagattatgttgtgctctttattgccaaaaataaacacttttaaaaagacaacttctgttaatcaataaatatcctttcctttctgta

SEQ ID NO: 8703 - DNA, 1963 bp, Homo sapiens
ttctcctccttctcggccgggaggaggcagggctggatccctcagccgccgccgctcctcctcctggcaggccggccgcggagtcagctgacgccggcgctccagcctcgcctccccgcgccgcgctctgcgctccccgaaagtggctgcaagccggccgcccactgtcagggttggggggacagagaaagtgatgtgcgccttctaaagcctcgcccagcgccgccgaagcagcttcacctctccaactttctcccaccgactgcttgtcttgaccctgccctccaccctccccagagccacttcgggtgcgcgctcttgggtaaagggggggtcaccggctgtctgggatggcttccaattttaatgacatagtgaagcaagggtacgtgaggatccggagcagacgcctcgggatttatcagcgatgctggttagtattcaagaaagcttcaagcaaaggtccaaaaagactggagaaattttctgatgaacgtgctgcatatttcaggtgttatcataaggttacagaactcaataatgtgaagaacgtagctcgattgccaaaaagcaccaagaaacatgccatagggatttatttcaatgacgatacctccaagacttttgcttgcgaatcagatcttgaggctgatgagtggtgcaaagtactccagatggagtgtgtaggaacacggatcaatgacatcagccttggagagcctgacttactggccactggggttgagagagaacagagtgagagattcaatgtgtatttgatgccatctcctaacttagatgtacatggcgaatgtgccttgcagattacatatgagtatatctgtctttgggacgtccagaatcccagagtcaaactcatctcttggccgctaagcgccctgcggcggtatggacgtgatactacgtggttcacttttgaggcagggaggatgtgtgagactggtgaagggctgtttatctttcagacccgagacggggaggccatctatcagaaagtccactctgctgccttggccatagccgagcagcacgagcgcttgctacagagtgtgaaaaactcgatgctccagatgaagatgagtgagcgggccgcctcgctgagcaccatggtgcccctgcctcgcagcgcctactggcagcacatcacacggcagcacagcacgggacagctctaccgcttgcaagatgtttccagccctctgaagcttcatcgaacagagacttttccagcctacagatctgagcactgacagtaactgccaagaattgttaacacacttgtgatgtgtcagccacagattcacccaggaggtcacagaatgacagcaagggaaatgacgaccaagagaagaagcttaaagtcctggctaattgtgtggtcattggaaaactctgcaatacaataattttctttattttctttttcttttttaaattcttagtgtaattgaaacgtgctctatagatattgactctgtgttccctcttttacagctggacagaaagaagtcaatgtcacgaaatgattttctattgtagatactttgtcccttgcacttctctgaatctgtccttttgtggattcttgtgattttccttccaagtgtttcagttgtatgacagtcagtattgacaataaaatggcttttaattatttgttatttgtttacaccctattcctcagttattattactgtggttctgattaactactggaaattatatttgattatatcaccaattagttaaatcagtgcttcgactcactcttatctgttctgttcaaaactatttgttcaaagaacccgttagtgttgtttacagggttacagtttctctcacatgctttcctcacccctttacccccctttttgaaagcctttattttgttcggagtctcttcataaaacatttgaaaataaaagatcattcttcacccata

SEQ ID NO: 8704 - DNA, 2562 bp, Homo sapiens
attttgaaagtgaccctgggctggggcgccggggcgagcgcggcggcgcggaaccatgacagaagatgaccgaggcggcgctggtggagggccaggtcaagctgcgggacggcaagaagtggaagagtaggtggctggtgctgcggaagccgtcgcccgtggcagactgcctgctgatgctggtctacaaggacaagtcggagcgtatcaagggcctgcgggagcgcagcagcctgacgctagaggacatctgcgggctggagcccggcctgccctacgagggcttggtccacacgctggccattgtctgcctgtcccaggccatcatgctgggctttgacagccacgaggccatgtgtgcgtgggatgcccggatccgctatgcgctcggcgaggtgcataggttccatgtgacagtggctccaggcaccaagttggagagcggcccggctaccctgcacctctgcaatgatgtcctcgtcttggccagggacatccccccggctgtcacggggcagtggaagctgtctgacctccggcgctacggggccgtgccaagcggattcatctttgaaggcgggaccaggtgtgggtactgggctggcgtcttcttcctgtcctcggccgagggggagcagatcagcttcctgttcgactgcatcgtccgaggcatctcccccaccaagggcccctttgggctgcggccggttctaccagacccaagtcccccgggaccctcgactgtggaggagcgtgtggcccaggaagccctggaaaccctacagctggagaagcggctgagcctcctctcacatgcgggcaggccgggcagtggaggggatgaccgcagcctgtccagctcatcctcagaggccagtcacttggacgtcagcgccagcagccggctcaccgcatggccagagcaatcctcgtcgtcagccagcacgtcacaggaggggcctagaccagcagctgcccaggccgccggggaagccatggtgggtgcctcaaggccaccccccaagccgctgcgtccgcggcagctgcaggaggttggccgccagagctcctcggacagcggcatcgccactggcagccactcctcttactccagcagcctctcgtcctacgcgggcagcagcctggacgtgtggcgggccacagatgaactgggctcactgctcagcctgccagcagcgggggcccccgagcccagcctgtgcacctgcctgcccgggacagtcgagtaccaggtgcccacctccctgcgggcccactatgacacaccacgcagcctttgcctggctcctagagaccacagccccccctcacagggcagccccggcaacagtgcggccagggactcaggcggccagacgtccgccgggtgtccctctggctggctgggcacgagacggcggggcctggtgatggaggccccccagggcagcgaggccacactgcctggccctgcccctggcgagccctgggaagcaggcggcccccacgcggggccacccccggctttcttttcggcatgtccagtctgtggaggactcaaggtaaacccccctccttgagagccgcagatcccgccccgcggctgcaaaggggctgaatttgcccccagatggcagaggaagtggcgccagcctccttgcagactggtgctctgtgttctgtgggagggaccgggggtctcccggagaggggagctggagggcgcgccctgtggctgccaccggaggaaggggctgacttggggaggtgagttctggaaggcaggggctctgggtccggcaggtcggggtcaccagagccccaatgctcagctgcttcactccgtgtcccccacccctgaggatcaggtgagtgctgcacctctgttggctcgtgccttgcactggggtgccaagggctggaggccctgccgctggccttgtcctccttgggcctcacgcccccttcgggggtggccggttctccccatcacctctctggggcagtcacaccacctgttaagcatcaagctaccacagaggctccggccacctgggctccaccagcccagcccccctgggctccgtgtgcgctgggcctcatccccatctatgggaggaaactgaagctcaggaggctgtgtggcttgcggggtctctgggttctgggccccactgttccccagtgaagcccttgtgggaaggttccgggagcaggtggtgtcctcagagcagcctcgcctgctgaccccactgggagaggcgccgtgcctcgggcccctggtgggagctctgctggctcctgtctgaacctcctcgcagggccaaaggctggcttggcctgtgtttcccctggcccaggcctcagcccctgcgtcggaggtggggctgtgttgggcccattgtcccccgccctgggtggcttcctcttgcacagcctggagcctgccctgaccacagcccagcagctccctgtgaacacctctttgtcccttcactgtcagctgtttctaaacccagacactgtttgtaatagactggaaataaaatgttctttccttac

SEQ ID NO: 8705 - DNA, 1897 bp, Homo sapiens
gagctattttgaaagtgaccctgggctggggcgccggggcgagcgcggcggcgcggaaccatgacagaagatgaccgaggcggcgctggtggagggccaggtcaagctgcgggacggcaagaagtggaagagtaggtggctggtgctgcggaagccgtcgcccgtggcagactgcctgctgatgctggtctacaaggacaagtcggagcgtatcaagggcctgcgggagcgcagcagcctgacgctagaggacatctgcgggctggagcccggcctgccctacgagggcttggtccacacgctggccattgtctgcctgtcccaggccatcatgctgggctttgacagccacgaggccatgtgtgcgtgggatgcccggatccgctatgcgctcggcgaggtgcataggttccatgtgacagtggctccaggcaccaagttggagagcggcccggctaccctgcacctctgcaatgatgtcctcgtcttggccagggacatccccccggctgtcacggggcagtggaagctgtctgacctccggcgctacggggccgtgccaagcggattcatctttgaaggcgggaccaggtgtgggtactgggctggcgtcttcttcctgtcctcggccgagggggagcagatcagcttcctgttcgactgcatcgtccgaggcatctcccccaccaagggcccctttgggctgcggccggttctaccagacccaagtcccccgggaccctcgactgtggaggagcgtgtggcccaggaagccctggaaaccctacagctggagaagcggctgagcctcctctcacatgcgggcaggccgggcagtggaggggatgaccgcagcctgtccagctcatcctcagaggccagtcacttggacgtcagcgccagcagccggctcaccgcatggccagagcaatcctcgtcgtcagccagcacgtcacaggaggggcctagaccagcagctgcccaggccgccggggaagccatggtgggtgcctcaaggccaccccccaagccgctgcgtccgcggcagctgcaggaggttggccgccagagctcctcggacagcggcatcgccactggcagccactcctcttactccagcagcctctcgtcctacgcgggcagcagcctggacgtgtggcgggccacagatgaactgggctcactgctcagcctgccagcagcgggggcccccgagcccagcctgtgcacctgcctgcccgggacagtcgagtaccaggtgcccacctccctgcgggcccactatgacacaccacgcagcctttgcctggctcctagagaccacagccccccctcacagggcagccccggcaacagtgcggccagggactcaggcggccagacgtccgccgggtgtccctctggctggctgggcacgagacggcggggcctggtgatggaggccccccagggcagcgaggccacactgcctggccctgcccctggcgagccctgggaagcaggcggcccccacgcggggccacccccggctttcttttcggcatgtccagtctgtggaggactcaagggagcggcagcctcagccccaggacctgcgacagcacattcaggatccccaggacccgtggctgtggacagcccaggaccagagaggccgcgcggcgagtcgcccacttacgtgaacatccccgtcagcccatcctccagaaagcagctgcactacatgggcctggagctccaggaggccagcgagggtgtccgaggggctggcgcctccctctacgcccagatcgacatcatggccaccgagacggcgcacagagtgggggtgcggcacgcacgggcccgggaggagcagctgtcggagctggagcagaggaaggcagccccgcagtga

SEQ ID NO: 8706 - DNA, 2551 bp, Homo sapiens
attttgaaagtgaccctgggctggggcgccggggcgagcgcggcggcgcggaaccatgacagaagatgaccgaggcggcgctggtggagggccaggtcaagctgcgggacggcaagaagtggaagagtaggtggctggtgctgcggaagccgtcgcccgtggcagactgcctgctgatgctggtctacaaggacaagtcggagcgtatcaagggcctgcgggagcgcagcagcctgacgctagaggacatctgcgggctggagcccggcctgccctacgagggcttggtccacacgctggccattgtctgcctgtcccaggccatcatgctgggctttgacagccacgaggccatgtgtgcgtgggatgcccggatccgctatgcgctcggcgaggtgcataggttccatgtgacagtggctccaggcaccaagttggagagcggcccggctaccctgcacctctgcaatgatgtcctcgtcttggccagggacatccccccggctgtcacggggcagtggaagctgtctgacctccggcgctacggggccgtgccaagcggattcatctttgaaggcgggaccaggggctggcgtcttcttcctgtcctcggccgagggggagcagatcagcttcctgttcgactgcatcgtccgaggcatctcccccaccaagggcccctttgggctgcggccggttctaccagacccaagtcccccgggaccctcgactgtggaggagcgtgtggcccaggaagccctggaaaccctacagctggagaagcggctgagcctcctctcacatgcgggcaggccgggcagtggaggggatgaccgcagcctgtccagctcatcctcagaggccagtcacttggacgtcagcgccagcagccggctcaccgcatggccagagcaatcctcgtcgtcagccagcacgtcacaggaggggcctagaccagcagctgcccaggccgccggggaagccatggtgggtgcctcaaggccaccccccaagccgctgcgtccgcggcagctgcaggaggttggccgccagagctcctcggacagcggcatcgccactggcagccactcctcttactccagcagcctctcgtcctacgcgggcagcagcctggacgtgtggcgggccacagatgaactgggctcactgctcagcctgccagcagcgggggcccccgagcccagcctgtgcacctgcctgcccgggacagtcgagtaccaggtgcccacctccctgcgggcccactatgacacaccacgcagcctttgcctggctcctagagaccacagccccccctcacagggcagccccggcaacagtgcggccagggactcaggcggccagacgtccgccgggtgtccctctggctggctgggcacgagacggcggggcctggtgatggaggccccccagggcagcgaggccacactgcctggccctgcccctggcgagccctgggaagcaggcggcccccacgcggggccacccccggctttcttttcggcatgtccagtctgtggaggactcaaggtaaacccccctccttgagagccgcagatcccgccccgcggctgcaaaggggctgaatttgcccccagatggcagaggaagtggcgccagcctccttgcagactggtgctctgtgttctgtgggagggaccgggggtctcccggagaggggagctggagggcgcgccctgtggctgccaccggaggaaggggctgacttggggaggtgagttctggaaggcaggggctctgggtccggcaggtcggggtcaccagagccccaatgctcagctgcttcactccgtgtcccccacccctgaggatcaggtgagtgctgcacctctgttggctcgtgccttgcactggggtgccaagggctggaggccctgccgctggccttgtcctccttgggcctcacgcccccttcgggggtggccggttctccccatcacctctctggggcagtcacaccacctgttaagcatcaagctaccacagaggctccggccacctgggctccaccagcccagcccccctgggctccgtgtgcgctgggcctcatccccatctatgggaggaaactgaagctcaggaggctgtgtggcttgcggggtctctgggttctgggccccactgttccccagtgaagcccttgtgggaaggttccgggagcaggtggtgtcctcagagcagcctcgcctgctgaccccactgggagaggcgccgtgcctcgggcccctggtgggagctctgctggctcctgtctgaacctcctcgcagggccaaaggctggcttggcctgtgtttcccctggcccaggcctcagcccctgcgtcggaggtggggctgtgttgggcccattgtcccccgccctgggtggcttcctcttgcacagcctggagcctgccctgaccacagcccagcagctccctgtgaacacctctttgtcccttcactgtcagctgtttctaaacccagacactgtttgtaatagactggaaataaaatgttctttccttac

SEQ ID NO: 8707 - DNA, 2079 bp, Homo sapiens
ccgcgccttatcgccaaagctgcggctctggacgcccagccgcggcgtatcccgatcacttccgggtagtgctccacgggcacgagccgcgattgggctaccgtagatggggtacttccggtgtgcacgtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggcggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggtggcaaatacagtgttcagttcaagttgcccgacgtgtatggtgtattccagtttaaagtggattacaaccggctaggctacacacacctgtactcttccactcaggtatccgtgcggccactccagcacacgcagtatgagcgcttcatcccctcggcctacccctactacgccagcgccttctccatgatgctggggctcttcatcttcagcatcgtcttcttgcacatgaaggagaaggagaagtccgactgaggggctagagccctctccgcacagcgtggagacggggcaaggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgctaaaagtggcatttttcctatgtgcagtcactcctctcatttctaaaatagggacgtggccaggcacggtggctcatgcctgtaatcccagcactttgggaggccgaggcaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaataaataaataaaaataaagcgagatgttgccctcaaa

SEQ ID NO: 8708 - DNA, 1589 bp, Homo sapiens
gtagatggggtacttccggtgtgcacgtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggattttggaggcaacatcaacgtggagaccatcagtgcctttattgacggcggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggtggcaaatacagtgttcagttcaagttgcccgacgtgtatggtgtattccagtttaaagtggattacaaccggctaggctacacacacctgtactcttccactcaggtatccgtgcggccactccagcacacgcagtatgagcgcttcatcccctcggcctacccctactacgccagcgccttctccatgatgctggggctcttcatcttcagcatcgtcttcttgcacatgaaggagaaggagaagtccgactgaggggctagagccctctccgcacagcgtggagacggggcaaggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgctaaaagtggcatttttcctatgtgcagtcactcctctcatttctaaaatagggacgtggccaggcacggtggctcatgcctgtaatcccagcactttgggaggccgaggcaggcggctcacgaggtca

SEQ ID NO: 8709 - DNA, 486 bp, Homo sapiens
gaactacaactcccagaaggccgcgcggaagcggaacgtgaaccagggaggacttccggacgccaacatccgggccgcgcggggaaggggagacgtggggtagaggggagcattgcttccttctctcgcagtgaccatgacgaaattagcgcagtggctttggggactagcgatcctgggctccacctgggtggccctgaccacgggagccttgggcctggagctgcccttgtcctgccaggaagtcctgtggccactgcccgcctacttgctggtgtccgccggctgctatgccctgggcactgtgggctatcgtgtggccacttttcatgactgcgaggacgccgcacgcgagctgcagagccagatacaggaggcccgagccgacttagcccgcagggggctgcgcttctgacagcctaaccccattcctgtgcggacagcccttcctcccatttcccattaaagagccagtttattttctaa

SEQ ID NO: 8710 - DNA, 517 bp, Homo sapiens
ggcccttccaccttttgtgggcactcaagttcggacctctgggatcggcgattcccctctggccagggctggttttaatgctctccgtgggcgggcttcggttgagtttggtccgcttttcctttctgctcctcaggggagcattgcttccttctctcgcagtgaccatgacgaaattagcgcagtggctttggggactagcgatcctgggctccacctgggtggccctgaccacgggagccttgggcctggagctgcccttgtcctgccaggaagtcctgtggccactgcccgcctacttgctggtgtccgccggctgctatgccctgggcactgtgggctatcgtgtggccacttttcatgactgcgaggacgccgcacgcgagctgcagagccagatacaggaggcccgagccgacttagcccgcagggggctgcgcttctgacagcctaaccccattcctgtgcggacagcccttcctcccatttcccattaaagagccagtttattttctaa

SEQ ID NO: 8711 - DNA, 409 bp, Homo sapiens
acttccggacgccaacatccgggccgcgcggggaaggggagacgtggggtagagtgaccatgacgaaattagcgcagtggctttggggactagcgatcctgggctccacctgggtggccctgaccacgggagccttgggcctggagctgcccttgtcctgccaggaagtcctgtggccactgcccgcctacttgctggtgtccgccggctgctatgccctgggcactgtgggctatcgtgtggccacttttcatgactgcgaggacgccgcacgcgagctgcagagccagatacaggaggcccgagccgacttagcccgcagggggctgcgcttctgacagcctaaccccattcctgtgcggacagcccttcctcccatttcccattaaagagccagtttattttctaa

SEQ ID NO: 8712 - DNA, 1628 bp, Homo sapiens
gtgatgacgaaaggagcgtcaacttgtcgtccctcaggcccgtcagtgctgggaggggcggtggcgacgcacataccagcatcacctccgccaggccgggccccacgccggccgcggattggctccctccaagggcacgcacgcccggggactcgttggcggcgtggaggggcgccggtggccacgttggtgtcaacctccttcgtgaagctcacacctcccccgccccgggaggggtttgcccgccactgtcgctgaatgattgcatcatcgaaagcagaaaaccacttttgcatccttcggcctctggcgtgcctgccatgacgtcatagctctgcggaggtggaagttggggagctttgaggacctcatggatcccagggggaccaagagaggagctgagaagacagaggtagctgagcctcggaacaaactacctcgtccagcaccttctctgcccacagaccctgccctctactctgggccctttcctttctaccggcgcccttcggaactgggctgcttctccctggatgctcaacgccagtaccatggagatgcccgagccctgcgctactatagcccaccccccactaacggtccaggccccaactttgacctcagagacggatacccggatcgataccagccccgggacgaggaggtccaggaaaggctggaccacctgctgtgctggctcctggaacaccgaggccggttggaggggggtccaggctggctggcagaggccatagtgacgtggcgggggcacctgacaaaactgctgacgacaccgtatgagcggcaggagggctggcagctggcagcctcccggttccagggaacactatacctgagtgaagtggagacaccgaacgctcgggcccagaggcttgctcggccaccgctcctccgggagcttatgtacatgggatacaaatttgagcagtacatgtgtgcagacaaacctggaagctccccagacccctctggggaggttaacaccaacgtggccttctgctctgtgctacgcagccgcctgggaagccaccctctgctcttctcaggggaggtagactgcacagacccccaagccccatccacacagcccccaacctgctatgtggagctcaagacctccaaggagatgcacagccctggccaatggaggagtttctacagacacaagctcctgaaatggtgggctcagtcattcctcccaggggtcccgaatgttgttgctggcttccgtaacccagacggttttgtctcttccctcaagacctttcctaccatgaagatgtttgaatatgtcaggaatgaccgtgacggctggaatccctctgtgtgcatgaacttctgtgccgccttccttagctttgcccagagcacggttgtccaggatgaccccaggctcgttcatctcttctcttgggagcctggcggcccagtcaccgtgtctgtacaccaagatgcaccttacgccttcctgcccatatggtatgtggaagctatgactcaggacctcccatcaccccccaagactccctctcccaaatagtaatgctttagagggaggcagtcatatctctgtgtgcagataataaaagcatatttctaagaggttc

SEQ ID NO: 8713 - DNA, 1667 bp, Homo sapiens
gatgacgaaaggagcgtcaacttgtcgtccctcaggcccgtcagtgctgggaggggcggtggcgacgcacataccagcatcacctccgccaggccgggccccacgccggccgcggattggctccctccaagggcacgcacgcccggggactcgttggcggcgtggaggggcgccggtggccacgttggtgtcaacctccttcgtgaagctcacacctcccccgccccgggaggggtttgcccgccactgtcgctgaatgattgcatcatcgaaagcagaaaaccacttttgcatccttcggcctctggcgtgcctgccatgacgtcatagctctgcggaggtggaagttggggagctttgaggcctcctctgtagaatggaaactctgtacccctgcttgtcttaggacctcatggatcccagggggaccaagagaggagctgagaagacagaggtagctgagcctcggaacaaactacctcgtccagcaccttctctgcccacagaccctgccctctactctgggccctttcctttctaccggcgcccttcggaactgggctgcttctccctggatgctcaacgccagtaccatggagatgcccgagccctgcgctactatagcccaccccccactaacggtccaggccccaactttgacctcagagacggatacccggatcgataccagccccgggacgaggaggtccaggaaaggctggaccacctgctgtgctggctcctggaacaccgaggccggttggaggggggtccaggctggctggcagaggccatagtgacgtggcgggggcacctgacaaaactgctgacgacaccgtatgagcggcaggagggctggcagctggcagcctcccggttccagggaacactatacctgagtgaagtggagacaccgaacgctcgggcccagaggcttgctcggccaccgctcctccgggagcttatgtacatgggatacaaatttgagcagtacatgtgtgcagacaaacctggaagctccccagacccctctggggaggttaacaccaacgtggccttctgctctgtgctacgcagccgcctgggaagccaccctctgctcttctcaggggaggtagactgcacagacccccaagccccatccacacagcccccaacctgctatgtggagctcaagacctccaaggagatgcacagccctggccaatggaggagtttctacagacacaagctcctgaaatggtgggctcagtcattcctcccaggggtcccgaatgttgttgctggcttccgtaacccagacggttttgtctcttccctcaagacctttcctaccatgaagatgtttgaatatgtcaggaatgaccgtgacggctggaatccctctgtgtgcatgaacttctgtgccgccttccttagctttgcccagagcacggttgtccaggatgaccccaggctcgttcatctcttctcttgggagcctggcggcccagtcaccgtgtctgtacaccaagatgcaccttacgccttcctgcccatatggtatgtggaagctatgactcaggacctcccatcaccccccaagactccctctcccaaatagtaatgctttagagggaggcagtcatatctctgtgtgcagataataaaagcatatttctaagagg

SEQ ID NO: 8714 - DNA, 1533 bp, Homo sapiens
ggcgtgcctgccatgacgtcatagctctgcggaggtggaagttggggagctttgaggtaactggattcttgatctgagcgcagacgtccttcctaacctcactgcatttggaggacctggagggagggtgggtgaagggcaaggaaagaggcaggatgagagcttggccgcggtggcgtctgaggggcctgaatgtttcaaggccagagcctggcgatcaggtggctcgcttagtcctaaaccagtcatccttctccaggcctcctctgtagaatggaaactctgtacccctgcttgtcttaggacctcatggatcccagggggaccaagagaggagctgagaagacagaggtagctgagcctcggaacaaactacctcgtccagcaccttctctgcccacagaccctgccctctactctgggccctttcctttctaccggcgcccttcggaactgggctgcttctccctggatgctcaacgccagtaccatggagatgcccgagccctgcgctactatagcccaccccccactaacggtccaggccccaactttgacctcagagacggatacccggatcgataccagccccgggacgaggaggtccaggaaaggctggaccacctgctgtgctggctcctggaacaccgaggccggttggaggggggtccaggctggctggcagaggccatagtgacgtggcgggggcacctgacaaaactgctgacgacaccgtatgagcggcaggagggctggcagctggcagcctcccggttccagggaacactatacctgagtgaagtggagacaccgaacgctcgggcccagaggcttgctcggccaccgctcctccgggagcttatgtacatgggatacaaatttgagcagtacatgtgtgcagacaaacctggaagctccccagacccctctggggaggttaacaccaacgtggccttctgctctgtgctacgcagccgcctgggaagccaccctctgctcttctcaggggaggtagactgcacagacccccaagccccatccacacagcccccaacctgctatgtggagctcaagacctccaaggagatgcacagccctggccaatggaggagtttctacagacacaagctcctgaaatggtgggctcagtcattcctcccaggggtcccgaatgttgttgctggcttccgtaacccagacggttttgtctcttccctcaagacctttcctaccatgaagatgtttgaatatgtcaggaatgaccgtgacggctggaatccctctgtgtgcatgaacttctgtgccgccttccttagctttgcccagagcacggttgtccaggatgaccccaggctcgttcatctcttctcttgggagcctggcggcccagtcaccgtgtctgtacaccaagatgcaccttacgccttcctgcccatatggtatgtggaagctatgactcaggacctcccatcaccccccaagactccctctcccaaatagtaatgctttagagggaggcagtcatatctctgt

SEQ ID NO: 8715 - DNA, 1628 bp, Homo sapiens; identical to SEQ ID NO: 8712

SEQ ID NO: 8716 - DNA, 1554 bp, Homo sapiens
tgacgtcatagctctgcggaggtggaagttggggagctttgaggtaactggattcttgatctgagcgcagacgtccttcctaacctcactgcatttggaggacctggagggagggtgggtgaagggcaaggaaagaggcaggatgagagcttggccgcggtggcgtctgaggggcctgaatgtttcaaggccagagcctggcgatcaggtggctcgcttagtcctaaaccagtcatccttctccaggcctcctctgtagaatggaaactctgtacccctgcttgtcttaggacctcatggatcccagggggaccaagagaggagctgagaagacagaggtagctgagcctcggaacaaactacctcgtccagcaccttctctgcccacagaccctgccctctactctgggccctttcctttctaccggcgcccttcggaactgggctgcttctccctggatgctcaacgccagtaccatggagatgcccgagccctgcgctactatagcccaccccccactaacggtccaggccccaactttgacctcagagacggatacccggatcgataccagccccgggacgaggaggtccaggaaaggctggaccacctgctgtgctggctcctggaacaccgaggccggttggaggggggtccaggctggctggcagaggccatagtgacgtggcgggggcacctgacaaaactgctgacgacaccgtatgagcggcaggagggctggcagctggcagcctcccggttccagggaacactatacctgagtgaagtggagacaccgaacgctcgggcccagaggcttgctcggccaccgctcctccgggagcttatgtacatgggatacaaatttgagcagtacatgtgtgcagacaaacctggaagctccccagacccctctggggaggttaacaccaacgtggccttctgctctgtgctacgcagccgcctgggaagccaccctctgctcttctcaggggaggtagactgcacagacccccaagccccatccacacagcccccaacctgctatgtggagctcaagacctccaaggagatgcacagccctggccaatggaggagtttctacagacacaagctcctgaaatggtgggctcagtcattcctcccaggggtcccgaatgttgttgctggcttccgtaacccagacggttttgtctcttccctcaagacctttcctaccatgaagatgtttgaatatgtcaggaatgaccgtgacggctggaatccctctgtgtgcatgaacttctgtgccgccttccttagctttgcccagagcacggttgtccaggatgaccccaggctcgttcatctcttctcttgggagcctggcggcccagtcaccgtgtctgtacaccaagatgcaccttacgccttcctgcccatatggtatgtggaagctatgactcaggacctcccatcaccccccaagactccctctcccaaatagtaatgctttagagggaggcagtcatatctctgtgtgcagataataaaagcatatttctaagaggttc

SEQ ID NO: 8717 - DNA, 1516 bp, Homo sapiens
tggcggcgtggaggggcgccggtggccacgttggtgtcaacctccttcgtgaagctcacacctcccccgccccgggaggggtttgcccgccactgtcgctgaatgattgcatcatcgaaagcagaaaaccacttttgcatccttcggcctctggcgtgcctgccatgacgtcatagctctgcggaggtggaagttggggagctttgaggcctcctctgtagaatggaaactctgtacccctgcttgtcttaggacctcatggatcccagggggaccaagagaggagctgagaagacagaggtagctgagcctcggaacaaactacctcgtccagcaccttctctgcccacagaccctgccctctactctgggccctttcctttctaccggcgcccttcggaactgggctgcttctccctggatgctcaacgccagtaccatggagatgcccgagccctgcgctactatagcccaccccccactaacggtccaggccccaactttgacctcagagacggatacccggatcgataccagccccgggacgaggaggtccaggaaaggctggaccacctgctgtgctggctcctggaacaccgaggccggttggaggggggtccaggctggctggcagaggccatagtgacgtggcgggggcacctgacaaaactgctgacgacaccgtatgagcggcaggagggctggcagctggcagcctcccggttccagggaacactatacctgagtgaagtggagacaccgaacgctcgggcccagaggcttgctcggccaccgctcctccgggagcttatgtacatgggatacaaatttgagcagtacatgtgtgcagacaaacctggaagctccccagacccctctggggaggttaacaccaacgtggccttctgctctgtgctacgcagccgcctgggaagccaccctctgctcttctcaggggaggtagactgcacagacccccaagccccatccacacagcccccaacctgctatgtggagctcaagacctccaaggagatgcacagccctggccaatggaggagtttctacagacacaagctcctgaaatggtgggctcagtcattcctcccaggggtcccgaatgttgttgctggcttccgtaacccagacggttttgtctcttccctcaagacctttcctaccatgaagatgtttgaatatgtcaggaatgaccgtgacggctggaatccctctgtgtgcatgaacttctgtgccgccttccttagctttgcccagagcacggttgtccaggatgaccccaggctcgttcatctcttctcttgggagcctggcggcccagtcaccgtgtctgtacaccaagatgcaccttacgccttcctgcccatatggtatgtggaagctatgactcaggacctcccatcaccccccaagactccctctcccaaatagtaatgctttagagggaggcagtcatatctctgtgtgcagataataaaagcatatttctaagaggttc

SEQ ID NO: 8718 - DNA, 1628 bp, Homo sapiens
gtgatgacgaaaggagcgtcaacttgtcgtccctcaggcccgtcagtgctgggaggggcggtggcgacgcacataccagcatcacctccgccaggccgggccccacgccggccgcggattggctccctccaagggcacgcacgcccggggactcgttggcggcgtggaggggcgccggtggccacgttggtgtcaacctccttcgtgaagctcacacctcccccgccccgggaggggtttgcccgccactgtcgctgaatgattgcatcatcgaaagcagaaaaccacttttgcatccttcggcctctggcgtgcctgccatgacgtcatagctctgcggaggtggaagttggggagctttgaggacctcatggatcccagggggaccaagagaggagctgagaagacagaggtagctgagcctcggaacaaactacctcgtccagcaccttctctgcccacagaccctgccctctactctgggccctttcctttctaccggcgcccttcggaactgggctgcttctccctggatgctcaacgccagtaccatggagatgcccgagccctgcgctactatagcccaccccccactaacggtccaggccccaactttgacctcagagacggatacccggatcgataccagccccgggacgaggaggtccaggaaaggctggaccacctgctgtgctggctcctggaacaccgaggccggttggaggggggtccaggctggctggcagaggccatagtgacgtggcgggggcacctgacaaaactgctgacgacaccgtatgagcggcaggagggctggcagctggcagcctcccggttccagggaacactatacctgagtgaagtggagacaccgaacgctcgggcccagaggcttgctcggccaccgctcctccgggagcttatgtacatgggatacaaatttgagcagtacatgtgtgcagacaaacctggaagctccccagacccctctggggaggttaacaccaacgtggccttctgctctgtgctacgcagccgcctgggaagccaccctctgctcttctcaggggaggtagactgcacagacccccaagccccatccacacagcccccgacctgctatgtggagctcaagacctccaaggagatgcaaagccctggccaatggaggagtttctacagacacaagctcctgaaatggtgggctcagtcattcctcccaggggtcccgaatgttgttgctggcttccgtaacccagacggttttgtctcttccctcaagacctttcctaccatgaagatgtttgaatatgtcaggaatgaccgtgacggctggaatccctctgtgtgcatgaacttctgtgccgccttccttagctttgcccagagcacggttgtccaggatgaccccaggctcgttcatctcttctcttgggagcctggcggcccagtcaccgtgtctgtacaccaagatgcaccttacgccttcctgcccatatggtatgtggaagctatgactcaggacctcccatcaccccccaagactccctctcccaaatagtaatgctttagagggaggcagtcatatctctgtgtgcagataataaaagcatatttctaagaggttc

SEQ ID NO: 8719 - DNA, 1628 bp, Homo sapiens; identical to SEQ ID NO: 8712

SEQ ID NO: 8720 - DNA, 1516 bp, Homo sapiens; identical to SEQ ID NO: 8717

SEQ ID NO: 8721 - DNA, 1554 bp, Homo sapiens; identical to SEQ ID NO: 8716

SEQ ID NO: 8722 - DNA, 1554 bp, Homo sapiens; identical to SEQ ID NO: 8716

SEQ ID NO: 8723 - DNA, 1516 bp, Homo sapiens
tggcggcgtggaggggcgccggtggccacgttggtgtcaacctccttcgtgaagctcacacctcccccgccccgggaggggtttgcccgccactgtcgctgaatgattgcatcatcgaaagcagaaaaccacttttgcatccttcggcctctggcgtgcctgccatgacgtcatagctctgcggaggtggaagttggggagctttgaggcctcctctgtagaatggaaactctgtacccctgcttgtcttaggacctcatggatcccagggggaccaagagaggagctgagaagacagaggtagctgagcctcggaacaaactacctcgtccagcaccttctctgcccacagaccctgccctctactctgggccctttcctttctaccggcgcccttcggaactgggctgcttctccctggatgctcaacgccagtaccatggagatgcccgagccctgcgctactatagcccaccccccactaacggtccaggccccaactttgacctcagagacggatacccggatcgataccagccccgggacgaggaggtccaggaaaggctggaccacctgctgtgctggctcctggaacaccgaggccggttggaggggggtccaggctggctggcagaggccatagtgacgtggcgggggcacctgacaaaactgctgacgacaccgtatgagcggcaggagggctggcagctggcagcctcccggttccagggaacactatacctgagtgaagtggagacaccgaacgctcgggcccagaggcttgctcggccaccgctcctccgggagcttatgtacatgggatacaaatttgagcagtacatgtgtgcagacaaacctggaagctccccagacccctctggggaggttaacaccaacgtggccttctgctctgtgctacgcagccgcctgggaagccaccctctgctcttctcaggggaggtagactgcacagacccccaagccccatccacacagcccccgacctgctatgtggagctcaagacctccaaggagatgcaaagccctggccaatggaggagtttctacagacacaagctcctgaaatggtgggctcagtcattcctcccaggggtcccgaatgttgttgctggcttccgtaacccagacggttttgtctcttccctcaagacctttcctaccatgaagatgtttgaatatgtcaggaatgaccgtgacggctggaatccctctgtgtgcatgaacttctgtgccgccttccttagctttgcccagagcacggttgtccaggatgaccccaggctcgttcatctcttctcttgggagcctggcggcccagtcaccgtgtctgtacaccaagatgcaccttacgccttcctgcccatatggtatgtggaagctatgactcaggacctcccatcaccccccaagactccctctcccaaatagtaatgctttagagggaggcagtcatatctctgtgtgcagataataaaagcatatttctaagaggttc

SEQ ID NO: 8724 - DNA, 1516 bp, Homo sapiens; identical to SEQ ID NO: 8717

SEQ ID NO: 8725 - DNA, 1554 bp, Homo sapiens; identical to SEQ ID NO: 8716

SEQ ID NO: 8726 - DNA, 1516 bp, Homo sapiens; identical to SEQ ID NO: 8717

SEQ ID NO: 8727 - DNA, 1628 bp, Homo sapiens; identical to SEQ ID NO: 8712

SEQ ID NO: 8728 - DNA, 1628 bp, Homo sapiens; identical to SEQ ID NO: 8712

SEQ ID NO: 8729 - DNA, 1554 bp, Homo sapiens
tgacgtcatagctctgcggaggtggaagttggggagctttgaggtaactggattcttgatctgagcgcagacgtccttcctaacctcactgcatttggaggacctggagggagggtgggtgaagggcaaggaaagaggcaggatgagagcttggccgcggtggcgtctgaggggcctgaatgtttcaaggccagagcctggcgatcaggtggctcgcttagtcctaaaccagtcatccttctccaggcctcctctgtagaatggaaactctgtacccctgcttgtcttaggacctcatggatcccagggggaccaagagaggagctgagaagacagaggtagctgagcctcggaacaaactacctcgtccagcaccttctctgcccacagaccctgccctctactctgggccctttcctttctaccggcgcccttcggaactgggctgcttctccctggatgctcaacgccagtaccatggagatgcccgagccctgcgctactatagcccaccccccactaacggtccaggccccaactttgacctcagagacggatacccggatcgataccagccccgggacgaggaggtccaggaaaggctggaccacctgctgtgctggctcctggaacaccgaggccggttggaggggggtccaggctggctggcagaggccatagtgacgtggcgggggcacctgacaaaactgctgacgacaccgtatgagcggcaggagggctggcagctggcagcctcccggttccagggaacactatacctgagtgaagtggagacaccgaacgctcgggcccagaggcttgctcggccaccgctcctccgggagcttatgtacatgggatacaaatttgagcagtacatgtgtgcagacaaacctggaagctccccagacccctctggggaggttaacaccaacgtggccttctgctctgtgctacgcagccgcctgggaagccaccctctgctcttctcaggggaggtagactgcacagacccccaagccccatccacacagcccccgacctgctatgtggagctcaagacctccaaggagatgcaaagccctggccaatggaggagtttctacagacacaagctcctgaaatggtgggctcagtcattcctcccaggggtcccgaatgttgttgctggcttccgtaacccagacggttttgtctcttccctcaagacctttcctaccatgaagatgtttgaatatgtcaggaatgaccgtgacggctggaatccctctgtgtgcatgaacttctgtgccgccttccttagctttgcccagagcacggttgtccaggatgaccccaggctcgttcatctcttctcttgggagcctggcggcccagtcaccgtgtctgtacaccaagatgcaccttacgccttcctgcccatatggtatgtggaagctatgactcaggacctcccatcaccccccaagactccctctcccaaatagtaatgctttagagggaggcagtcatatctctgtgtgcagataataaaagcatatttctaagaggttc

SEQ ID NO: 8730 - DNA, 1938 bp, Homo sapiens
ggagagagagaggacagagagcaagtcactcccggctgcctttttcacctctgacagagcccagacaccatgaacgcaagtgaattccgaaggagagggaaggagatggtggattacatggccaactacatggaaggcattgagggacgccaggtctaccctgacgtggagcccgggtacctgcggccgctgatccctgccgctgcccctcaggagccagacacgtttgaggacatcatcaacgacgttgagaagataatcatgcctggggtgacgcactggcacagcccctacttcttcgcctacttccccactgccagctcgtacccggccatgcttgcggacatgctgtgcggggccattggctgcatcggcttctcctgggcggcaagcccagcatgcacagagctggagactgtgatgatggactggctcgggaagatgctggaactaccaaaggcatttttgaatgagaaagctggagaagggggaggagtgatccagggaagtgccagtgaagccaccctggtggccctgctggccgctcggaccaaagtgatccatcggctgcaggcagcgtccccagagctcacacaggccgctatcatggagaagctggtggcttactcatccgatcaggcacactcctcagtggaaagagctgggttaattggtggagtgaaattaaaagccatcccctcagatggcaacttcgccatgcgtgcgtctgccctgcaggaagccctggagagagacaaagcggctggcctgattcctttctttatggttgccaccctggggaccacaacatgctgctcctttgacaatctcttagaagtcggtcctatctgcaacaaggaagacatatggctgcacgttgatgcagcctacgcaggcagtgcattcatctgccctgagttccggcaccttctgaatggagtggagtttgcagattcattcaactttaatccccacaaatggctattggtgaattttgactgttctgccatgtgggtgaaaaagagaacagacttaacgggagcctttagactggaccccacttacctgaagcacagccatcaggattcagggcttatcactgactaccggcattggcagataccactgggcagaagatttcgctctttgaaaatgtggtttgtatttaggatgtatggagtcaaaggactgcaggcttatatccgcaagcatgtccagctgtcccatgagtttgagtcactggtgcgccaggatccccgctttgaaatctgtgtggaagtcattctggggcttgtctgctttcggctaaagggttccaacaaagtgaatgaagctcttctgcaaagaataaacagtgccaaaaaaatccacttggttccatgtcacctcagggacaagtttgtcctgcgctttgccatctgttctcgcacggtggaatctgcccatgtgcagcgggcctgggaacacatcaaagagctggcggccgacgtgctgcgagcagagagggagtaggagtgaagccagctgcaggaatcaaaaattgaagagagatatatctgaaaactggaataagaagcaaataaatatcatcctgccttcatggaactcagctgtctgtggcttcccatgtctttctccaaagttatccagagggttgtgattttgtctgcttagtatctcatcaacaaagaaatattatttgctaattaaaaagttaatcttcatggccatagcttttattcattagctgtgatttttgttgattaaaacattatagattttcatgttcttgcagtcatcagaagtggtaggaaagcctcactgatatattttccagggcaatcaatgttcacgcaacttgaaattatatctgtggtcttcaaattgtcttttgtcatgtggctaaatgcctaataaacaattcaagtgaaatactaa

SEQ ID NO: 8731 - DNA, 460 bp, Homo sapiens
gcaatccagtgtgtaggtccagggcgacaagcgctgctcccatggctggggtaagtccctccagcattcagccttgctccctgtgcttatctggatgcggtgtaggatgaagatgaccctatagaactctaccctggaagtcctggcaaagtggatatgtgacatttttgaaaccagggacatgttggtgctgcttaatatttaaatcataattttcagactcttaaaaattactaaataagtttgaagagacacagccatctgcctacagtgccacccctgagcttcacgccaccctggtctccaggaaaggggagagtctcaggaatattgaatgcagttttcacctctgacagagcccagacaccatgaacgcaagtgaattccgaaggagagggaaggagatggtggattacatggccaactacatggaaggcattgagggacgccaggtctaccc

SEQ ID NO: 8732 - DNA, 251 bp, Homo sapiens
gcactcatggcatgttctgctgcctggaaggccgctgcctctgtcccagttccatggggatctctgctctagaggggtagcttcttccttgaaaagatgctgcttaaagtcagaggatggatggctctccttggggcatttctagctctggactgtgccacaagccctggatgtgttttcacctctgacagagcccagacaccatgaacgcaagtgaattccgaaggagagggaaggagatggtggattac

SEQ ID NO: 8733 - DNA, 2041 bp, Homo sapiens
ggcacatgtggctggaaatgcaagaagagggaaacgtgtggcttggagtttcaagaagagtgactgtctcagtgccgagtgcctcagcagcttctccacatgctcttcagtccccaaagttggagaatcccatcaaggagagtagccctgtaaggaattcgaatttccagcatttttcacctctgacagagcccagacaccatgaacgcaagtgaattccgaaggagagggaaggagatggtggattacatggccaactacatggaaggcattgagggacgccaggtctaccctgacgtggagcccgggtacctgcggccgctgatccctgccgctgcccctcaggagccagacacgtttgaggacatcatcaacgacgttgagaagataatcatgcctggggtgacgcactggcacagcccctacttcttcgcctacttccccactgccagctcgtacccggccatgcttgcggacatgctgtgcggggccattggctgcatcggcttctcctgggcggcaagcccagcatgcacagagctggagactgtgatgatggactggctcgggaagatgctggaactaccaaaggcatttttgaatgagaaagctggagaagggggaggagtgatccagggaagtgccagtgaagccaccctggtggccctgctggccgctcggaccaaagtgatccatcggctgcaggcagcgtccccagagctcacacaggccgctatcatggagaagctggtggcttactcatccgatcaggcacactcctcagtggaaagagctgggttaattggtggagtgaaattaaaagccatcccctcagatggcaacttcgccatgcgtgcgtctgccctgcaggaagccctggagagagacaaagcggctggcctgattcctttctttatggttgccaccctggggaccacaacatgctgctcctttgacaatctcttagaagtcggtcctatctgcaacaaggaagacatatggctgcacgttgatgcagcctacgcaggcagtgcattcatctgccctgagttccggcaccttctgaatggagtggagtttgcagattcattcaactttaatccccacaaatggctattggtgaattttgactgttctgccatgtgggtgaaaaagagaacagacttaacgggagcctttagactggaccccacttacctgaagcacagccatcaggattcagggcttatcactgactaccggcattggcagataccactgggcagaagatttcgctctttgaaaatgtggtttgtatttaggatgtatggagtcaaaggactgcaggcttatatccgcaagcatgtccagctgtcccatgagtttgagtcactggtgcgccaggatccccgctttgaaatctgtgtggaagtcattctggggcttgtctgctttcggctaaagggttccaacaaagtgaatgaagctcttctgcaaagaataaacagtgccaaaaaaatccacttggttccatgtcacctcagggacaagtttgtcctgcgctttgccatctgttctcgcacggtggaatctgcccatgtgcagcgggcctgggaacacatcaaagagctggcggccgacgtgctgcgagcagagagggagtaggagtgaagccagctgcaggaatcaaaaattgaagagagatatatctgaaaactggaataagaagcaaataaatatcatcctgccttcatggaactcagctgtctgtggcttcccatgtctttctccaaagttatccagagggttgtgattttgtctgcttagtatctcatcaacaaagaaatattatttgctaattaaaaagttaatcttcatggccatagcttttattcattagctgtgatttttgttgattaaaacattatagattttcatgttcttgcagtcatcagaagtggtaggaaagcctcactgatatattttccagggcaatcaatgttcacgcaacttgaaattatatctgtggtcttcaaattgtcttttgtcatgtggctaaatg

SEQ ID NO: 8734 - DNA, 1366 bp, Homo sapiens
agagaggacagagagcaagtcactcccggctgcctttttcacctctgacagagcccagacaccatgaacgcaagtgaattccgaaggagagggaaggagatggtggattacatggccaactacatggaaggcattgagggacgccaggtctaccctgacgtggagcccgggtacctgcggccgctgatccctgccgctgcccctcaggagccagacacgtttgaggacatcatcaacgacgttgagaagataatcatgcctggggtgacgcactggcacagcccctacttcttcgcctacttccccactgccagctcgtacccggccatgcttgcggacatgctgtgcggggccattggctgcatcggcttctcctgggcggcaagcccagcatgcacagagctggagactgtgatgatggactggctcgggaagatgctggaactaccaaaggcatttttgaatgagaaagctggagaagggggaggagtgatccagggaagtgccagtgaagccaccctggtggccctgctggccgctcggaccaaagtgatccatcggctgcaggcagcgtccccagagctcacacaggccgctatcatggagaagctggtggcttactcatccgatcaggcacactcctcagtggaaagagctgggttaattggtggagtgaaattaaaagccatcccctcagatggcaacttcgccatgcgtgcgtctgccctgcaggaagccctggagagagacaaagcggctggcctgattcctttctttatggttgccaccctggggaccacaacatgctgctcctttgacaatctcttagaagtcggtcctatctgcaacaaggaagacatatggctgcacgttgatgcagcctacgcaggcagtgcattcatctgccctgagttccggcaccttctgaatggagtggagtttgcagattcattcaactttaatccccacaaatggctattggtgaattttgactgttctgccatgtggtccagacaaccagtgcgtatgttaaggctgaagaaaacctgcttagtcagtgcggtggtgagaaggagttgagcctttcgggacgtggagtgcctgccgcagagctgatgccccgaggctgccgcagacgctgcagagctgatgccagcaagttggcggctgtgcgctcatctctcccggacaactcttccccggcgctcggggttcagttcagccaccagcctgtgaggggaaatttgacaaagtggaggtgatgtagggaagagacacaggacacacagggatgaggccaggccatttggaaaaggccatttggaaaatttccttgtagaaggaattaaacgtaagccctaagaca

SEQ ID NO: 8735 - DNA, 1700 bp, Homo sapiens
ggagagagagaggacagagagcaagtcactcccggctgcctttttcacctctgacagagcccagacaccatgaacgcaagtgaattccgaaggagagggaaggagatggtggattacatggccaactacatggaaggcattgagggacgccaggtctaccctgacgtggagcccgggtacctgcggccgctgatccctgccgctgcccctcaggagccagacacgtttgaggacatcatcaacgacgttgagaagataatcatgcctgggggaagtgccagtgaagccaccctggtggccctgctggccgctcggaccaaagtgatccatcggctgcaggcagcgtccccagagctcacacaggccgctatcatggagaagctggtggcttactcatccgatcaggcacactcctcagtggaaagagctgggttaattggtggagtgaaattaaaagccatcccctcagatggcaacttcgccatgcgtgcgtctgccctgcaggaagccctggagagagacaaagcggctggcctgattcctttctttatggttgccaccctggggaccacaacatgctgctcctttgacaatctcttagaagtcggtcctatctgcaacaaggaagacatatggctgcacgttgatgcagcctacgcaggcagtgcattcatctgccctgagttccggcaccttctgaatggagtggagtttgcagattcattcaactttaatccccacaaatggctattggtgaattttgactgttctgccatgtgggtgaaaaagagaacagacttaacgggagcctttagactggaccccacttacctgaagcacagccatcaggattcagggcttatcactgactaccggcattggcagataccactgggcagaagatttcgctctttgaaaatgtggtttgtatttaggatgtatggagtcaaaggactgcaggcttatatccgcaagcatgtccagctgtcccatgagtttgagtcactggtgcgccaggatccccgctttgaaatctgtgtggaagtcattctggggcttgtctgctttcggctaaagggttccaacaaagtgaatgaagctcttctgcaaagaataaacagtgccaaaaaaatccacttggttccatgtcacctcagggacaagtttgtcctgcgctttgccatctgttctcgcacggtggaatctgcccatgtgcagcgggcctgggaacacatcaaagagctggcggccgacgtgctgcgagcagagagggagtaggagtgaagccagctgcaggaatcaaaaattgaagagagatatatctgaaaactggaataagaagcaaataaatatcatcctgccttcatggaactcagctgtctgtggcttcccatgtctttctccaaagttatccagagggttgtgattttgtctgcttagtatctcatcaacaaagaaatattatttgctaattaaaaagttaatcttcatggccatagcttttattcattagctgtgatttttgttgattaaaacattatagattttcatgttcttgcagtcatcagaagtggtaggaaagcctcactgatatattttccagggcaatcaatgttcacgcaacttgaaattatatctgtggtcttcaaattgtcttttgtcatgtggctaaatgcctaataaacaattcaagtgaaata

SEQ ID NO: 8736 - DNA, 1620 bp, Homo sapiens
ctgcagttttcacctctgacagagcccagacaccatgaacgcaagtgaattccgaaggagagggaaggagatggtggattacatggccaactacatggaaggcattgagggacgccaggtctaccctgacgtggagcccgggtacctgcggccgctgatccctgccgctgcccctcaggagccagacacgtttgaggacatcatcaacgacgttgagaagataatcatgcctggggtgacgcactggcacagcccctacttcttcgcctacttccccactgccagctcgtacccggccatgcttgcggacatgctgtgcggggccattggctgcatcggcttctcctgggcggcaagcccagcatgcacagagctggagactgtgatgatggactggctcgggaagatgctggaactaccaaaggcatttttgaatgagaaagctggagaagggggaggagtgatccagatggttgccaccctggggaccacaacatgctgctcctttgacaatctcttagaagtcggtcctatctgcaacaaggaagacatatggctgcacgttgatgcagcctacgcaggcagtgcattcatctgccctgagttccggcaccttctgaatggagtggagtttgcagattcattcaactttaatccccacaaatggctattggtgaattttgactgttctgccatgtgggtgaaaaagagaacagacttaacgggagcctttagactggaccccacttacctgaagcacagccatcaggattcagggcttatcactgactaccggcattggcagataccactgggcagaagatttcgctctttgaaaatgtggtttgtatttaggatgtatggagtcaaaggactgcaggcttatatccgcaagcatgtccagctgtcccatgagtttgagtcactggtgcgccaggatccccgctttgaaatctgtgtggaagtcattctggggcttgtctgctttcggctaaagggttccaacaaagtgaatgaagctcttctgcaaagaataaacagtgccaaaaaaatccacttggttccatgtcacctcagggacaagtttgtcctgcgctttgccatctgttctcgcacggtggaatctgcccatgtgcagcgggcctgggaacacatcaaagagctggcggccgacgtgctgcgagcagagagggagtaggagtgaagccagctgcaggaatcaaaaattgaagagagatatatctgaaaactggaataagaagcaaataaatatcatcctgccttcatggaactcagctgtctgtggcttcccatgtctttctccaaagttatccagagggttgtgattttgtctgcttagtatctcatcaacaaagaaatattatttgctaattaaaaagttaatcttcatggccatagcttttattcattagctgtgatttttgttgattaaaacattatagattttcatgttcttgcagtcatcagaagtggtaggaaagcctcactgatatattttccagggcaatcaatgttcacgcaacttgaaattatatctgtggtcttcaaattgtcttttgtcatgtggctaaatgcctaataaacaattcaagtgaaata

SEQ ID NO: 8737 - DNA, 2613 bp, Homo sapiens
accccagccatgcccgccctcagtcgctgggccagcctgcccggccccagcatgcgggaggcagccttcatgtacagcacagcagtggccatcttcctggtcatcctggtggccgcactgcagggctcggctccccgtgagagccccctcccctatcacatccccctggacccggaggggtccctggagctctcatggaatgtcagctacacccaggaggccatccatttccagctcctggtgcggaggctcaaggctggcgtcctgtttgggatgtccgaccgtggcgagcttgagaacgcagatctcgtggtgctctggaccgatggggacactgcctattttgcggacggcactgtccacttggtctacgggatcctggaggagccgttccggtcactggaggccatcaacggctcgggcctgcagatggggctgcagagggtgcagctcctgaagcccaatatccccgaaccggagttgccctcagacgcgtgcaccatggaggtccaagctcccaatatccagatccccagccaggagaccacgtactggtgctacattaaggagcttccaaagggcttctctcggcaccacattatcaagtacgagcccatcgtcaccaagggcaatgaggcccttgtccaccacatggaagtcttccagtgcgcccccgagatggacagcgtcccccacttcagcgggccctgcgactccaagatgaaacccgaccgcctcaactactgccgccacgtgctggccgcctgggccctgggtgccaaggcattttactacccagaggaagccggccttgccttcgggggtccagggtcctccagatatctccgcctggaagttcactaccacaacccactggtgatagaaggacgaaacgactcctcaggcatccgcttgtactacacagccaagctgcggcgcttcaacgcggggatcatggagctgggactggtgtacacgccagtgatggccattccaccacgggagaccgccttcatcctcactggctactgcacggacaagtgcacccagctggcactgcctccctccgggatccacatcttcgcctctcagctccacacacacctgactgggagaaaggtggtcacagtgctggtccgggacggccgggagtgggagatcgtgaaccaggacaatcactacagccctcacttccaggagatccgcatgttgaagaaggtcgtgtcggtccatccgggagatgtgctcatcacctcctgcacgtacaacacagaagaccgggagctggccacagtggggggcttcgggatcctggaggagatgtgtgtcaactacgtgcactactacccccagacgcagctggagctctgcaagagcgctgtggacgccggcttcctgcagaagtacttccacctcatcaacaggttcaacaacgaggatgtctgcacctgccctcaggcgtccgtgtctcagcagttcacctctgttccctggaactccttcaaccgcgacgtactgaaggccctgtacagcttcgcgcccatctccatgcactgcaacaagtcctcagccgtccgcttccagggtgaatggaacctgcagcccctgcccaaggtcatctccacactggaagagcccaccccacagtgccccaccagccagggccgaagccctgctggccccaccgttgtcagcattggtgggggcaaaggctgaggggggacctactcctccccctcctccatgctgtccctgtgggctcacaccggcactgtgcactctactctgcgacgatccccatggaacagccctgcacgcccaggatgaaggggccagaccacgcccctgcctgagaccacggtccaatccagccttcttcccccagggtcccctgcatggctgagagggtgtgggtgccctgttgacctaccctggaccgagtggaccacgacctcgtccatttaaacccggctgactcagtgcagggacagcctgcacagtggtccagggtccagccctccgccagccctgttccgcctcactgggtgtggcctggcttctgggacaggcaccatgctgggccggggtgtggaatcaccgggaacgcccccgcccccgccccgctgctcccggtgtgcagcgggtgcgggtgccgcttaaacatttccctgctgagtggctcgtgtttcacagtgggcggcttccctgcgacggaggcaggaccaggcatttagctagttagagactcgcctgggaaattgctccattcctgagtaaacagatattttcgcccacctaaagggaagccctgacaacaactatcaccaaaagacgaggcggcaaagatccagcggggcttctgggcgccggttccacgtggggtggaattattagcaccagcttgcttctctgccggtggggccagcgctgaacagaccggggtggagtcagggctgtgctttccgcgtggttctgccacttagggagtgtgccttgggcgggccatttcacattcctgaccctcacttttctcatctgtaaaaccaggctgatgccgtgcgggctaatgagccaataaagctcacacttgggctggcacccactggaggtggg

SEQ ID NO: 8738 - DNA, 2763 bp, Homo sapiens
ctcaccccagccatgcccgccctcagtcgctgggccagcctgcccggccccagcatgcgggaggcagccttcatgtacagcacagcagtggccatcttcctggtcatcctggtggccgcactgcagggctcggctccccgtgagagccccctcccctatcacatccccctggacccggaggggtccctggagctctcatggaatgtcagctacacccaggaggccatccatttccagctcctggtgcggaggctcaaggctggcgtcctgtttgggatgtccgaccgtggcgagcttgagaacgcagatctcgtggtgctctggaccgatggggacactgcctattttgcggacgcctggagtgaccagaaggggcagatccacctggatccccagcaggactaccagctgctgcaggtgcagaggaccccagaaggcctgaccctgcttttcaagaggccctttggcacctgcgaccccaaggattacctcattgaagacggcactgtccacttggtctacgggatcctggaggagccgttccggtcactggaggccatcaacggctcgggcctgcagatggggctgcagagggtgcagctcctgaagcccaatatccccgaaccggagttgccctcagacgcgtgcaccatggaggtccaagctcccaatatccagatccccagccaggagaccacgtactggtgctacattaaggagcttccaaagggcttctctcggcaccacattatcaagtacgagcccatcgtcaccaagggcaatgaggcccttgtccaccacatggaagtcttccagtgcgcccccgagatggacagcgtcccccacttcagcgggccctgcgactccaagatgaaacccgaccgcctcaactactgccgccacgtgctggccgcctgggccctgggtgccaaggcattttactacccagaggaagccggccttgccttcgggggtccagggtcctccagatatctccgcctggaagttcactaccacaacccactggtgatagaaggacgaaacgactcctcaggcatccgcttgtactacacagccaagctgcggcgcttcaacgcggggatcatggagctgggactggtgtacacgccagtgatggccattccaccacgggagaccgccttcatcctcactggctactgcacggacaagtgcacccagctggcactgcctccctccgggatccacatcttcgcctctcagctccacacacacctgactgggagaaaggtggtcacagtgctggtccgggacggccgggagtgggagatcgtgaaccaggacaatcactacagccctcacttccaggagatccgcatgttgaagaaggtcgtgtcggtccatccgggagatgtgctcatcacctcctgcacgtacaacacagaagaccgggagctggccacagtggggggcttcgggatcctggaggagatgtgtgtcaactacgtgcactactacccccagacgcagctggagctctgcaagagcgctgtggacgccggcttcctgcagaagtacttccacctcatcaacaggttcaacaacgaggatgtctgcacctgccctcaggcgtccgtgtctcagcagttcacctctgttccctggaactccttcaaccgcgacgtactgaaggccctgtacagcttcgcgcccatctccatgcactgcaacaagtcctcagccgtccgcttccagggtgaatggaacctgcagcccctgcccaaggtcatctccacactggaagagcccaccccacagtgccccaccagccagggccgaagccctgctggccccaccgttgtcagcattggtgggggcaaaggctgaggggggacctactcctccccctcctccatgctgtccctgtgggctcacaccggcactgtgcactctactctgcgacgatccccatggaacagccctgcacgcccaggatgaaggggccagaccacgcccctgcctgagaccacggtccaatccagccttcttcccccagggtcccctgcatggctgagagggtgtgggtgccctgttgacctaccctggaccgagtggaccacgacctcgtccatttaaacccggctgactcagtgcagggacagcctgcacagtggtccagggtccagccctccgccagccctgttccgcctcactgggtgtggcctggcttctgggacaggcaccatgctgggccggggtgtggaatcaccgggaacgcccccgcccccgccccgctgctcccggtgtgcagcgggtgcgggtgccgcttaaacatttccctgctgagtggctcgtgtttcacagtgggcggcttccctgcgacggaggcaggaccaggcatttagctagttagagactcgcctgggaaattgctccattcctgagtaaacagatattttcgcccacctaaagggaagccctgacaacaactatcaccaaaagacgaggcggcaaagatccagcggggcttctgggcgccggttccacgtggggtggaattattagcaccagcttgcttctctgccggtggggccagcgctgaacagaccggggtggagtcagggctgtgctttccgcgtggttctgccacttagggagtgtgccttgggcgggccatttcacattcctgaccctcacttttctcatctgtaaaaccaggctgatgccgtgcgggctaatgagccaataaagctcacacttgggctggcacccactggaggtggg

SEQ ID NO: 8739 - DNA, 2342 bp, Homo sapiens
gaattcaggggctttctggtgcccaagacagtgacctgcagcaagggagtcagaagacagatgtagaaatcaagagtgaccatccacgggattgacttggattgccactcaagcggtcctctcatggaatgttggtgaggccctctgccagggaagcaatctggctgtgcaaagtgctgcctggtggggaggactcctggaaatctgactgacccctattccctgcttgggaacttgaggggtgtcagagcccctgatgtgctttctcttaggaagatgaggactctgaacacctctgccatggacgggactgggctggtggtggagagggacttctctgttcgtatcctcactgcctgtttcctgtcgctgctcatcctgtccacgctcctggggaacacgctggtctgtgctgccgttatcaggttccgacacctgcggtccaaggtgaccaacttctttgtcatctccttggctgtgtcagatctcttggtggccgtcctggtcatgccctggaaggcagtggctgagattgctggcttctggccctttgggtccttctgtaacatctgggtggcctttgacatcatgtgctccactgcatccatcctcaacctctgtgtgatcagcgtggacaggtattgggctatctccagccctttccggtatgagagaaagatgacccccaaggcagccttcatcctgatcagtgtggcatggaccttgtctgtactcatctccttcatcccagtgcagctcagctggcacaaggcaaaacccacaagcccctctgatggaaatgccacttccctggctgagaccatagacaactgtgactccagcctcagcaggacatatgccatctcatcctctgtaataagcttttacatccctgtggccatcatgattgtcacctacaccaggatctacaggattgctcagaaacaaatacggcgcattgcggccttggagagggcagcagtccacgccaagaattgccagaccaccacaggtaatggaaagcctgtcgaatgttctcaaccggaaagttcttttaagatgtccttcaaaagagaaactaaagtcctgaagactctgtcggtgatcatgggtgtgtttgtgtgctgttggctacctttcttcatcttgaactgcattttgcccttctgtgggtctggggagacgcagcccttctgcattgattccaacacctttgacgtgtttgtgtggtttgggtgggctaattcatccttgaaccccatcatttatgcctttaatgctgattttcggaaggcattttcaaccctcttaggatgctacagactttgccctgcgacgaataatgccatagagacggtgagtatcaataacaatggggccgcgatgttttccagccatcatgagccacgaggctccatctccaaggagtgcaatctggtttacctgatcccacatgctgtgggctcctctgaggacctgaaaaaggaggaggcagctggcatcgccagacccttggagaagctgtccccagccctatcagtcatattggactatgacactgacgtctctctggagaagatccaacccatcacacaaaacggtcagcacccaacctgaactcgcagatgaatcctgccacacatgctcatcccaaaagctagaggagattgctctggggcttgctattaagaaactaaggtacggtgagactctgaggtgtcaggagagccctctgctgctttccaacacacaattaactccgtttccaaatacattccagtgtattttctgtgttgttcatagtcaatcaaacagggacactacaaacatggggagccataagggacatgtctttggcttcagaattgtttttagaaatttattcttatcttaggatttaccaaatagggcaaagaatcaacagtgaacagcttcacttaaaatcaaatttttctgggaagaaaatgagatgggttgagtttgctgtatacaaacaggtgctaacactgttcccagcaaagttttcagattgtaaaggtaggtgcatgccttcataaattatttctaaaacattaattgaggcttacagtaggagtgagaaatttttttccagaattgagagatgttttgttgatattggttctatttatttattgtatatatggatatttttaatttatgatataataaatatatatttatcatatttaataggataaattaatgagttttatccaagaccttacaaccacatttctggccatttaactagcactttataagccaatgaagcaaacacacagactctgtgagattctaaatgttcatgtgtaacttctaga

SEQ ID NO: 8740 - DNA, 3373 bp, Homo sapiens
ggctcgctgcctcgcattgccacaggctcctgagaggtcgcgggcagtgcctgcggggaggcgcggggccctgctctgtagggctgaaggccgcccgaggttcgccaaggctctgggctctcgaaaggaagccaagaaaagaagctgcccaggtgaccagtcctgggagtgctctctcccaaggaagctccgagcgcccaggagcccttagccggggtctagtgccctttgaacaatctccagctcttcaaggaagtgggctgccgccgcctctcttgggacctggcctgggatcctttccccaaacgcaccccggcgatttttgcgcaccgggagccgaacccctgctgcgcgcagctggctgggctcaggcgcgcttcctcaacgtttcggagccgctgcccccagcgaagtccacattccaagctccaggggctttgagagagacgaccccaaggcaaggcgtttggagagctgctgaggagccaggggcttggaggagcgagaagacatgtattttcagctgagtctcagaaggggagaatctcctgtcaccaccagaaaagcaacagccccgaaatgtgattgcaactgactagcagagcagaggcccaggagtcactggattgatgatttagaatatgctaaaaagccagtgctttatttggggaattcaggggctttctggtgcccaagacagtgacctgcagcaagggagtcagaagacagatgtagaaatcaagagtgaccatccacgggattgacttggattgccactcaagcggtcctctcatggaatgttggtgaggccctctgccagggaagcaatctggctgtgcaaagtgctgcctggtggggaggactcctggaaatctgactgacccctattccctgcttgggaacttgaggggtgtcagagcccctgatgtgctttctcttaggaagatgaggactctgaacacctctgccatggacgggactgggctggtggtggagagggacttctctgttcgtatcctcactgcctgtttcctgtcgctgctcatcctgtccacgctcctggggaacacgctggtctgtgctgccgttatcaggttccgacacctgcggtccaaggtgaccaacttctttgtcatctccttggctgtgtcagatctcttggtggccgtcctggtcatgccctggaaggcagtggctgagattgctggcttctggccctttgggtccttctgtaacatctgggtggcctttgacatcatgtgctccactgcatccatcctcaacctctgtgtgatcagcgtggacaggtattgggctatctccagccctttccggtatgagagaaagatgacccccaaggcagccttcatcctgatcagtgtggcatggaccttgtctgtactcatctccttcatcccagtgcagctcagctggcacaaggcaaaacccacaagcccctctgatggaaatgccacttccctggctgagaccatagacaactgtgactccagcctcagcaggacatatgccatctcatcctctgtaataagcttttacatccctgtggccatcatgattgtcacctacaccaggatctacaggattgctcagaaacaaatacggcgcattgcggccttggagagggcagcagtccacgccaagaattgccagaccaccacaggtaatggaaagcctgtcgaatgttctcaaccggaaagttcttttaagatgtccttcaaaagagaaactaaagtcctgaagactctgtcggtgatcatgggtgtgtttgtgtgctgttggctacctttcttcatcttgaactgcattttgcccttctgtgggtctggggagacgcagcccttctgcattgattccaacacctttgacgtgtttgtgtggtttgggtgggctaattcatccttgaaccccatcatttatgcctttaatgctgattttcggaaggcattttcaaccctcttaggatgctacagactttgccctgcgacgaataatgccatagagacggtgagtatcaataacaatggggccgcgatgttttccagccatcatgagccacgaggctccatctccaaggagtgcaatctggtttacctgatcccacatgctgtgggctcctctgaggacctgaaaaaggaggaggcagctggcatcgccagacccttggagaagctgtccccagccctatcagtcatattggactatgacactgacgtctctctggagaagatccaacccatcacacaaaacggtcagcacccaacctgaactcgcagatgaatcctgccacacatgctcatcccaaaagctagaggagattgctctggggcttgctattaagaaactaaggtacggtgagactctgaggtgtcaggagagccctctgctgctttccaacacacaattaactccgtttccaaatacattccagtgtattttctgtgttgttcatagtcaatcaaacagggacactacaaacatggggagccataagggacatgtctttggcttcagaattgtttttagaaatttattcttatcttaggatttaccaaatagggcaaagaatcaacagtgaacagcttcacttaaaatcaaatttttctgggaagaaaatgagatgggttgagtttgctgtatacaaacaggtgctaacactgttcccagcaaagttttcagattgtaaaggtaggtgcatgccttcataaattatttctaaaacattaattgaggcttacagtaggagtgagaaatttttttccagaattgagagatgttttgttgatattggttctatttatttattgtatatatggatatttttaatttatgatataataaatatatatttatcatatttaataggataaattaatgagttttatccaagaccttacaaccacatttctggccatttaactagcactttataagccaatgaagcaaacacacagactctgtgagattctaaatgttcatgtgtaacttctagaaacacagcagaaactgatagataagggaataaagttgaaatgattccttaaaattcatggacacagataaatgcaaggtgagaattgacaaatgctataaatgctttctttttctgaaaagattttgaaaaatttaaaaaagtatagctactactgtgttcaaaacgttttaaatgacaaatgactttcccaggggaatttgcagttctgtaaatatcttaaataaaagccaacttaagaagagcccagcattaaatttacgatcttaggtggtaatgaaaagtatatgctgctttgtatttatgtaaaataattggccctctccatcttttctcatttcatgtgtcaggtagtttttctga

SEQ ID NO: 8741 - DNA, 2433 bp, Homo sapiens
agcagccggcgccgtctctgcccccgggcgccctatggcttgaagagcctggccacccagtggctccaccgccctgatggatccactgaatctgtcctggtatgatgatgatctggagaggcagaactggagccggcccttcaacgggtcagacgggaaggcggacagaccccactacaactactatgccacactgctcaccctgctcatcgctgtcatcgtcttcggcaacgtgctggtgtgcatggctgtgtcccgcgagaaggcgctgcagaccaccaccaactacctgatcgtcagcctcgcagtggccgacctcctcgtcgccacactggtcatgccctgggttgtctacctggaggtggtaggtgagtggaaattcagcaggattcactgtgacatcttcgtcactctggacgtcatgatgtgcacggcgagcatcctgaacttgtgtgccatcagcatcgacaggtacacagctgtggccatgcccatgctgtacaatacgcgctacagctccaagcgccgggtcaccgtcatgatctccatcgtctgggtcctgtccttcaccatctcctgcccactcctcttcggactcaataacgcagaccagaacgagtgcatcattgccaacccggccttcgtggtctactcctccatcgtctccttctacgtgcccttcattgtcaccctgctggtctacatcaagatctacattgtcctccgcagacgccgcaagcgagtcaacaccaaacgcagcagccgagctttcagggcccacctgagggctccactaaaggaggctgcccggcgagcccaggagctggagatggagatgctctccagcaccagcccacccgagaggacccggtacagccccatcccacccagccaccaccagctgactctccccgacccgtcccaccatggtctccacagcactcccgacagccccgccaaaccagagaagaatgggcatgccaaagaccaccccaagattgccaagatctttgagatccagaccatgcccaatggcaaaacccggacctccctcaagaccatgagccgtaggaagctctcccagcagaaggagaagaaagccactcagatgctcgccattgttctcggcgtgttcatcatctgctggctgcccttcttcatcacacacatcctgaacatacactgtgactgcaacatcccgcctgtcctgtacagcgccttcacgtggctgggctatgtcaacagcgccgtgaaccccatcatctacaccaccttcaacattgagttccgcaaggccttcctgaagatcctccactgctgactctgctgcctgcccgcacagcagcctgcttcccacctccctgcccaggccggccagcctcacccttgcgaaccgtgagcaggaaggcctgggtggatcggcctcctcttcaccccggcaggccctgcagtgttcgcttggctccatgctcctcactgcccgcacaccctcactctgccagggcagtgctagtgagctgggcatggtaccagccctggggctgggccccccagctcaggggcagctcatagagtcccccctcccacctccagtccccctatccttggcaccaaagatgcagccgccttccttgaccttcctctggggctctagggttgctggagcctgagtcagggcccagaggctgagttttctctttgtggggcttggcgtggagcaggcggtggggagagatggacagttcacaccctgcaaggcccacaggaggcaagcaagctctcttgccgaggagccaggcaacttcagtcctgggagacccatgtaaataccagactgcaggttggaccccagagattcccaagccaaaaaccttagctccctcccgcaccccgatgtggacctctactttccaggctagtccggacccacctcaccccgttacagctccccaagtggtttccacatgctctgagaagaggagccctcatcttgaagggcccaggagggtctatggggagaggaactccttggcctagcccaccctgctgccttctgacggccctgcaatgtatcccttctcacagcacatgctggccagcctggggcctggcagggaggtcaggccctggaactctatctgggcctgggctaggggacatcagaggttctttgagggactgcctctgccacactctgacgcaaaaccactttccttttctattccttctggcctttcctctctcctgtttcccttcccttccactgcctctgccttagaggagcccacggctaagaggctgctgaaaaccatctggcctggcctggccctgccctgaggaaggaggggaagctgcagcttgggagagcccctggggcctagactctgtaacatcactatccatgcaccaaactaataaaactttgacgagtca

SEQ ID NO: 8742 - DNA, 2704 bp, Homo sapiens
actgctccccgcgggccagagccggccgagctgctgcccgccggggctctgaacggcgcggcggggccgggagccagggaccggccgaggagagtggcggccccggacggctgccggaggggcggccgcgcgtggatgcggcgggagctggaagcctcaagcagccggcgccgtctctgcccccgggcgccctatggcttgaagagcctggccacccagtggctccaccgccctgatggatccactgaatctgtcctggtatgatgatgatctggagaggcagaactggagccggcccttcaacgggtcagacgggaaggcggacagaccccactacaactactatgccacactgctcaccctgctcatcgctgtcatcgtcttcggcaacgtgctggtgtgcatggctgtgtcccgcgagaaggcgctgcagaccaccaccaactacctgatcgtcagcctcgcagtggccgacctcctcgtcgccacactggtcatgccctgggttgtctacctggaggtggtaggtgagtggaaattcagcaggattcactgtgacatcttcgtcactctggacgtcatgatgtgcacggcgagcatcctgaacttgtgtgccatcagcatcgacaggtacacagctgtggccatgcccatgctgtacaatacgcgctacagctccaagcgccgggtcaccgtcatgatctccatcgtctgggtcctgtccttcaccatctcctgcccactcctcttcggactcaataacgcagaccagaacgagtgcatcattgccaacccggccttcgtggtctactcctccatcgtctccttctacgtgcccttcattgtcaccctgctggtctacatcaagatctacattgtcctccgcagacgccgcaagcgagtcaacaccaaacgcagcagccgagctttcagggcccacctgagggctccactaaagggcaactgtactcaccccgaggacatgaaactctgcaccgttatcatgaagtctaatgggagtttcccagtgaacaggcggagagtggtgcaggaggctgcccggcgagcccaggagctggagatggagatgctctccagcaccagcccacccgagaggacccggtacagccccatcccacccagccaccaccagctgactctccccgacccgtcccaccatggtctccacagcactcccgacagccccgccaaaccagagaagaatgggcatgccaaagaccaccccaagattgccaagatctttgagatccagaccatgcccaatggcaaaacccggacctccctcaagaccatgagccgtaggaagctctcccagcagaaggagaagaaagccactcagatgctcgccattgttctcggcgtgttcatcatctgctggctgcccttcttcatcacacacatcctgaacatacactgtgactgcaacatcccgcctgtcctgtacagcgccttcacgtggctgggctatgtcaacagcgccgtgaaccccatcatctacaccaccttcaacattgagttccgcaaggccttcctgaagatcctccactgctgactctgctgcctgcccgcacagcagcctgcttcccacctccctgcccaggccggccagcctcacccttgcgaaccgtgagcaggaaggcctgggtggatcggcctcctcttcaccccggcaggccctgcagtgttcgcttggctccatgctcctcactgcccgcacaccctcactctgccagggcagtgctagtgagctgggcatggtaccagccctggggctgggccccccagctcaggggcagctcatagagtcccccctcccacctccagtccccctatccttggcaccaaagatgcagccgccttccttgaccttcctctggggctctagggttgctggagcctgagtcagggcccagaggctgagttttctctttgtggggcttggcgtggagcaggcggtggggagagatggacagttcacaccctgcaaggcccacaggaggcaagcaagctctcttgccgaggagccaggcaacttcagtcctgggagacccatgtaaataccagactgcaggttggaccccagagattcccaagccaaaaaccttagctccctcccgcaccccgatgtggacctctactttccaggctagtccggacccacctcaccccgttacagctccccaagtggtttccacatgctctgagaagaggagccctcatcttgaagggcccaggagggtctatggggagaggaactccttggcctagcccaccctgctgccttctgacggccctgcaatgtatcccttctcacagcacatgctggccagcctggggcctggcagggaggtcaggccctggaactctatctgggcctgggctaggggacatcagaggttctttgagggactgcctctgccacactctgacgcaaaaccactttccttttctattccttctggcctttcctctctcctgtttcccttcccttccactgcctctgccttagaggagcccacggctaagaggctgctgaaaaccatctggcctggcctggccctgccctgaggaaggaggggaagctgcagcttgggagagcccctggggcctagactctgtaacatcactatccatgcaccaaactaataaaactttgacgagtcaccttccaggacccctgggt

SEQ ID NO: 8743 - DNA, 2789 bp, Homo sapiens
ccggcagcctcacgcgcgcaccgcgccgcctccgccccgtccccgcgctccctcctgcccgcccgccccgcgcccggccccgccccgccccgccccgccgcggcccgtccactgctccccgcgggccagagccggccgagctgctgcccgccggggctctgaacggcgcggcggggccgggagccagggaccggccgaggagagtggcggccccggacggctgccggaggggcggccgcgcgtggatgcggcgggagctggaagcctcaagcagccggcgccgtctctgcccccgggcgccctatggcttgaagagcctggccacccagtggctccaccgccctgatggatccactgaatctgtcctggtatgatgatgatctggagaggcagaactggagccggcccttcaacgggtcagacgggaaggcggacagaccccactacaactactatgccacactgctcaccctgctcatcgctgtcatcgtcttcggcaacgtgctggtgtgcatggctgtgtcccgcgagaaggcgctgcagaccaccaccaactacctgatcgtcagcctcgcagtggccgacctcctcgtcgccacactggtcatgccctgggttgtctacctggaggtggtaggtgagtggaaattcagcaggattcactgtgacatcttcgtcactctggacgtcatgatgtgcacggcgagcatcctgaacttgtgtgccatcagcatcgacaggtacacagctgtggccatgcccatgctgtacaatacgcgctacagctccaagcgccgggtcaccgtcatgatctccatcgtctgggtcctgtccttcaccatctcctgcccactcctcttcggactcaataacgcagaccagaacgagtgcatcattgccaacccggccttcgtggtctactcctccatcgtctccttctacgtgcccttcattgtcaccctgctggtctacatcaagatctacattgtcctccgcagacgccgcaagcgagtcaacaccaaacgcagcagccgagctttcagggcccacctgagggctccactaaagggcaactgtactcaccccgaggacatgaaactctgcaccgttatcatgaagtctaatgggagtttcccagtgaacaggcggagagtggaggctgcccggcgagcccaggagctggagatggagatgctctccagcaccagcccacccgagaggacccggtacagccccatcccacccagccaccaccagctgactctccccgacccgtcccaccatggtctccacagcactcccgacagccccgccaaaccagagaagaatgggcatgccaaagaccaccccaagattgccaagatctttgagatccagaccatgcccaatggcaaaacccggacctccctcaagaccatgagccgtaggaagctctcccagcagaaggagaagaaagccactcagatgctcgccattgttctcggcgtgttcatcatctgctggctgcccttcttcatcacacacatcctgaacatacactgtgactgcaacatcccgcctgtcctgtacagcgccttcacgtggctgggctatgtcaacagcgccgtgaaccccatcatctacaccaccttcaacattgagttccgcaaggccttcctgaagatcctccactgctgactctgctgcctgcccgcacagcagcctgcttcccacctccctgcccaggccggccagcctcacccttgcgaaccgtgagcaggaaggcctgggtggatcggcctcctcttcaccccggcaggccctgcagtgttcgcttggctccatgctcctcactgcccgcacaccctcactctgccagggcagtgctagtgagctgggcatggtaccagccctggggctgggccccccagctcaggggcagctcatagagtcccccctcccacctccagtccccctatccttggcaccaaagatgcagccgccttccttgaccttcctctggggctctagggttgctggagcctgagtcagggcccagaggctgagttttctctttgtggggcttggcgtggagcaggcggtggggagagatggacagttcacaccctgcaaggcccacaggaggcaagcaagctctcttgccgaggagccaggcaacttcagtcctgggagacccatgtaaataccagactgcaggttggaccccagagattcccaagccaaaaaccttagctccctcccgcaccccgatgtggacctctactttccaggctagtccggacccacctcaccccgttacagctccccaagtggtttccacatgctctgagaagaggagccctcatcttgaagggcccaggagggtctatggggagaggaactccttggcctagcccaccctgctgccttctgacggccctgcaatgtatcccttctcacagcacatgctggccagcctggggcctggcagggaggtcaggccctggaactctatctgggcctgggctaggggacatcagaggttctttgagggactgcctctgccacactctgacgcaaaaccactttccttttctattccttctggcctttcctctctcctgtttcccttcccttccactgcctctgccttagaggagcccacggctaagaggctgctgaaaaccatctggcctggcctggccctgccctgaggaaggaggggaagctgcagcttgggagagcccctggggcctagactctgtaacatcactatccatgcaccaaactaataaaactttgacgagtca

SEQ ID NO: 8744 - DNA, 1493 bp, Homo sapiens
atggatccactgaatctgtcctggtatgatgatgatctggagaggcagaactggagccggcccttcaacgggtcagacgggaaggcggacagaccccactacaactactatgccacactgctcaccctgctcatcgctgtcatcgtcttcggcaacgtgctggtgtgcatggctgtgtcccgcgagaaggcgctgcagaccaccaccaactacctgatcgtcagcctcgcagtggccgacctcctcgtcgccacactggtcatgccctgggttgtctacctggaggtggtaggtgagtggaaattcagcaggattcactgtgacatcttcgtcactctggacgtcatgatgtgcacggcgagcatcctgaacttgtgtgccatcagcatcgacaggtacacagctgtggccatgcccatgctgtacaatacgcgctacagctccaagcgccgggtcaccgtcatgatctccatcgtctgggtcctgtccttcaccatctcctgcccactcctcttcggactcaataacgcagaccagaacgagtgcatcattgccaacccggccttcgtggtctactcctccatcgtctccttctacgtgcccttcattgtcaccctgctggtctacatcaagatctacattgtcctccgcagacgccgcaagcgagtcaacaccaaacgcagcagccgagctttcagggcccacctgagggctccactaaagggcaactgtactcaccccgaggacatgaaactctgcaccgttatcatgaagtctaatgggagtttcccagtgaacaggcggagagtggtgcaggaggctgcccggcgagcccaggagctggagatggagatgctctccagcaccagcccacccgagaggacccggtacagccccatcccacccagccaccaccagctgactctccccgacccgtcccaccatggtctccacagcactcccgacagccccgccaaaccagagaagaatgggcatgccaaagaccaccccaagattgccaagatctttgagatccagaccatgcccaatggcaaaacccggacctccctcaagaccatgagccgtaggaagctctcccagcagaaggagaagaaagccactcagatgctcgccattgttctcggcgtgttcatcatctgctggctgcccttcttcatcacacacatcctgaacatacactgtgactgcaacatcccgcctgtcctgtacagcgccttcacgtggctgggctatgtcaacagcgccgtgaaccccatcatctacaccaccttcaacattgagttccgcaaggccttcctgaagatcctccactgctgactctgctgcctgcccgcacagcagcctgcttcccacctccctgcccaggccggccagcctcacccttgcgaaccgtgagcaggaaggcctgggtggatcggcctcctcttcaccccggcaggccctgcagtgttcgcttggctccatgctcctca

SEQ ID NO: 8745 - DNA, 443 bp, Homo sapiens
actgctccccgcgggccagagccggccgagctgctgcccgccggggctctgaacggcgcggcggggccgggagccagggaccggccgaggagagtggcggccccggacggctgccggaggggcggccgcgcgtggatgcggcgggagctggaagcctcaagcagccggcgccgtctctgcccccgggcgccctatggcttgaagtgcaggcgacggtggcggcagtagcggagggtgaccgcccggctctcggcccggctctatgatggaccgagagcccctctagggtggtatgcggagacaagagacacctctaagcaccagacagagcgcttccctatccctgtctgaggcgggcagcccttgagtgcttcctcttgaagagcagagagcctggccacccagtggctccaccgccctgatggatccactgaatctgtcct

SEQ ID NO: 8746 - DNA, 2467 bp, Homo sapiens
ttaagaagtgtttgttgaatgaataaataaatgatggatcagctctgttcaagctcatcttattatgcatttttaaaaaattgtgtttgctcatttgtcctaccagctgtaaaaacttgctagcaaaagagtggcagaaggcccaacatttttagaaaattcttagccgtaaaccttaaaatcccgagttggaaaattctcattattaaatgccaggagttggtcttcttcctggagacctctgcaagaggccctctcactgacaccttgtgtccatttttcctggccagagcctggccacccagtggctccaccgccctgatggatccactgaatctgtcctggtatgatgatgatctggagaggcagaactggagccggcccttcaacgggtcagacgggaaggcggacagaccccactacaactactatgccacactgctcaccctgctcatcgctgtcatcgtcttcggcaacgtgctggtgtgcatggctgtgtcccgcgagaaggcgctgcagaccaccaccaactacctgatcgtcagcctcgcagtggccgacctcctcgtcgccacactggtcatgccctgggttgtctacctggaggtggtaggtgagtggaaattcagcaggattcactgtgacatcttcgtcactctggacgtcatgatgtgcacggcgagcatcctgaacttgtgtgccatcagcatcgacaggtacacagctgtggccatgcccatgctgtacaatacgcgctacagctccaagcgccgggtcaccgtcatgatctccatcgtctgggtcctgtccttcaccatctcctgcccactcctcttcggactcaataacgcagaccagaacgagtgcatcattgccaacccggccttcgtggtctactcctccatcgtctccttctacgtgcccttcattgtcaccctgctggtctacatcaagatctacattgtcctccgcagacgccgcaagcgagtcaacaccaaacgcagcagccgagctttcagggcccacctgagggctccactaaagggcaactgtactcaccccgaggacatgaaactctgcaccgttatcatgaagtctaatgggagtttcccagtgaacaggcggagagtggaggctgcccggcgagcccaggagctggagatggagatgctctccagcaccagcccacccgagaggacccggtacagccccatcccacccagccaccaccagctgactctccccgacccgtcccaccatggtctccacagcactcccgacagccccgccaaaccagagaagaatgggcatgccaaagaccaccccaagattgccaagatctttgagatccagaccatgcccaatggcaaaacccggacctccctcaagaccatgagccgtaggaagctctcccagcagaaggagaagaaagccactcagatgctcgccattgttctcggcgtgttcatcatctgctggctgcccttcttcatcacacacatcctgaacatacactgtgactgcaacatcccgcctgtcctgtacagcgccttcacgtggctgggctatgtcaacagcgccgtgaaccccatcatctacaccaccttcaacattgagttccgcaaggccttcctgaagatcctccactgctgactctgctgcctgcccgcacagcagcctgcttcccacctccctgcccaggccggccagcctcacccttgcgaaccgtgagcaggaaggcctgggtggatcggcctcctcttcaccccggcaggccctgcagtgttcgcttggctccatgctcctcactgcccgcacaccctcactctgccagggcagtgctagtgagctgggcatggtaccagccctggggctgggccccccagctcaggggcagctcatagagtcccccctcccacctccagtccccctatccttggcaccaaagatgcagccgccttccttgaccttcctctggggctctagggttgctggagcctgagtcagggcccagaggctgagttttctctttgtggggcttggcgtggagcaggcggtggggagagatggacagttcacaccctgcaaggcccacaggaggcaagcaagctctcttgccgaggagccaggcaacttcagtcctgggagacccatgtaaataccagactgcaggttggaccccagagattcccaagccaaaaaccttagctccctcccgcaccccgatgtggacctctactttccaggctagtccggacccacctcaccccgttacagctccccaagtggtttccacatgctctgagaagaggagccctcatcttgaagggcccaggagggtctatggggagaggaactccttggcctagcccaccctgctgccttctgacggccctgcaatgtatcccttctcacagcacatgctggccagcctggggcctggcagggaggtcaggccctggaactc

SEQ ID NO: 8747 - DNA, 714 bp, Homo sapiens
gccagatgctgactgcctgtcagaattcagtccctacacaccccgccccatgtctgtctgtcttgcttcatggaccactcacaccccagagttccgcctgccttctctgttgcccaccaaacccgtgtgtgtttgttcgttcatatgcaagagcctggccacccagtggctccaccgccctgatggatccactgaatctgtcctggtatgatgatgatctggagaggcagaactggagccggcccttcaacgggtcagacgggaaggcggacagaccccactacaactactatgccacactgctcaccctgctcatcgctgtcatcgtcttcggcaacgtgctggtgtgcatggctgtgtcccgcgagaaggcgctgcagaccaccaccaactacctgatcgtcagcctcgcagtggccgacctcctcgtcgccacactggtcatgccctgggttgtctacctggaggtggtaggtgagtggaaattcagcaggattcactgtgacatcttcgtcactctggacgtcatgatgtgcacggcgagcatcctgaacttgtgtgccatcagcatcgacaggtacacagctgtggccatgcccatgctgtacaatacgcgctacagctccaagcgccgggtcaccgtcatgatctccatcgtctgggtcctgtccttcaccatctcctgcccactcctcttcggactcaataacgcag

SEQ ID NO: 8748 - DNA, 2473 bp, Homo sapiens
agagcctggccacccagtggctccaccgccctgatggatccactgaatctgtcctggtatgatgatgatctggagaggcagaactggagccggcccttcaacgggtcagacgggaaggcggacagaccccactacaactactatgccacactgctcaccctgctcatcgctgtcatcgtcttcggcaacgtgctggtgtgcatggctgtgtcccgcgagaaggcgctgcagaccaccaccaactacctgatcgtcagcctcgcagtggccgacctcctcgtcgccacactggtcatgccctgggttgtctacctggaggtaggtgagtggaaattcagcaggattcactgtgacatcttcgtcactctggacgtcatgatgtgcacggcgagcatcctgaacttgtgtgccatcagcatcgacaggtacacagctgtggccatgcccatgctgtacaatacgcgctacagctccaagcgccgggtcaccgtcatgatctccatcgtctgggtcctgtccttcaccatctcctgcccactcctcttcggactcaataacgcagaccagaacgagtgcatcattgccaacccggccttcgtggtctactcctccatcgtctccttctacgtgcccttcattgtcaccctgctggtctacatcaagatctacattgtcctccgcagacgccgcaagcgagtcaacaccaaacgcagcagccgagctttcagggcccacctgagggctccactaaagggcaactgtactcaccccgaggacatgaaactctgcaccgttatcatgaagtctaatgggagtttcccagtgaacaggcggagagtggaggctgcccggcgagcccaggagctggagatggagatgctctccagcaccagcccacccgagaggacccggtacagccccatcccacccagccaccaccagctgactctccccgacccgtcccaccatggtctccacagcactcccgacagccccgccaaaccagagaagaatgggcatgccaaagaccaccccaagattgccaagatctttgagatccagaccatgcccaatggcaaaacccggacctccctcaagaccatgagccgtaggaagctctcccagcagaaggagaagaaagccactcagatgctcgccattgttctcggcgtgttcatcatctgctggctgcccttcttcatcacacacatcctgaacatacactgtgactgcaacatcccgcctgtcctgtacagcgccttcacgtggctgggctatgtcaacagcgccgtgaaccccatcatctacaccaccttcaacattgagttccgcaaggccttcctgaagatcctccactgctgactctgctgcctgcccgcacagcagcctgcttcccacctccctgcccaggccggccagcctcacccttgcgaaccgtgagcaggaaggcctgggtggatcggcctcctcttcaccccggcaggccctgcagtgttcgcttggctccatgctcctcactgcccgcacaccctcactctgccagggcagtgctagtgagctgggcatggtaccagccctggggctgggccccccagctcaggggcagctcatagagtcccccctcccacctccagtccccctatccttggcaccaaagatgcagccgccttccttgaccttcctctggggctctagggttgctggagcctgagtcagggcccagaggctgagttttctctttgtggggcttggcgtggagcaggcggtggggagagatggacagttcacaccctgcaaggcccacaggaggcaagcaagctctcttgccgaggagccaggcaacttcagtcctgggagacccatgtaaataccagactgcaggttggaccccagagattcccaagccaaaaaccttagctccctcccgcaccccgatgtggacctctactttccaggctagtccggacccacctcaccccgttacagctccccaagtggtttccacatgctctgagaagaggagccctcatcttgaagggcccaggagggtctatggggagaggaactccttggcctagcccaccctgctgccttctgacggccctgcaatgtatcccttctcacagcacatgctggccagcctggggcctggcagggaggtcaggccctggaactctatctgggcctgggctaggggacatcagaggttctttgagggactgcctctgccacactctgacgcaaaaccactttccttttctattccttctggcctttcctctctcctgtttcccttcccttccactgcctctgccttagaggagcccacggctaagaggctgctgaaaaccatctggcctggcctggccctgccctgaggaaggaggggaagctgcagcttgggagagcccctggggcctagactctgtaacatcactatccatgcaccaaactaataaaactttgacgagtc

SEQ ID NO: 8749 - DNA, 1542 bp, Homo sapiens
gatagagagacaaagaggaaaagagagcgaggtagaaaacggatactgcctatgcctactccatccctctttcagcaccaaggacagaacctctgagcggctgacccaagcaacgctcagtttagggtccctcccaaatcctctaaagaaaacggatacattcgaaagcagctatgaaacatgcactaaggtctaatagggaagctggaaaagcagcactcaagtaatttcaccttagaggcaaaaatgggtgatttctttctgttcatttcatagtttctgagtcctgagaaaggcaaagtttgctttgcttgggtatgtctgctgtcagtaaatggctgcaggagccgaagtggtaaactcctcggtctccagaaatcagaagaaaattttagggaagccccttggcatcacgcacctccctctgggctatggcatctctgagccagctgagtggccacctgaactacacctgtggggcagagaactccacaggtgccagccaggcccgcccacatgcctactatgccctctcctactgcgcgctcatcctggccatcgtcttcggcaatggcctggtgtgcatggctgtgctgaaggagcgggccctgcagactaccaccaactacttagtagtgagcctggctgtggcagacttgctggtggccaccttggtgatgccctgggtggtatacctggaggtgacaggtggagtctggaatttcagccgcatttgctgtgatgtttttgtcaccctggatgtcatgatgtgtacagccagcatccttaatctctgtgccatcagcatagacaggtacactgcagtggtcatgcccgttcactaccagcatggcacgggacagagctcctgtcggcgcgtggccctcatgatcacggccgtctgggtactggcctttgctgtgtcctgccctcttctgtttggctttaataccacaggggaccccactgtctgctccatctccaaccctgattttgtcatctactcttcagtggtgtccttctacctgccctttggagtgactgtccttgtctatgccagaatctatgtggtgctgaaacaaaggagacggaaaaggatcctcactcgacagaacagtcagtgcaacagtgtcaggcctggcttcccccagcaaaccctctctcctgacccggcacatctggagctgaagcgttactacagcatctgccaggacactgccttgggtggaccaggcttccaagaaagaggaggagagttgaaaagagaggagaagactcggaattccctgagtgccacttcgggagaagaaggcaacccaaatggtggccattgtgcttggggccttcattgtctgctggctgcccttcttcttgacccatgttctcaatacccactgccagacatgccacgtgtccccagagctttacagtgccacgacatggctgggctacgtgaatagcgccctcaaccctgtgatctataccaccttcaatatcgagttccggaaagccttcctcaagatcctgtcttgctgagggagc

SEQ ID NO: 8750 - DNA, 1535 bp, Homo sapiens
gatagagagacaaagaggaaaagagagcgaggtagaaaacggatactgcctatgcctactccatccctctttcagcaccaaggacagaacctctgagcggctgacccaagcaacgctcagtttagggtccctcccaaatcctctaaagaaaacggatacattcgaaagcagctatgaaacatgcactaaggtctaatagggaagctggaaaagcagcactcaagtaatttcaccttagaggcaaaaatgggtgatttctttctgttcatttcatagtttctgagtcctgagaaaggcaaagtttgctttgcttgggtatgtctgctgtcagtaaatggctgcaggagccgaagtggtaaactcctcggtctccagaaatcagaagaaaattttagggaagccccttggcatcacgcacctccctctgggctatggcatctctgagccagctgagtggccacctgaactacacctgtggggcagagaactccacaggtgccagccaggcccgcccacatgcctactatgccctctcctactgcgcgctcatcctggccatcgtcttcggcaatggcctggtgtgcatggctgtgctgaaggagcgggccctgcagactaccaccaactacttagtagtgagcctggctgtggcagacttgctggtggccaccttggtgatgccctgggtggtatacctggaggtgacaggtggagtctggaatttcagccgcatttgctgtgatgtttttgtcaccctggatgtcatgatgtgtacagccagcatccttaatctctgtgccatcagcatagacaggtacactgcagtggtcatgcccgttcactaccagcatggcacgggacagagctcctgtcggcgcgtggccctcatgatcacggccgtctgggtactggcctttgctgtgtcctgccctcttctgtttggctttaataccacaggggaccccactgtctgctccatctccaaccctgattttgtcatctactcttcagtggtgtccttctacctgccctttggagtgactgtccttgtctatgccagaatctatgtggtgctgaaacaaaggagacggaaaaggatcctcactcgacagaacagtcagtgcaacagtgtcaggcctggcttcccccagcaaaccctctctcctgacccggcacatctggagctgaagcgttactacagcatctgccaggacactgccttgggtggaccaggcttccaagaaagaggaggagagttgaaaagagaggagaagactcggaattccctgatgccacttcgggagaagaaggcaacccaaatggtggccattgtgcttggggccttcattgtctgctggctgcccttcttcttgacccatgttctcaatacccactgccagacatgccacgtgtccccagagctttacagtgccacgacatggctgggctacgtgaatagcgccctcaaccctgtgatctataccaccttcaatatcgagttccggaaagccttcctcaagatcctgtcttgctga

SEQ ID NO: 8751 - DNA, 1640 bp, Homo sapiens
gatagagagacaaagaggaaaagagagcgaggtagaaaacggatactgcctatgcctactccatccctctttcagcaccaaggacagaacctctgagcggctgacccaagcaacgctcagtttagggtccctcccaaatcctctaaagaaaacggatacattcgaaagcagctatgaaacatgcactaaggtctaatagggaagctggaaaagcagcactcaagtaatttcaccttagaggcaaaaatgggtgatttctttctgttcatttcatagtttctgagtcctgagaaaggcaaagtttgctttgcttgggtatgtctgctgtcagtaaatggctgcaggagccgaagtggtaaactcctcggtctccagaaatcagaagaaaattttagggaagccccttggcatcacgcacctccctctgggctatggcatctctgagccagctgagtggccacctgaactacacctgtggggcagagaactccacaggtgccagccaggcccgcccacatgcctactatgccctctcctactgcgcgctcatcctggccatcgtcttcggcaatggcctggtgtgcatggctgtgctgaaggagcgggccctgcagactaccaccaactacttagtagtgagcctggctgtggcagacttgctggtggccaccttggtgatgccctgggtggtatacctggaggtgacaggtggagtctggaatttcagccgcatttgctgtgatgtttttgtcaccctggatgtcatgatgtgtacagccagcatccttaatctctgtgccatcagcatagacaggtacactgcagtggtcatgcccgttcactaccagcatggcacgggacagagctcctgtcggcgcgtggccctcatgatcacggccgtctgggtactggcctttgctgtgtcctgccctcttctgtttggctttaataccacaggggaccccactgtctgctccatctccaaccctgattttgtcatctactcttcagtggtgtccttctacctgccctttggagtgactgtccttgtctatgccagaatctatgtggtgctgaaacaaaggagacggaaaaggatcctcactcgacagaacagtcagtgcaacagtgtcaggcctggcttcccccagcaaaccctctctcctgacccggcacatctggagctgaagcgttactacagcatctgccaggacactgccttgggtggaccaggcttccaagaaagaggaggagagttgaaaagagaggagaagactcggaattccctgagtcccaccatagcgcccaagctcagcttagaagttcgaaaactcagcaatggcagattatcgacatctttgaagctggggcccctgcaacctcggggagtgccacttcgggagaagaaggcaacccaaatggtggccattgtgcttggggccttcattgtctgctggctgcccttcttcttgacccatgttctcaatacccactgccagacatgccacgtgtccccagagctttacagtgccacgacatggctgggctacgtgaatagcgccctcaaccctgtgatctataccaccttcaatatcgagttccggaaagccttcctcaagatcctgtcttgctgagggagc

SEQ ID NO: 8752 - DNA, 1557 bp, Homo sapiens
attataaaagcaagttcaacctcctcttgctctcaccctttcttgctcttctgccttccgccatgagatgacacagcacaaaggtctttgccagatgtctgtgccacactcttggacttcccggactccagaacttttctgagtcctgagaaaggcaaagtttgctttgcttgggtatgtctgctgtcagtaaatggctgcaggagccgaagtggtaaactcctcggtctccagaaatcagaagaaaattttagggaagccccttggcatcacgcacctccctctgggctatggcatctctgagccagctgagtggccacctgaactacacctgtggggcagagaactccacaggtgccagccaggcccgcccacatgcctactatgccctctcctactgcgcgctcatcctggccatcgtcttcggcaatggcctggtgtgcatggctgtgctgaaggagcgggccctgcagactaccaccaactacttagtagtgagcctggctgtggcagacttgctggtggccaccttggtgatgccctgggtggtatacctggaggtgacaggtggagtctggaatttcagccgcatttgctgtgatgtttttgtcaccctggatgtcatgatgtgtacagccagcatccttaatctctgtgccatcagcatagacaggtacactgcagtggtcatgcccgttcactaccagcatggcacgggacagagctcctgtcggcgcgtggccctcatgatcacggccgtctgggtactggcctttgctgtgtcctgccctcttctgtttggctttaataccacaggggaccccactgtctgctccatctccaaccctgattttgtcatctactcttcagtggtgtccttctacctgccctttggagtgactgtccttgtctatgccagaatctatgtggtgctgaaacaaaggagacggaaaaggatcctcactcgacagaacagtcagtgcaacagtgtcaggcctggcttcccccagcaaaccctctctcctgacccggcacatctggagctgaagcgttactacagcatctgccaggacactgccttgggtggaccaggcttccaagaaagaggaggagagttgaaaagagaggagaagactcggaattccctgagtcccaccatagcgcccaagctcagcttagaagttcgaaaactcagcaatggcagattatcgacatctttgaagctggggcccctgcaacctcggggagtgccacttcgggagaagaaggcaacccaaatggtggccattgtgcttggggccttcattgtctgctggctgcccttcttcttgacccatgttctcaatacccactgccagacatgccacgtgtccccagagctttacagtgccacgacatggctgggctacgtgaatagcgccctcaaccctgtgatctataccaccttcaatatcgagttccggaaagccttcctcaagatcctgtcttgctgagggagcagaagagggaacactctttgtacccatttctagctgccaggctgttggcccactcaga

SEQ ID NO: 8753 - DNA, 1554 bp, Homo sapiens
ggtaaactcctcggtctccagaaatcagaagaaaattttaggaaagagaacaaataattaaaactctgtaagtcttaatgaggtgctaaggaggaaccccacgaatgtttcaggaagactgttattcagcactgagggattgaacatcagcaaagcaggacaaatgtcataactgatggggacctgacaactctctgttcccctgcctttttaaataggttatgcactcactctaagagatgccagaacaaactataaagaccaagataaatcaatactttgtaaggcatttaaaagctcattaaaatgtgaagccccttggcatcacgcacctccctctgggctatggcatctctgagccagctgagtggccacctgaactacacctgtggggcagagaactccacaggtgccagccaggcccgcccacatgcctactatgccctctcctactgcgcgctcatcctggccatcgtcttcggcaatggcctggtgtgcatggctgtgctgaaggagcgggccctgcagactaccaccaactacttagtagtgagcctggctgtggcagacttgctggtggccaccttggtgatgccctgggtggtatacctggaggtgacaggtggagtctggaatttcagccgcatttgctgtgatgtttttgtcaccctggatgtcatgatgtgtacagccagcatccttaatctctgtgccatcagcatagacaggtacactgcagtggtcatgcccgttcactaccagcatggcacgggacagagctcctgtcggcgcgtggccctcatgatcacggccgtctgggtactggcctttgctgtgtcctgccctcttctgtttggctttaataccacaggggaccccactgtctgctccatctccaaccctgattttgtcatctactcttcagtggtgtccttctacctgccctttggagtgactgtccttgtctatgccagaatctatgtggtgctgaaacaaaggagacggaaaaggatcctcactcgacagaacagtcagtgcaacagtgtcaggcctggcttcccccagcaaaccctctctcctgacccggcacatctggagctgaagcgttactacagcatctgccaggacactgccttgggtggaccaggcttccaagaaagaggaggagagttgaaaagagaggagaagactcggaattccctgagtcccaccatagcgcccaagctcagcttagaagttcgaaaactcagcaatggcagattatcgacatctttgaagctggggcccctgcaacctcggggagtgccacttcgggagaagaaggcaacccaaatggtggccattgtgcttggggccttcattgtctgctggctgcccttcttcttgacccatgttctcaatacccactgccagacatgccacgtgtccccagagctttacagtgccacgacatggctgggctacgtgaatagcgccctcaaccctgtgatctataccaccttcaatatcgagttccggaaagccttcctcaagatcctgtcttgctgagggagc

SEQ ID NO: 8754 - DNA, 1375 bp, Homo sapiens
cccgggcgcgccatggggaaccgcagcaccgcggacgcggacgggctgctggctgggcgcgggccggccgcgggggcatctgcgggggcatctgcggggctggctgggcagggcgcggcggcgctggtggggggcgtgctgctcatcggcgcggtgctcgcggggaactcgctcgtgtgcgtgagcgtggccaccgagcgcgccctgcagacgcccaccaactccttcatcgtgagcctggcggccgccgacctcctcctcgctctcctggtgctgccgctcttcgtctactccgaggtccagggtggcgcgtggctgctgagcccccgcctgtgcgacgccctcatggccatggacgtcatgctgtgcaccgcctccatcttcaacctgtgcgccatcagcgtggacaggttcgtggccgtggccgtgccgctgcgctacaaccggcagggtgggagccgccggcagctgctgctcatcggcgccacgtggctgctgtccgcggcggtggcggcgcccgtactgtgcggcctcaacgacgtgcgcggccgcgaccccgccgtgtgccgcctggaggaccgcgactacgtggtctactcgtccgtgtgctccttcttcctaccctgcccgctcatgctgctgctctactgggccacgttccgcggcctgcagcgctgggaggtggcacgtcgcgccaagctgcacggccgcgcgccccgccgacccagcggccctggcccgccttcccccacgccacccgcgccccgcctcccccaggacccctgcggccccgactgtgcgccccccgcgcccggccttccccggggtccctgcggccccgactgtgcgcccgccgcgcccagcctcccccaggacccctgcggccccgactgtgcgccccccgcgcccggcctccccccggacccctgcggctccaactgtgctccccccgacgccgtcagagccgccgcgctcccaccccagactccaccgcagacccgcaggaggcggcgtgccaagatcaccggccgggagcgcaaggccatgagggtcctgccggtggtggtcggggccttcctgctgtgctggacgcccttcttcgtggtgcacatcacgcaggcgctgtgtcctgcctgctccgtgcccccgcggctggtcagcgccgtcacctggctgggctacgtcaacagcgccctcaaccccgtcatctacactgtcttcaacgccgagttccgcaacgtcttccgcaaggccctgcgtgcctgctgctgagccgggcacccccggacgccccccggcctgatggccaggcctcagggaccaaggagatggggagggcgcttttgtacgttaattaaacaaattccttcccaaa

SEQ ID NO: 8755 - DNA, 2375 bp, Homo sapiens
agtgccagcctggcgcccgcgactgcctgccccagcccctcagtggcggcttgctctcttctctcgctccgaaccagacacagccgctgccgctgccgtccggcgcgctacagactcccgagaacagccctggctgtcagcgagcaccagccgcttcctgtccccatcgcggagactggaggggcgcaccacggccatggagccagaggcgcttcaggaggcaagagaagtccccgcgcgctccgcagcccggcgcagctcatggtgagcgccctctggggctcgagggtcccttggctgagggggcgcatcctcggggtgcccgatggggctgcctgggggtcgcagggctgaagttgggaccgcgcacagaccgcccctgcagtccagcccgaaatgctgccgccaggcagcaacggcaccgcgtacccggggcagttcgctctataccagcagctggcgcaggggaacgccgtggggggctcggcgggggcaccgccactggggccctcacaggtggtcaccgcctgcctgctgaccctactcatcatctggaccctgctgggcaacgtgctggtgtgcgcagccatcgtgcggagccgccacctgcgcgccaacatgaccaacgtcttcatcgtgtctctggccgtgtcagaccttttcgtggcgctgctggtcatgccctggaaggcagtcgccgaggtggccggttactggccctttggagcgttctgcgacgtctgggtggccttcgacatcatgtgctccactgcctccatcctgaacctgtgcgtcatcagcgtggaccgctactgggccatctccaggcccttccgctacaagcgcaagatgactcagcgcatggccttggtcatggtcggcctggcatggaccttgtccatcctcatctccttcattccggtccagctcaactggcacagggaccaggcggcctcttggggcgggctggacctgccaaacaacctggccaactggacgccctgggaggaggacttttgggagcccgacgtgaatgcagagaactgtgactccagcctgaatcgaacctacgccatctcttcctcgctcatcagcttctacatccccgttgccatcatgatcgtgacctacacgcgcatctaccgcatcgcccaggtgcagatccgcaggatttcctccctggagagggccgcagagcacgcgcagagctgccggagcagcgcagcctgcgcgcccgacaccagcctgcgcgcttccatcaagaaggagaccaaggttctcaagaccctgtcggtgatcatgggggtcttcgtgtgttgctggctgcccttcttcatccttaactgcatggtccctttctgcagtggacaccccgaaggccctccggccggcttcccctgcgtcagtgagaccaccttcgacgtcttcgtctggttcggctgggctaactcctcactcaaccccgtcatctatgccttcaacgccgactttcagaaggtgtttgcccagctgctggggtgcagccacttctgctcccgcacgccggtggagacggtgaacatcagcaatgagctcatctcctacaaccaagacatcgtcttccacaaggaaatcgcagctgcctacatccacatgatgcccaacgccgttacccccggcaaccgggaggtggacaacgacgaggaggagggtcctttcgatcgcatgttccagatctatcagacgtccccagatggtgaccctgttgctgagtctgtctgggagctggactgcgagggggagatttctttagacaaaataacacctttcaccccgaatggattccattaaactgcattaagaaaccccctcatggatctgcataaccgcacagacattgacaagcacgcacacacacgcaaatacatgcctttccagtgctgctccctttatcatgtgtttctgtgtagtagctcgtgtgcttagaaacctcaccccattgattggtagttcgaagaattggcagaagcagttgcaataaactcagtcaaatgtacccagcctaccagagatggaccaacgatcctatgagagaagagagtatggtgctgggtccttaaaaaaaaaaatgatacttggtccttaaaaaatatgctctcccctccctttttaaacaaatggcttgttcagtcacttgtttgtgtttgaattgatttttaaacagcaggttgtgtgtgtgtgcagtgatgtggtgggagcacagctttcctgggtctggattcccgtggctttgtgcttatgtcatttcttctctctgtgctggtgggggcctctttaccatagcttaagaagtatccctgatttattctggtgtctaataaacacagattatttgt

SEQ ID NO: 8756 - DNA, 623 bp, Homo sapiens
gacccgcgcggtggggaagagccgctgccgctggttctccggctcttcctcggcggttctggctcccggccgcgccgcagccctgcccagtctctctcccccagcccggagggctcctccgcgccgcacgtgagcgcgcccgccaacagggccactgccgcgatacttttctgctgtgagaatgtaagatggatccagaagagcaggagctcttaaatgattacagatacagaagctactcttcagtgattgaaaaggctttgagaaattttgagtcctcgagtgaatgggcggatctcatatcttcacttggcaaactcaacaaggctcttcagagtaacctgaggtactccttgttgccaagacggctcctcatcagcaaaagattagctcagtgtttgcaccctgccctgcccagtggtgtccacttaaaagctctggaaacctacgagattatctttaaaatcgtggggaccaaatggctggccaaggacttgtttctgtacagctgcgggttatttcctctcctggcacacgcggcggtgtcggtgaggccggtgctgctcaccctgtacgagaagtacttcctcccactgcagaagctgctcctgcccagtctgcag

SEQ ID NO: 8757 - DNA, 7685 bp, Homo sapiens
ttcatctcccacagtgcctggcccagaagccttgctaaatatttgaacaggattgcccaatacttttctgctgtgagaatgtaagatggatccagaagagcaggagctcttaaatgattacagatacagaagctactcttcagtgattgaaaaggctttgagaaattttgagtcctcgagtgaatgggcggatctcatatcttcacttggcaaactcaacaaggctcttcagagtaacctgaggtactccttgttgccaagacggctcctcatcagcaaaagattagctcagtgtttgcaccctgccctgcccagtggtgtccacttaaaagctctggaaacctacgagattatctttaaaatcgtggggaccaaatggctggccaaggacttgtttctgtacagctgcgggttatttcctctcctggcacacgcggcggtgtcggtgaggccggtgctgctcaccctgtacgagaagtacttcctcccactgcagaagctgctcctgcccagtctgcaggccttcatcgtgggcctgctgcccggccttgaagagggctccgagatctccgacagaacggatgctctgctcctgagactgtcgctggtggttggcaaagaggtgttttacaccgccctctgggggagcgtcctggccagcccgtccatccgcctccctgcctcagtcttcgtggtgggccacatcaacagggatgcccccggccgggagcagaagtacatgctggggaccaatcaccaactcacggtgaagtctttgcgtgcctccctgttggactcaaatgttcttgtgcaaagaaataatctggaaatcgttctgtttttcttcccattttatacctgtctggattccaatgagagagccatccccctcctcagatctgacatcgtgcgcattctctcagccgccacccagaccctactgagaagggacatgtccctgaacagaagactgtatgcatggttactaggctcagacataaaaggaaataccgttgtgccagaatctgaaatctcaaattcttatgaagaccagtcgtcttatttttttgaaaaatactccaaggatcttttagttgagggtttggctgagatattgcatcagaagttcatagatgctgacgtggaggaacgccatcatgcatacctgaagccttttcgcgtcctcatcagtctgcttgacaagccagaaatagggcctcaagtggttgggaatttgtttctcgaagtcatcagggccttttattcttactgcagagatgcccttggctctgatcttaaacttagctacacccagagtggaaattcgctgataagtgcaatcaaggaaaacagaaatgcctctgagattgtcaaaacggtaaatttgctgataacttctctaagcacagactttctctgggattatatgacaaggtgttttgaggaatgctttagaccagtgaagcagcgttacagcgtgaggaacagcgtcagccctccccccacggtctcggagctctgcgccctcctggtcttcctgctggatgtcattcctttggaactttactctgaggtgcaaacccagtatctccctcaggtgctcggctgcctggtgcagcctcttgctgaggacatggaggccttaagtttacctgaactcacgcatgccttgaagacgtgtttcaaggtgctcagcaaagtccagatgcctccttcctacctcgacacggagtccaccagcggaacctcgagtccagtaaaaggtgaaaacggcaaaataattttggaaacaaaggcagtgattcccggtgacgaagatgcttcgtttccccctctgaagtctgaggacagtgggatcgggctcagtgcctcgtcaccggagctctctgagcacttgagggttcctcgagtttctctggaaagggacgacgtttggaagaagggcgggagcatgcagaggacgtttctttgcatccaagagctaatcgccaactttgccagcaagaacatttttggagtacagctgacagcgtcaggagaagaaagcaagtccgaggagcctgcagggaagagggacagggatgggacgcagagcctggcagccaatgattccagcaggaagaactcttgggagcccaagcccatcactgtgcctcagttcaagcagatgctgtcagacttgttcacagcacgagggtctccattcaagacaaaaagttcagagtcaccatcgtcttcgcccagcagccctgccaggaaaaacgggggagaatgggatgttgagaaggtggtcattgacctggggggttccagggaggaacgcagggaggcctttgccgccgcctgccacctgctgctggattgtgccactttccctgtctacctgtccgaggaagagaccgagcagctctgtgcaacgctcttccagctgccaggagccggtgattccagttttccatcttggctgaagtccctcatgactatttgctgctgtgtgactgactgctacctccagaacgtggccatttccactctgctggaagtgataaaccattcccagtccctggcgcttgtcattgaagacaagatgaaacgctataagagctctggacacaaccctttttttggcaagctgcagatggtgacggttcctcccattgctccagggatattgaaagtcattgcagagaaaacagatttctatcagagggtggctcgtgtgctttggaatcagctgaacaaagagacccgggagcatcacgtcacctgcgtagaattgttctaccggctgcactgcctggcccctacggccaacatctgcgaggacatcatctgccatgccctcctggaccctgacaagggaacaaggctggaagctctgtttagattttccgtgatctggcatctgacaagagagatccaaggcagtcgagtaacatctcacaatcgctcctttgataggtccttgtttgtcgtgctggacagcctggcctgcacggatggtgccatcggtgcggcagcccagggctggctggtgcgtgcgctctccctcggggacgtggctcgcatcctcgaacccgtgctcctgctgctgctgcagccaaaaacccagagaacctccatccactgcctcaagcaggagaactcggccgatgacttgcaccgttggtttaacaggaagaaaacctctttcagagaggcatgcgcagtgcccgagcctcaggagagcggctctgaagagcacctgcctctgagccagttcaccacagtggaccgtgaagccatttgggccgaagtggagaaggagcccgagaagtacccgctgcgaggcgagctgagcgaggaagagctgccctactacgtggagcttccagacaggacggcccacggcgccccggacagcagcgagcacaccgagtctgcagatacaagctcctgccacacggacagcgagaacacgtcctccttctcctccccttcccacgacctgcaggagctgagcaacgaagagaactgctgtgcacccatccccatggggggcagggcgtaccccaagcgctcggccctgctggcggccttccagtcagaaagcttcaaggctggggccaagttaagcctggtgcgggtggactcggacaagacgcaggcttctgagtcgttctccagcgacgaggaggcggacttggagctccaggccctcaccacatccaggctgctaaagcagcagcgggaaaggcaggaggccgtcgaggccttgttcaagcacatcctgctctacctgcagccctacgactctcggcgggtcctctatgccttctcggtgctggaggctgtgctcaaaaccaaccctaaggaattcatcgaggctgtgtccaggactagcatggataccagctccaccgcgcacctcaacctcatctccaacctcctcgctcgccaccaggaggccctcattggccagagtttctacggaaagctccagacccaggtccccaacgtgtgcccccactctctgctcctggagctgctcacctacctctgcctgagcttcctgcgctcctactacccttgctatttgaaggtctcgcaccgagacattctcggcaaccgggacgtgcaggtcaaaagtgtcgaggttttgatcaggataatgatgcagctggtctcagtggccaagtcttcggaagggaagaacgtggagttcatccacagcttgctgcagaggtgcaaagttcaggagtttgtcctgctctccctgtcggcgtccatgtacacgagccagaagcgctacgggctggccaccgcccaccacggcagggccctgccagaggacagcctctttgaggagagtctcattaacttgggtcaggaccagatctggagtgagcacccgctgcagattgagctgctgaagctgctgcaggtgctgattgtcttggaacaccacctgggtcgggcccatgaggaggcggaaaaccagcccgacctgtcccgggagtggcagagagccctgaacttccagcaggccatcagcgccctgcagtacgtgcagccccaccccctcacctcccagggtcttctggtctctgcggtggtgaggggtctgcagcccgcctacggttacggcatgcatccggcctgggtgagcttggtcacgcattccttgccctacttcggaaagtccctgggctggacggtgacaccctttgttgtccagatttgcaaaaacttggatgacttggtcaagcagtatgaaagcgaatctgtgaagctctctgtcagcacaacctccaagagggaaaacatttctccagattatccactcacccttctagaaggtctaacgaccattagtcatttttgtcttttggaacaagccaaccaaaacaaaaagaccatggctgcaggtgatcctgccaacttgaggaatgccagaaatgccattttggaagagctgcctcgaactgttaacaccatggcccttctctggaatgttctcagaaaggaggagactcaaaagagacctgtcgatctcctaggggccacgaagggatcctcttccgtttactttaaaaccaccaaaaccataagacaaaaaattttagacttcttaaaccccttgacggcccatcttggggttcagttgacagcggctgttgcggcagtgtggagcagaaagaaagcccagcgtcacagtaagatgaagattatcccaacggcaagtgcatcccagctaacccttgtcgacttggtgtgtgcactcagcaccctgcagactgacacgctgctgcacctggtgaaggaggtggtgaagaggccaccccaagtcaaagggggtgatgagaaatcgcccctagtggacattcctgtgttgcagttttgctatgcttttctccaaaggctcccagtaccagccttgcaagagaacttttcttcactgttgggagtattgaaagagtctgtacagttgaatctagccccacctgggtattttctgcttctcagcatgctgaatgactttgtaacaagaactcccaacctggaaaacaagaaggaccaaaaagacctgcaggaaatcactcagaaaatcctagaagctgtggggaacattgccggctcttccttggagcaaaccagctggctaagcagaaacctggaagtgaaggcccaacctcaggcctctctagaagaatctgatgctgaggaggacctgtatgatgctgctgcagcttcagcaatggtgtcttcatccgccccgtcggtgtacagcgtgcaagccctctctctcctggcagaggtactggcttccctcctggacatggtttatcgaagtgatgagaaggagaaagctgtgccgttaatctcccgtctgctttactatgtttttccatacttacgcaaccacagtgcctacaatgctcccagcttccgggctggcgctcagctgctgagctccctgagtggctatgcctacacaaagcgagcctggaggaaggaggtcctggagctgtttctcgaccccgctttctttcagatggatacttcctgtgttcattggaagtccattattgaccatcttttgactcatgagaaaacaatgtttaaggatttaatgaacatgcagagcagttctttgaaactattctcaagttttgaacagaaagccatgctgttaaagcgccaggcttttgctgtcttcagtggagaacttgatcaataccacctttaccttccactgatacaagaacgcctgacagacaatctcagagttggacagacatccatagttgctgctcagatgtttctttttttcagagttttgctgctaagaatatctcctcaacatttgacttcattgtggccaataatggtctctgaattgattcagacattcacacagcttgaagaagatctaaaagatgaagatgagtcattgagaagcaccaacaaagtaaacagaacgaaagtttcagtcccggatgcaaatggaccctcagtgggggagataccccagagtgaactcatcttgtatttatcagcttgcaaattcttggacacagcgctttcttttccacctgacaagatgccattatttcaaatttataggtgggcatttattccagaagtggacacagagggccctgccttcctgtcggatgtagaggagaatcaccaagaatgcaaaccccacactgtcaggattctagaacttctaaaattaaagtttggggaaatcagtagctctgatgagatcaccatgaagagtgaattcccgcttctgcgccaacattctgtttccagcatcaggcagttgatgccattcttcatgactctaaatggtgcatttaagacccagagacagctgcctgctgatagcccaggaactccattcttggactttcctgtcacagatagcccaaggatcttaaaacaactggaagaatgcatcgaatatgattttctggaacatccagaatgttaaccatgtgagagagaatatgtttaatccatgtattggtactttactgaaaaccaggttatattctaaagaagaaagaaggcaggatagtgcttttgaacaagcctatttccattttgaaagtagatttcaggctaggtgcggtggctcacacctgtaatctcagcactttgggaggccaaggcaggcagatcacttgaggtcaggagttcgagaccagcctgaccaacatggtgagaccctgtctctactaaaaatacaaaaattagctgggtgtggtggcggcgcctgtaatcccagctacttgggaggctaaggcatgagaattgcttgaacccaggaggtggaggctgcagtgagccgagatcacgacactgcactccagctgtgtgacagaatgagaccatctccaaaaaaaaaaaaaagtagatttcagataatttactgttcagcaacaggacacacctccctaaatgccttgtaatatatttgaatctgattctgcatttcttcctcaatttatgtaatgaaaataaaattaatatatcatctaacagtagcacaaaatttgtaatatgaagtaaagtatgaagataatgaagaagttgttttctttgttgaagcagttatatgggtctttctcagtatatttctcttttctctaaaagtttaaacttattaaaagaatgttatttttaacctttca

SEQ ID NO: 8758 - DNA, 3216 bp, Homo sapiens
gccgaggtatgctcggctcctgacccactcgccgggccccgagcgccgggccttggggctcggctgccttcctggcctgagctgcagctcgcagatggccttgcgcgctagccggacctggctgcggtggcccgggtgcagggcttctggctgggaccccagagagccagaaactacgctgcggggtttggtgctggggccagggtgagggcacggccgtccgggaggtggacacacccgaaggactgccctgtggggttgctgcttgcgacggggctgccgccttccctcctgtcccccgcagtgagatgagggcgttgggagggactttccaggaggggagcgccgggtgcgccctagggctgggcgggagcgctggcagagggagacttgaagctctatcgctgtttgctttgcagccaggcaggagcaacgcgcgcgggtccgttctgctgccaccctcccaggtctcggccgtccagccgatctgacagccggcgatgttttatttccactgcccgccacagctagagggcactgcaacctttggcaatcactcttcgggggattttgatgacgggtttctgcgtagaaaacagcgccggaaccggacgacgttcactcttcagcagctggaagctctcgaggccgtttttgcccaaacacactatccagatgtcttcaccagagaagagctcgccatgaaaataaacctcacagaagccagagtgcaggtttggttccagaacagaagggccaaatggaggaagacagagagaggggcctcagaccaggagccaggagccaaggagcccatggcagaggtgacacctcctccagtgagaaacatcaactccccgccccctggggaccaagcccggagtaagaaggaggcgctggaggcccagcagagcctggggcgaacggtaggtcctgcagggcctttcttcccctcctgcttgccggggactctcctgaacacggccacctacgcccaggccttgtcccatgtggcttccctcaaagggggcccactgtgctcttgctgcgtcccagaccccatgggactctccttccttcccacctatggctgccagagtaaccgcacggccagcgtggccaccctgcgcatgaaggcccgcgagcactcagaagctgtcctgcagtcagccaacctcctgccttccaccagcagcagccccggccctgtcgccaagccggcgcccccagatggcagccaggaaaagacctctcccaccaaggaacagagcgaggcagagaagagtgtatgagggtccacagtgccccgcccggcctgccctcccccgcccctccttctcccagcctcagcccctacagaaaactctccaaatagcaaggagaagcctgcggccccagggcctctgcatggacccaggacgggcaagtgagacccacagctcccttggcacctggagcgtccctctggagtcccaccagtgcggcagtgttgtcctggcttctttggcaacagatcccgatggcacttggtggcagcagagccctctctgtgaggagcctccctgggatttccatccaggcccagagtctcggagggaggtagattcctcatccgtctcccttcctatttcctccctgggctgcctttgaaggtcttgtcaaccccaggaactgtggcatgggctgaagtttcatgaaaagaaaagggcctgtcccgcttacagtgtttaagaactggggaactggtggaaccccaagcgactcttgctcccctggaccaagatgagcagtaatgccctttctcttgttggagaatattggttgtgggcttcattacaaagtgagaagatgcagggtagggaggggccaacaggacacagcctgtcccagaggaccacggtggctctgacccaggagatctcactggcacatctggccggggggctgggctaatcacccaggccacctgctccatgaactgggggctgctgtcttgacactgtgggtgtggaactagtgtggcccctgtacctgaagcactcacctgcaagcccttcctctctcccagatagacctgtggattggtgggaagttaagcaactgaaaagcagctctctggtccaggagggcctgagggcccttggagagggaagaagcccttcaggaatgcctctgaagtaattatgcatacagatgaactacctttccccacatgcctggcacgtagagggggctcttcagtggtggtggttttttactggggaaaaaaaagtaggaaaggagacaggaacggcgtatgtgcagatatggagcatggggaagacagctttctcatggtgtggagagcattaattccaaagggccaaatttcacagagatttctgttttggtctagtgtggctgttttctctggtgaggatggtgacctagaggagatccaaggggaacgtgcaatagcataagctctgccgctttctggcaggggcgcccggcatgggaaaggttgcagtctttggtggcttttgctgatggtgtttccatgcggatggttattgccttcatgatggttattttggtttcagttattatcgtcaaaatgttttactttcacatttcctgtcccctttttaccttcccccactccatgacccccaaataatactcctgagtgtatcatgccttgtctatgatcactacgaagcatttgataaaacccactgtctcctttaaagaaaaaaatcaaatccttcttcctgctgtattttgcttgttgagtataaagatgaaacgatttgccaaaaagcggcaaagttgcttccgtttccctgtaattacgaatgtttggttgaaggatgtaagctcaagcccttatgtacactaactcttcaatctaattgtttgattaaactcgtatttcctccagaaaggtacataaataagtgaactgttgagcaaattaagaatacttaacagcattgcatctgaaaagtagttatgctgattaaattttgtgtccttgaggactttcaggaaattacttttgatcgtcaataacacaattaagtaaactacacacacattagcatgaataattgataagaaattatgtattaccacgaagcactgatttaataattcatgatgcgacactctagtgactgtgcaaaactggatcatatcgaaaagtctgcctgatgttactgaaaggaaagaaaa

SEQ ID NO: 8759 - DNA, 807 bp, Homo sapiens
atggtgctgatgagctgtgaccaacggttgatcagtttgctcttggtaggcactgcaacctttggcaatcactcttcgggggattttgatgacgggtttctgcgtagaaaacagcgccggaaccggacgacgttcactcttcagcagctggaagctctcgaggccgtttttgcccaaacacactatccagatgtcttcaccagagaagagctcgccatgaaaataaacctcacagaagccagagtgcaggtttggttccagaacagaagggccaaatggaggaagacagagagaggggcctcagaccaggagccaggagccaaggagcccatggcagaggtgacacctcctccagtgagaaacatcaactccccgccccctggggaccaagcccggagtaagaaggaggcgctggaggcccagcagagcctggggcgaacggtaggtcctgcagggcctttcttcccctcctgcttgccggggactctcctgaacacggccacctacgcccaggccttgtcccatgtggcttccctcaaagggggcccactgtgctcttgctgcgtcccagaccccatgggactctccttccttcccacctatggctgccagagtaaccgcacggccagcgtggccaccctgcgcatgaaggcccgcgagcactcagaagctgtcctgcagtcagccaacctcctgccttccaccagcagcagccccggccctgtcgccaagccggcgcccccagatggcagccaggaaaagacctctcccaccaaggaacagagcgaggcagagaagagtgtatga

SEQ ID NO: 8760 - DNA, 5259 bp, Homo sapiens
cccgcctagcatggtgcggcggccgcgcgcgcggacatgggggagaagctggagctgagactgaagtcgcccgtgggggctgagcccgccgtctacccgtggccgctgccggtctacgataaacatcacgatgctgctcatgaaatcatcgagaccatccgatgggtctgtgaagaaatcccggatctcaagctcgctatggagaattacgttttaattgactatgacaccaaaagcttcgagagcatgcagaggctctgcgacaagtacaaccgtgccatcgacagcatccaccagctgtggaagggcaccacgcagcccatgaagctgaacacgcggccgtccactggactcctgcgccatatcctgcagcaggtctacaaccactcggtgaccgaccccgagaagctcaacaactacgagcccttctcccccgaggtgtacggggagacctccttcgacctggtggcccagatgattgatgagatcaagatgaccgacgacgacctgtttgtggacttggggagcggtgtgggccaggtcgtgctccaggttgctgctgccaccaactgcaaacatcactatggcgtcgagaaagcagacatcccggccaagtatgcggagaccatggaccgcgagttcaggaagtggatgaaatggtatggaaaaaagcatgcagaatacacattggagagaggcgatttcctctcagaagagtggagggagcgaatcgccaacacgagtgttatatttgtgaataattttgcctttggtcctgaggtggatcaccagctgaaggagcggtttgcaaacatgaaggaaggtggcagaatcgtgtcctcgaaaccctttgcacctctgaacttcagaataaacagtagaaacttgagtgacatcggcaccatcatgcgcgtggtggagctctcgcccctgaagggctcggtgtcgtggacggggaagccagtctcctactacctgcacactatcgaccgcaccatacttgaaaactatttttctagtctgaaaaacccaaaactcagggaggaacaggaggcagcccggcgccgccagcagcgcgagagcaagagcaacgcggccacgcccactaagggcccagagggcaaggtggccggccccgccgacgcccccatggactctggtgctgaggaagagaaggcgggagcagccaccgtgaagaagccgtctccctccaaagcccgcaagaagaagctaaacaagaaggggaggaagatggctggccgcaagcgcgggcgccccaagaagatgaacactgcgaaccccgagcggaagcccaagaagaaccaaactgcactggatgccctgcacgctcagaccgtgtctcagacggcggcctcctcaccccaggatgcctacagatcccctcacagcccgttctaccagctacctccgagcgtgcagcggcactcccccaacccgctgctggtggcgcccaccccgcccgcgctgcagaagcttctagagtccttcaagatccagtacctgcagttcctggcatacacaaagaccccccagtacaaggccagcctgcaggagctgctgggccaggagaaggagaagaacgcccagctcctgggtgcggctcagcagctcctcagccactgccaggcccagaaggaggagatcaggaggctgtttcagcaaaaattggatgagctgggtgtgaaggcgctgacctacaacgacctgattcaagcgcagaaggagatctccgcccataaccagcagctgcgggagcagtcggagcagctggagcaggacaaccgcgcgctccgcggccagagcttgcagctgctcaaggctcgctgcgaggagctgcagctggactgggccacgctgtcgctggagaagctgttgaaggagaagcaggccctgaagagccagatctcggagaagcagaggcactgcctggagctgcagatcagcattgtggagctagagaagagccagcggcagcaggagctcctgcagctcaagtcctgtgtgccgcctgacgacgccctgtccctgcacctgcgtgggaagggcgccctgggccgcgagctggagcctgacgccagccggctgcacctggagctggactgcaccaagttctcgctgcctcacttgagcagcatgagcccggagctctccatgaacggccaggctgctggctatgagctctgcggtgtgctgagccggccttcgtcgaagcagaacacgccccagtacctggcctcacccctggaccaggaggtggtgccctgtacccctagccacgtcggccggccgcgcctggagaagctgtctggcctagccgcacccgactacactaggctgtccccggccaagattgtgctgaggcggcacctgagccaggaccacacggtgcccggcaggccggctgccagtgagctgcattcgagagctgagcacaccaaggagaacggccttccctaccagagccccagcgtgcctggcagcatgaagctgagccctcaggacccgcggcccctgtcccctggggccttgcagcttgctggagagaagagcagtgagaagggcctgagagagcgcgcctacggcagcagcggggagctcatcaccagcctgcccatcagcatcccgctcagcaccgtgcagcccaacaagctcccggtcagcattcccctggccagcgtggtgctgcccagccgcgccgagagggcgaggagcacccccagtcccgtgctgcagccccgtgacccctcgtccacacttgaaaagcagattggtgctaatgcccacggtgctgggagcagaagccttgccctggcccccgcaggcttctcctacgctggctcggtggccatcagcggggccttggcgggcagcccggcctctctcacacctggagccgagccggccaccttggatgagtcctccagctctgggagcctttttgccaccgtggggtcccgcagctccacgccacagcaccccctgctgctggcacagccccggaactcgcttcctgcctctcccgcccaccagctctcctccagtccccggcttggtggggccgcccagggcccgttgcccgaggccagcaagggagacctgccctccgattccggcttctcagatcctgagagtgaagccaagaggaggattgtgttcaccatcaccactggtgcgggcagtgccaagcagtcgccctccagcaagcacagccccctgaccgccagcgcccgtggggactgtgtgccgagccacgggcaggacagtcgcaggcgcggccggcggaagcgagcatctgcggggacgcccagcttgagcgcaggcgtgtcccccaagcgccgagccctgccgtccgtcgctggccttttcacacagccttcggggtctcccctcaacctcaactccatggtcagtaacatcaaccagcccctggagattacagccatctcgtccccggagacctccctgaagagctcccctgtgccctaccaggaccacgaccagccccccgtgctcaagaaggagcggcctctgagccagaccaatggggcacactactccccactcacctcagacgaggagccaggctctgaggacgagcccagcagtgctcgaattgagagaaaaattgcaacaatctccttagaaagcaaatctcccccgaaaaccttggaaaatggtggtggcttggcgggaaggaagcccgcgcccgccggcgagccagtcaatagcagcaagtggaagtccaccttctcgcccatctccgacatcggcctggccaagtcggcggacagcccgctgcaggccagctccgccctcagccagaactccctgttcacgttccggcccgccctggaggagccctctgccgatgccaagctggccgctcaccccaggaaaggctttcccggctccctgtcgggggctgacggactcagcccgggcaccaaccctgccaacggctgcaccttcggcgggggcctggccgcggacctgagtttacacagcttcagtgatggtgcttctcttccccacaagggccccgaggcggccggcctgagctccccgctgagcttcccctcgcagcgcggcaaggagggctcggacgccaaccctttcctgagcaagaggcagctggacggcctggctgggctgaagggcgagggcagccgcggcaaggaggcaggggagggcggcctaccgctgtgcgggcccacggacaagaccccactgctgagcggcaaggccgccaaggcccgggaccgcgaggtcgacctcaagaatggccacaacctcttcatctctgcggcggccgtgcctcccggaagcctcctcagcggccccggcctggccccggcggcgtcctccgcaggcggcgcggcgtcctccgcccagacgcaccggtccttcctgggccccttcccgccgggaccgcagttcgcgctcggccccatgtccctgcaggccaacctcggctccgtggccggctcctccgtgctgcagtcgctgttcagctctgtgccggccgccgcaggcctggtgcacgtgtcgtccgctgccaccagactgaccaactcgcacgccatgggcagcttttccggggtggcaggcggcacagttggagcaggaggtgtctttaaccacgcggtgccctccgcctctgctcatccgtttggagcccgtgtcggccgcggggctgcatgtggcagcgccacactgggcccgagcccgctgcaggcggcggccagcgcctcggcctcttcctttcaggccccggcctcggttgagacccggccgccccctccgcctccgcctccgcctcccccgctgcccccgcctgcgcacctgggccggtcccccgcggggccgcccgtcctccacgccccccctccacctaacgccgccttgcctcctcccccaacgctgctggcctctaaccctgagcccgcgcttctgcagagcctcgcgtccctcccgcctaaccaagctttcttgccccccacctctgctgcctctctgccgcctgctaacgcctctttgtctatcaagctcacctccctcccgcacaagggcgcccgcccctccttcacggtgcaccaccagcccctgccccggctggccctggcccaggccgcgcccgggatcccacaggccagcgccacggggccgtccgcggtgtgggtgtccctcggcatgccgcctccctatgccgcgcacctttcgggggttaagccgcgataa

SEQ ID NO: 8761 - DNA, 7436 bp, Homo sapiens
cccgcctagcatggtgcggcggccgcgcgcgcggacatgggggagaagctggagctgagactgaagtcgcccgtgggggctgagcccgccgtctacccgtggccgctgccggtctacgataaacatcacgatgctgctcatgaaatcatcgagaccatccgatgggtctgtgaagaaatcccggatctcaagctcgctatggagaattacgttttaattgactatgacaccaaaagcttcgagagcatgcagaggctctgcgacaagtacaaccgtgccatcgacagcatccaccagctgtggaagggcaccacgcagcccatgaagctgaacacgcggccgtccactggactcctgcgccatatcctgcagcaggtctacaaccactcggtgaccgaccccgagaagctcaacaactacgagcccttctcccccgaggtgtacggggagacctccttcgacctggtggcccagatgattgatgagatcaagatgaccgacgacgacctgtttgtggacttggggagcggtgtgggccaggtcgtgctccaggttgctgctgccaccaactgcaaacatcactatggcgtcgagaaagcagacatcccggccaagtatgcggagaccatggaccgcgagttcaggaagtggatgaaatggtatggaaaaaagcatgcagaatacacattggagagaggcgatttcctctcagaagagtggagggagcgaatcgccaacacgagtgttatatttgtgaataattttgcctttggtcctgaggtggatcaccagctgaaggagcggtttgcaaacatgaaggaaggtggcagaatcgtgtcctcgaaaccctttgcacctctgaacttcagaataaacagtagaaacttgagtgacatcggcaccatcatgcgcgtggtggagctctcgcccctgaagggctcggtgtcgtggacggggaagccagtctcctactacctgcacactatcgaccgcaccatacttgaaaactatttttctagtctgaaaaacccaaaactcagggaggaacaggaggcagcccggcgccgccagcagcgcgagagcaagagcaacgcggccacgcccactaagggcccagagggcaaggtggccggccccgccgacgcccccatggactctggtgctgaggaagagaaggcgggagcagccaccgtgaagaagccgtctccctccaaagcccgcaagaagaagctaaacaagaaggggaggaagatggctggccgcaagcgcgggcgccccaagaagatgaacactgcgaaccccgagcggaagcccaagaagaaccaaactgcactggatgccctgcacgctcagaccgtgtctcagacggcggcctcctcaccccaggatgcctacagatcccctcacagcccgttctaccagctacctccgagcgtgcagcggcactcccccaacccgctgctggtggcgcccaccccgcccgcgctgcagaagcttctagagtccttcaagatccagtacctgcagttcctggcatacacaaagaccccccagtacaaggccagcctgcaggagctgctgggccaggagaaggagaagaacgcccagctcctgggtgcggctcagcagctcctcagccactgccaggcccagaaggaggagatcaggaggctgtttcagcaaaaattggatgagctgggtgtgaaggcgctgacctacaacgacctgattcaagcgcagaaggagatctccgcccataaccagcagctgcgggagcagtcggagcagctggagcaggacaaccgcgcgctccgcggccagagcttgcagctgctcaaggctcgctgcgaggagctgcagctggactgggccacgctgtcgctggagaagctgttgaaggagaagcaggccctgaagagccagatctcggagaagcagaggcactgcctggagctgcagatcagcattgtggagctagagaagagccagcggcagcaggagctcctgcagctcaagtcctgtgtgccgcctgacgacgccctgtccctgcacctgcgtgggaagggcgccctgggccgcgagctggagcctgacgccagccggctgcacctggagctggactgcaccaagttctcgctgcctcacttgagcagcatgagcccggagctctccatgaacggccaggctgctggctatgagctctgcggtgtgctgagccggccttcgtcgaagcagaacacgccccagtacctggcctcacccctggaccaggaggtggtgccctgtacccctagccacgtcggccggccgcgcctggagaagctgtctggcctagccgcacccgactacactaggctgtccccggccaagattgtgctgaggcggcacctgagccaggaccacacggtgcccggcaggccggctgccagtgagctgcattcgagagctgagcacaccaaggagaacggccttccctaccagagccccagcgtgcctggcagcatgaagctgagccctcaggacccgcggcccctgtcccctggggccttgcagcttgctggagagaagagcagtgagaagggcctgagagagcgcgcctacggcagcagcggggagctcatcaccagcctgcccatcagcatcccgctcagcaccgtgcagcccaacaagctcccggtcagcattcccctggccagcgtggtgctgcccagccgcgccgagagggcgaggagcacccccagtcccgtgctgcagccccgtgacccctcgtccacacttgaaaagcagattggtgctaatgcccacggtgctgggagcagaagccttgccctggcccccgcaggcttctcctacgctggctcggtggccatcagcggggccttggcgggcagcccggcctctctcacacctggagccgagccggccaccttggatgagtcctccagctctgggagcctttttgccaccgtggggtcccgcagctccacgccacagcaccccctgctgctggcacagccccggaactcgcttcctgcctctcccgcccaccagctctcctccagtccccggcttggtggggccgcccagggcccgttgcccgaggccagcaagggagacctgccctccgattccggcttctcagatcctgagagtgaagccaagaggaggattgtgttcaccatcaccactggtgcgggcagtgccaagcagtcgccctccagcaagcacagccccctgaccgccagcgcccgtggggactgtgtgccgagccacgggcaggacagtcgcaggcgcggccggcggaagcgagcatctgcggggacgcccagcttgagcgcaggcgtgtcccccaagcgccgagccctgccgtccgtcgctggccttttcacacagccttcggggtctcccctcaacctcaactccatggtcagtaacatcaaccagcccctggagattacagccatctcgtccccggagacctccctgaagagctcccctgtgccctaccaggaccacgaccagccccccgtgctcaagaaggagcggcctctgagccagaccaatggggcacactactccccactcacctcagacgaggagccaggctctgaggacgagcccagcagtgctcgaattgagagaaaaattgcaacaatctccttagaaagcaaatctcccccgaaaaccttggaaaatggtggtggcttggcgggaaggaagcccgcgcccgccggcgagccagtcaatagcagcaagtggaagtccaccttctcgcccatctccgacatcggcctggccaagtcggcggacagcccgctgcaggccagctccgccctcagccagaactccctgttcacgttccggcccgccctggaggagccctctgccgatgccaagctggccgctcaccccaggaaaggctttcccggctccctgtcgggggctgacggactcagcccgggcaccaaccctgccaacggctgcaccttcggcgggggcctggccgcggacctgagtttacacagcttcagtgatggtgcttctcttccccacaagggccccgaggcggccggcctgagctccccgctgagcttcccctcgcagcgcggcaaggagggctcggacgccaaccctttcctgagcaagaggcagctggacggcctggctgggctgaagggcgagggcagccgcggcaaggaggcaggggagggcggcctaccgctgtgcgggcccacggacaagaccccactgctgagcggcaaggccgccaaggcccgggaccgcgaggtcgacctcaagaatggccacaacctcttcatctctgcggcggccgtgcctcccggaagcctcctcagcggccccggcctggccccggcggcgtcctccgcaggcggcgcggcgtcctccgcccagacgcaccggtccttcctgggccccttcccgccgggaccgcagttcgcgctcggccccatgtccctgcaggccaacctcggctccgtggccggctcctccgtgctgcagtcgctgttcagctctgtgccggccgccgcaggcctggtgcacgtgtcgtccgctgccaccagactgaccaactcgcacgccatgggcagcttttccggggtggcaggcggcacagttggaggtaactaggatttctacctcaaccgcgagacctatgcaaggacggtgtggaccaactcgcgcccgcggcatggtgcccgccggcctgccgggctcccacccctggacggcagaggcaaggacggacgggagctccactgtgaatcggcggcacgcgccgcaggaggctgggactggtccagtttgtactgtcgatagttttagataaagtatttatcattttttaaaaagtataaacaattctgacttattttattccatctaagtggtaaaaggcaacttattgagaaatataaatatctatatatgagagctctatataaagacacgtgtctgcagggcgggcccgccagcggattcgccacagcctgccccggtgctatctcgtccccaggcccgcgcctgcctccacccgcttggtgctgactagacgctgacaacgccgaaccccgttctcggaaacgccgcccggccggctcccccgacgcgctgctcccgtaccaaaggcaggcccgtcgccaccacattcctcggaggcctccccgcggcctgagccccttcctgagcgccctggcgcctgccctgagctcttcacctttaccccggcactgtgaacccccagactgttcaccctccggggcgtgggttgcgcccttgcatgtgaaggggcctgcgcggtgacgcagctggccatgtgctgcgcgatggtgctgtgaggacggcgcgggcacgttgaacaagtgcatttacttttgtatttctcggctgtccatggctcgcagcatgccctgcgatgcggggcaggcctgtcgtgggtcccttggtgtttctgtacaggagagagtcacactaatgagtggcagtattttatagagatgtgatgagaatttataaatttcatagatttgacagcttttatttttagatggtataatgcacagtgaagaggaaagaaaagcgaggggaaaaaaccttatttattcaaacagtgcacaaaatggccccagcgtcagccccgaccctagacccctcagttgcagctcccagcagcccagacagagctgccggcgcccctgcctgccccacatcccttcctgtcagggccacgcctggcacccatcccttggagcctgtgctggttctcccagctgctgtgggtgtgctggggccagggtgcactgctgaaacctggcctctctggccctaggccccagggtgacgtcggccccccactctgcagccttggcgggtgcctgggactgggtgtggaaggagaggagctgaggccggggtgtagcaggcaggcagggccactccagtgcttctggagccctgagcagtcagggcctgggttgtctgagcagtggtggctctgtgccctccctggaggatgggatctgggagtctgagctccccgcatctggccctgggctgtgtggcacttgctgagcccaccttctcaagtgcttgctcctgtgagatggcatcggggagccccttccccaaggtgccacagatccaccctccagggagctgccagccctgtgttctggttcccaagggcaggatggacacacgtcacatccctaccacgtggcctccaaagggagccacggaggaaaggcttctgtggttgctaggtgggggagtcctgtgtgggagggcctgaagacccctgcttgtgcctggtgaggggggtgctgcctcccccagcccccaacaacctctcagacccccaccctccaacatagctgagttctgaagatggtgctccggacctgtcctcttaagtggtgcccagtgccctccccaccccacgttggtgctctcagctagaaggtgctgtgcctctgcctgagccccaagccccgagcctggccttcaggacaggcagcctgctctgtgtcgccacgggccggatacgccacagggttgatggcagagacggccgagtccctggtctagaacaagacacattctttaaacactgtattacttctgcctccctctaggtgacagtggcagtccgggtgccatcacgggtcctgcagatggccatgcagggctcctgcccacgcaggccaccgtatgttcaggacacgcactgggtctcagagccactggcccaggcagaagtctccttgagcccactgggtcatatgcgtgtcaccacacgtgaactagtgtggtggctgcctgcggacaccctcctgttctgagccctgggcctgtgttcttctcagacactcccagactgaggggtggtgtgtggcgggtggcagggtggctgtggagactggggatctggagcctggtgctggcacctggcctgagtttccgtgggcagctggcggggacctgtgctgctgctgctgactgtgggtgggcgggcggcgcctgggagtggctcttgctcaggaattgataggaaccctaaaaactaggataccccctcctcggcccatgaggcacgcacagtgacttatttaagacttcccccttaatttatctgcccccaggatgcgtcagtctgttcagtggtcagcaggccccccaccccccgccgactgccctcgccatcgtggtcagacccccctcccaacacaacacgctgctggtctgtgtcagcctttgtaacgtgggaggctctgccgtgtcttccgggtgaactgtatttggattgcgcgcattgtcacggtccgcccctgggctgcaggcgccccttcctctgggcacccctgcattctgcatccccacctctagacgctgtaataaacagactgttttcactcgga

SEQ ID NO: 8762 - DNA, 2066 bp, Homo sapiens
cgccgccgcgccggctgcatcctcgcctccacctcgctcaccccctcctccccgcactttctcggcgctccctccctctcggctcgcacagctcgactccgcgctctcctcgccggccgccgccgcccagcctgcgcccgccgtccccccagtgcctgggcacctgttggaggcagagccaggggtgctgcatgaggggccgcaggggcgatcgcatgaccatcaacatccaggagcacatggccatcaacgtgtgccccgggcccatccggcccatccgccagatctctgactacttcccccggggaccaggacctgaagggggcggcgggggcggcggggaggcccccgcccatctggtccccctggctctggccccccctgcagccctccttggggccaccacgcctgaggatggtgcggaggtggacagctatgactcggatgatgccaccgccctaggcacgctggagtttgaccttctctacgaccgggcctcctgcactctgcactgtagcatcctcagggccaagggcctcaagcccatggatttcaatggcctcgccgacccctacgtcaagctgcacttgctgcctggagcctgtaaggccaataagctaaaaacgaagactcagaggaacacactgaatcccgtgtggaatgaggacctgacttacagcgggatcacagatgacgacatcacgcacaaggtgctcaggatcgccgtctgtgatgaggacaagctgagtcacaatgagtttattggggagatccgcgtgcccctccgccgcctcaagccttcgcagaagaagcattttaacatctgcctcgagcgccaggtcccgctggcgtccccctcttccatgtcagcggcgctgaggggcatctcctgttatctgaaggagttggagcaggcggagcaggggcaggggctgctggaggagcgtggccgcatcctgctgagtctcagctacagctcgcggcgccggggactgctggtaggcatcttgcgctgcgcccatctggctgccatggacgtcaacggttactcggacccctacgtcaagacgtacctgaggcccgatgtggacaagaaatccaagcataagacgtgtgtgaagaagaagactctcaacccagaatttaacgaggagtttttctacgagatagagctctccactctggccaccaagaccctggaagtcaccgtctgggactatgacattggcaaatccaatgacttcattggtggcgtgtccctggggccaggtgcccgaggcgaggctcggaagcactggagtgactgcctgcagcagccggacgcagccctggagcgctggcacaccctgaccagtgagctgccccctgcggccggggctctgtcctcagcctgagtggacagcagtgtcccggcacaggcccatcgagccgggtccagtacccaaccttcgcacgagtgtgttgcacgtttacacagggtgggctgcccccaccctgcactacctatttttgtgagtctccgtgacccgggtctgtctgctcatgaggggctgcggagttctatattcacatatgcaaacctcctgcctgactcgctagtccctgcaaatatgcaaaccccccatcatctgcacacccgggcagtgctcagagcccggccccaggcccccgcgctcctcactcctgcctctccacgctgccccgtccctctcccccaacagggaggaggtcggattaggggaggttcagaggaggagaatgtctcaaaaaaaaaggacaaaaaacaaacccagagccactcctttaatacagaaacttcattgaaaaaacctagccctgtacagctgcccttttaaagaggtggccattgcagggtctctgcctccccagcaggtggcagatgctcccggccactcgtttaaataactgtcccctggagggggccggggtttgaaggcagggcccctgccaccctcctgggggacacccgtgcatgtttacgccttttctggttgtgtcagtggccggagcatggcagctgggcatcaataaacacctccgaggaa

SEQ ID NO: 8763 - DNA, 927 bp, Homo sapiens
atgaccctccggcggcgcggggagaaggcgaccatcagcatccaggagcatatggccatcgacgtgtgccccggccccatccgtcccatcaagcagatctccgactacttcccccgcttcccgcggggcctgcccccggacgccgggccccgagccgctgcacccccggacgcccccgcgcgcccggctgtggccggtgccggccgccgcagcccctccgacggcgcccgcgaggacgacgaggatgtggaccagctcttcggagcctacggctccagcccgggccccagcccgggtcccagccccgcgcggccgccagccaagccgccggaggacgagccggacgccgacggctacgagtcggacgactgcactgccctgggcacgctggacttcagcctgctgtatgaccaggagaacaacgccctccactgcaccatcaccaaggccaagggcctgaagccaatggaccacaatgggctggcagacccctacgtcaagctgcacctgctgccaggagccagtaaggcaaataagctcagaacaaaaactctccgtaacactctgaaccccacatggaacgagaccctcacttactacgggatcacagatgaagacatgatccgcaagaccctgcggatctctgtgtgtgacgaggacaaattccggcacaatgagttcatcggggagacacgtgtgcccctgaagaagctgaaacccaaccacaccaagaccttcagcatctgcctggagaagcagctgccggtggacaagactgaagacaagtccctggaggagcggggccgcatcctcatctccctcaagtacagctcacagaagcaaggcctgctggtaggcatcgtgcggtgcgcccacctggccgccatggacgccaacggctactcggacccctacgtgaaaacgtga

SEQ ID NO: 8764 - DNA, 1080 bp, Homo sapiens
tccgcagcggagcgggcagcggccaagtcagggccgtccgggggcgcggccggcgatgcccgcagcccccgccgcgccccgccgggcctgctgagccgcccccgggccggggtcgcgccgggccgggccgcgcccggggcggggcggcgctgcctgcatgaccctccggcggcgcggggagaaggcgaccatcagcatccaggagcatatggccatcgacgtgtgccccggccccatccgtcccatcaagcagatctccgactacttcccccgcttcccgcggggcctgcccccggacgccgggccccgagccgctgcacccccggacgcccccgcgcgcccggctgtggccggtgccggccgccgcagcccctccgacggcgcccgcgaggacgacgaggatgtggaccagctcttcggagcctacggctccagcccgggccccagcccgggtcccagccccgcgcggccgccagccaagccgccggaggacgagccggacgccgacggctacgagtcggacgactgcactgccctgggcacgctggacttcagcctgctgtatgaccaggagaacaacgccctccactgcaccatcaccaaggccaagggcctgaagccaatggaccacaatgggctggcagacccctacgtcaagctgcacctgctgccaggagccagtaaggcaaataagctcagaacaaaaactctccgtaacactctgaaccccacatggaacgagaccctcacttactacgggatcacagatgaagacatgatccgcaagaccctgcggatctctgtgtgtgacgaggacaaattccggcacaatgagttcatcggggagacacgtgtgcccctgaagaagctgaaacccaaccacaccaagaccttcagcatctgcctggagaagcagctgccggtggacaagactgaagacaagtccctggaggagcggggccgcatcctcatctccctcaagtacagctcacagaagcaaggcctgctggtaggcatcgtgcggtgcgcccacctggccgccatggacgccaacggctactcggacccctacgtgaaaac

SEQ ID NO: 8765 - DNA, 1501 bp, Homo sapiens
atggccctcccgacaccctcggacagcaccctccccgcggaagcccggggacgaggacggcgacggagactcgtttggaccccgagccaaagcgaggccctgcgagcctgctttgagcggaacccgtacccgggcatcgccaccagagaacggctggcccaggccatcggcattccggagcccagggtccagatttggtttcagaatgagaggtcacgccagctgaggcagcaccggcgggaatctcggccctggcccgggagacgcggcccgccagaaggccggcgaaagcggaccgccgtcaccggatcccagaccgccctgctcctccgagcctttgagaaggatcgctttccaggcatcgccgcccgggaggagctggccagagagacgggcctcccggagtccaggattcagatctggtttcagaatcgaagggccaggcacccgggacagggtggcagggcgcccgcgcaggcaggcggcctgtgcagcgcggcccccggcgggggtcaccctgctccctcgtgggtcgccttcgcccacaccggcgcgtggggaacggggcttcccgcaccccacgtgccctgcgcgcctggggctctcccacagggggctttcgtgagccaggcagcgagggccgcccccgcgctgcagcccagccaggccgcgccggcagagggggtctcccaacctgccccggcgcgcggggatttcgcctacgccgccccggctcctccggacggggcgctctcccaccctcaggctcctcggtggcctccgcacccgggcaaaagccgggaggaccgggacccgcagcgcgacggcctgccgggcccctgcgcggtggcacagcctgggcccgctcaagcggggccgcagggccaaggggtgcttgcgccacccacgtcccaggggagtccgtggtggggctggggccggggtccccaggtcgccggggcggcgtgggaaccccaagccggggcagctccacctccccagcccgcgcccccggacgcctccgcctccgcgcggcaggggcagatgcaaggcatcccggcgccctcccaggcgctccaggagccggcgccctggtctgcactcccctgcggcctgctgctggatgagctcctggcgagcccggagtttctgcagcaggcgcaacctctcctagaaacggaggccccgggggagctggaggcctcggaagaggccgcctcgctggaagcacccctcagcgaggaagaataccgggctctgctggaggagctttaggacgcggggttgggacggggtcgggtggttcggggcagggcggtggcctctctttcgcggggaacacctggctggctacggaggggcgtgtctccgccccgccccctccaccgggctgaccggcctgggattcctgccttctaggtccaggcccggtgagagactccacaccgcggagaactgccattctttcctgggcatcccggggatcccagagccggcccag

SEQ ID NO: 8766 - DNA, 1617 bp, Homo sapiens
ccaccccccccccccaccaccaccaccaccaccaccccgccggccggccccaggcctcgacgccctgggtcccttccggggtggggcgggctgtcccaggggggctcaccgccattcatgaaggggtggagcctgcctgcctgtgggcctttacaagggcggctggctggctggctggctgtccgggcaggcctcctggctgcacctgccgcagtgcacagtccggctgaggtgcacgggagcccgccggcctctctctgcccgcgtccgtccgtgaaattccggccggggctcaccgcgatggccctcccgacaccctcggacagcaccctccccgcggaagcccggggacgaggacggcgacggagactcgtttggaccccgagccaaagcgaggccctgcgagcctgctttgagcggaacccgtacccgggcatcgccaccagagaacggctggcccaggccatcggcattccggagcccagggtccagatttggtttcagaatgagaggtcacgccagctgaggcagcaccggcgggaatctcggccctggcccgggagacgcggcccgccagaaggccggcgaaagcggaccgccgtcaccggatcccagaccgccctgctcctccgagcctttgagaaggatcgctttccaggcatcgccgcccgggaggagctggccagagagacgggcctcccggagtccaggattcagatctggtttcagaatcgaagggccaggcacccgggacagggtggcagggcgcccgcgcaggcaggcggcctgtgcagcgcggcccccggcgggggtcaccctgctccctcgtgggtcgccttcgcccacaccggcgcgtggggaacggggcttcccgcaccccacgtgccctgcgcgcctggggctctcccacagggggctttcgtgagccaggcagcgagggccgcccccgcgctgcagcccagccaggccgcgccggcagagggggtctcccaacctgccccggcgcgcggggatttcgcctacgccgccccggctcctccggacggggcgctctcccaccctcaggctcctcggtggcctccgcacccgggcaaaagccgggaggaccgggacccgcagcgcgacggcctgccgggcccctgcgcggtggcacagcctgggcccgctcaagcggggccgcagggccaaggggtgcttgcgccacccacgtcccaggggagtccgtggtggggctggggccggggtccccaggtcgccggggcggcgtgggaaccccaagccggggcagctccacctccccagcccgcgcccccggacgcctccgcctccgcgcggcaggggcagatgcaaggcatcccggcgccctcccaggcgctccaggagccggcgccctggtctgcactcccctgcggcctgctgctggatgagctcctggcgagcccggagtttctgcagcaggcgcaacctctcctagaaacggaggccccgggggagctggaggcctcggaagaggccgcctcgctggaagcacccctcagcgaggaagaataccgggctctgctggaggagctttaggacgcggggttgggacggggtcgggtggttcggggcagggcg

SEQ ID NO: 8767 - DNA, 9405 bp, Homo sapiens
cttatttcttatgaatgtcggatagctgcaccagcttggtggggaaagggtttgatgaatagcacaaagacactggctgttccctggaggctgtccctttaaaggagaatcttagtttattctggggggaggggatgcacacattagagtaggaaagagggcttggaataaaatgaaaacactcccccttcatagtcattgtactgaaatgcaaagactgcttcctaagctggagatgctaaccttgggtagctccttctgttctcttcaaggggaattttgtcaggctatggattcatttacaactgttagtcatgtgggcatgtgtgaggaaacagatgccagttttaatgtatttagcccgaagttccaatttgataggagccactgtcagtctctgaggttccaccaaaatatggaacttgattttggacactttgacgaaagagataagacatccaggaacatgcgaggctcccggatgaatgggttgcctagccccactcacagcgcccactgtagcttctaccgaaccagaaccttgcaggcactgagtaatgagaagaaagccaagaaggtacgtttctaccgcaatggggaccgctacttcaaggggattgtgtacgctgtgtcctctgaccgttttcgcagctttgacgccttgctggctgacctgacgcgatctctgtctgacaacatcaacctgcctcagggagtgcgttacatttacaccattgatggatccaggaagatcggaagcatggatgaactggaggaaggggaaagctatgtctgttcctcagacaacttctttaaaaaggtggagtacaccaagaatgtcaatcccaactggtctgtcaacgtaaaaacatctgccaatatgaaagccccccagtccttggctagcagcaacagtgcacaggccagggagaacaaggactttgtgcgccccaagctggttaccatcatccgcagtggggtgaagcctcggaaggctgtgcgtgtgcttctgaacaagaagacagcccactcttttgagcaagtcctcactgatatcacagaagccatcaaactggagaccggggttgtcaaaaaactctacactctggatggaaaacaggtaacttgtctccatgatttctttggtgatgatgatgtgtttattgcctgtggtcctgaaaaatttcgctatgctcaggatgatttttctctggatgaaaatgaatgccgagtcatgaagggaaacccatcagccacagctggcccaaaggcatccccaacacctcagaagacttcagccaagagccctggtcctatgcgccgaagcaagtctccagctgactcagcaaacggaacctccagcagccagctctctacccccaagtctaagcagtctcccatctctacgcccaccagtcctggcagcctccggaagcacaaggacctgtacctgcctctgtccttggatgactcggactcgcttggtgattccatgtaaaggaggggagagtgctcagagtccagagtacaaatccaagcctatcattgtagtagggtacttctgctcaagtgtccaacagggctattggtgctttcaagtttttattttgttgttgttgttattttgaaaaacacattgtaatatgttgggtttattttcctgtgatttctcctctgggccactgatccacagttaccaattatgagagatagattgataaccatcctttggggcagcattccagggatgcaaaatgtgctagtccatgacctttcaatggaaagcttaggtgcctgcgttatatttgccctgtctaattttgcccatacagtcttccttctgtagagggctgtttacatatacagcacttaaaatgtttgtgtgggaaaaaaaaaactcattggcagatccaagaatgacaaacacaagtgccccttttctctggatctcaagaatggtggaggaccctggaaggacagcaaggcagctccccagcctcactcttcactcctgattgaggcccgggtttgttgtccagcaccaattctggctgtcaatggggagaaataaaccaacaacttataattgtgacaccagatgcttaggatcctggtgctgggttagctaagagaatagacagaattggaaaatactgcagacatttccgaagagtttataaagcacagtgaattcctggtcaatctctccactgaggcaatttggaatcaataagcaattgataatagtttggagtaagggacttcatatacctgattcctctagaaggctgtctaacataccacatgattacatgaactgtatggtatccatctatctctgttctattgaatgccttgttaacagccaacactgaaaacactgtgagaatttgttttcaggtctgacacctttcagtctctttttatagcaagaaatcaatatcctttttataaaaattcatgtctgtatttcaggagcaaactcttcaggctccttttttataaactggtgatttttcttttgtctaaaaaacacatgaagaaaatttaccaaaaaaaaaaaaaaaagcagaagaataatgtagtttagaaattatgctgtcactgccaaacagtaacctccaggagaaaacaagatgaatagcagaggccaattcaatagaatcagttttttgatagctttttaacagttatgcttgcattaataatttcaatgtggaccagacattctaattatattttaaatgaaatgttacagcatattttaagcaactctttttatctataatcctaatatttcatactgaagacacagaaatctttcacttgtctttaacattagaaaggatttctctttactaaggactgatcatttgaaatagttttcagtcttttgagatacaggtttataacactgcttttttttttctgtaatcatagcccataatggcaaagacaactaaatttaagtgaaggtcatgcatgccaattctgtgtttgcttttagcagatatgaagatttccttatttctttgtaattgtgcagatattttgaaaggcacagcattcgaagccaagctgctgtttggctactgaatggcttgcagttgttcctccactctaaatggaatgagcttgctgtgtgtgtgtgtggtggtggtgggagggggtggtgcatgtgtgtgtgtgtgtgtgcatctgcagctgcttcaaaattaggaaatactacaggacacccctgtaatggattggtggcaactgggtggcactgctgatgtgcactgtgtaggggggaacccagtggtggtggggtagctcagatgcccctagacaagcttcagatgtctgtagctaccagaaacattttcggttcaggaaaagtgagatgatggtagtactggtttctggtgaaattgaagaaccccaaatgatgaggatctctttttgccccctctcctttttttgtagacccattcaaaaccattaataagcccattttactaagcccctatttctttctagaagctcagggttttcttagtgcctcccagaacattttgtagttaattgggaaaaagtgatacttggattagggggtgtgggcataaagaatggtgggaggcctgattttaaacttcaggccagaacccccaatgactccacccatagtctcactttaggtctcatttagtccatcacctttattttaagttgaggaagtggaggctggtaaagagcaggaccagaggaagaatccagatttccttatgcttgggcctcacactagctctctgagtatttccttgattgcggtatatgtactactagaaaataccaaatggatatattttctttaggataacctttgaaccaacaatcttcaataacaatagtacatcttccatcttacttttaatcgagtataaggaaatgtttctttatggccattttggagggagcaggggatgaggcttggcatagtccaaaatttaagtctccaataattaattgcattttaaattggcccactttcaaggcaattttttttgtgtgtctgtaactgagctcctccacccctgtcattcacttccaattttacccaatccaattttagcactcaagttccattgtgttaatttctgcacggtcaacaaacatcaagtcagcaagcatttgccaccactccctatacttctccctccttcttacacacacacacacacacacacacacaatccatctcttgcttgttcctacctcctgatttttcttccctacagaaatagaaatagggacaaagaaggggaaaatgtatatattggggctgggctgaacaactaacttcataagtagtattaactaggggtaaattgagagaaaagctccttttctcttcactgttttggaaaggatagccattagcatgactgctttgtgtccttatggactttagtattagcctagattgaattatagcgttttctagctggaaggaaccttaagatcacatcatctactcctctactccaaatttctcattcttcaggccaggaaaccgagacacagaggtaaagtaatttccccaaggtcacacagctggctggggcaggattgggtttacaacccacatctcctggctcttattccagggccttttcccactaagtagtattgccttccattaggctcctgagagttatttctcagggtcatgttgcatcttggagccacatgctgctgccctgatctcagtgggaaatccacccagcaacctaatacagccccttttccctgcattcacctggttcccatccacatgggttgcagatgtccttgaagagagtgaggcattgagggccaataggagcaatggggtccctggccttgtccatctgattcaggagatcactgctccatcgtgaggagccctctgaatagccccccactgaatgcttgccttgcccaaatggaatggaggaagattgattttctccatcagttcaccttgtgtcatctcataatggttggtctttccaggctgagggaaatgtttcttgtttccagagtagaaaaagaaagagtggaacaatagctttgttcatcctaactttctgagatggcttttcaacattttaaaaaaactagtgtggctaccattcactggcaatgatttcttttagaatatgggagtaagatgagctagagaaaataacctggtctcactgtggttgccctcatccacaatgtccccaaagccatcctgctctgatgaggacaatttccaggtataagcaaggggctttgtgacaaaaatgtaccctggctgatgttaaacattggctcctgtgtttgcaccaaaatagcaagctgtgtgctctatacactcttcccatcgtcttgtgtacactgctcctgtggccttccacagcagaaaccagggcaaaagggtccaaacacatggttttccttgctgcaaggctcttcctgggaactaagggggtatttattagttcagttctaagagacctccttctgggcttaccccactcctcaggtacttctctctccttcctccttctcctccacagtcacaagtaaccaaggaacctgaaagtggatgtgtagctatttgaagaaggcaaggaaccctgagattcttctttgaatcctctagtccaagtcttagaccagtgattggtgcttaccttgaacaaaattttgtctgtgttcctaatcccttcaatactctgggtacaatgctcccaatcaccctgcacatttgattctaaatggcttttattttttaaaaatccatatccctaggacaagagaacaggatgcctatatccccaaaatgagctccaggacactgatgggaatgatcccaaagatcaccccacctcagaaacgtctgtgccaagagacttccccagatagaaacactgggacagtggtttgaacgacttcttttatggttgtccagtttgctatggaaataaaaggcattgattttttaaaaagatgattggaacctgtctttggccacatagggccacttggatccatttccaggccttactcatatattgccttcactgaagggctttggctttaagtcccagactggtctcccaagtgaaccataagtgttttggagctcatctggggtgaggcatgagaatgttgccccatctatcccttcaggaaaaggtgccttccctccctttctcctaaagcctggtccccagaaattgtttttgtctccaaaagtctagtatggtctttatacacccagactcttagtgttgcgtcctgccttgtttccttgttaaggatctatgcagacctcccgctttggcttagctagcgtgacattggctatcatttgacaagactaacttttttttttttttttttttgactgagtctccctctgtcacctaggctggagtgcagtggcacaatcttggctcgctgcaaccttcacccttcacctcccaggtcgaagcgattctcctgcctcagtctcccgagtagctgggattacaggcgtgcgccaccaaatctggctatttttttattattattatttttagtagagatggggtttcaccatgttggccagactggtcttgaactcttggcctcaaattatctgcccacctcggcctcccaaagtgctgggattacaggcatgagccaccatgcccagctgacaagactaattttttatcccttggtttattggcttcaacatcttctggaatcagaggtgattttttcttaccttggatgcctgagactaggggagtatagaattccaattggtaattaaggcatctttctgctcctgatcagaagggcaggttagttgggagaggtcagatggcacaacagaagtcaccttgtaagtaaggcaaagacttgaaggcattagcgtttctcattactaggtcaataacctgagggaatcaatggctttttgccgctctacctcttgtgtatctctttgacttttctttctctgtctagtttcctctgttctcagtttatattctatgttatcagtctctctttccacagtacaaacatccatcctttctcctgtgcaattctgtctctccctcttattatctttatttgtactttttccttcctccctgtctaggcattgggcatgtgcctcttcttagcctgtgattttgccttgggactgatgataaattatttccagattcaatcagccctggtcctaccccagtccaatcagaagtatgttggtgggaatcaacctgatcctggccctttcttcttctccattttcattcgtaatccccctcagcagatctttacaagcagtttccttatagctcatgtatctttaggtctttgccttccaagcactgtacagaatactttgtggttcctttttagtctgacattttgtggagcagtgaagcgtgctcagagacataatcagctgaagagaaaaaatccacccatggatttatatcagctaaatactaataattgattttgtttgatgtgcccataatttttaaagctgcaatataatataatgagggaccacaggtaatttctcctgtcatttgttttggctggatgggggtgggggagtaattgcttaaagttttaccattacacattaaactctctataataatcttgtttggggcttgctaactgttgagctgttttaactaaactggtaggcaatcggagttgatttaaatgaaaagataatttaacaaatctatactataaaaagagacatttgcttaattgacatgtattttttccttctgagtcacctaaacatttactcttgacaccaactgttcatgatactgaatagacagtccatataagagaaattagtggacctaaagaagccagattgtaggtgttaatttattaaacagagtgcaaagcccttggaaatgtcactgcttggcaataccatatggaatgccaaaatttacaatgacttttctttataagttatccaaaagggatttgaacaagtaagaggttatgccaaaatgtctccaatgtatggtcctgtaatatattgcagcttgaagccaatgatcccttatgacttgtatacaactaatgcatgttttattgaattttgcatttcccacgtgtggtaagttctttaaaatgtttttgatcacctttttgtgccattaaacttgtacagaaaatgtttttatggccattttcaaagggagaaagtttaaaatggaaacagcccaccctttctgccctatagctgtagttagaattgagtacctgtagcaaaacagctgtaattggtggttgtagtgttagaggtgttagcttgctagtgactagctttggagagtaaatgcatggtattgtacatcacatttcttaactcgttttaacctctgaaaagaatatattcttctttgtagtccttcttcccacccccttgccctctccctctccctgctcccagttgtcttacagttgtaaatatctgatttgaggcccaataactcttgccaagtaaagtcagcaaacaacaaacaaaccaaaatgtggggaaaaggcatttctcaaccatctctcagcagttattgatcatttcttaaggaacagcattgtgatcaaagactcaactttacgtaaaaatcagtggtaaattggggttgtatttggccatttgattacatttcaggattgaatagttttcagaatcacatgtaatccaaagacagtaggtagtgatgtcccttatccctgcagctgttttaagatagagacctcagaagactctgcttgaccgatgaccaataattatttgaaaaaaaaagaaaaaatgagagaaataaaacagatatttaagaactttagccacctatttagaatagttatagccagaaaaaaaaacaagggcatgagttcaaatgcattactatcagtgtcctaggcaatacctaacctactctgaaattgtgattcaaaagcagtatttcaagaggcattctccttttttggtttgctgaccccacttggactggtaggtttggtgaggcccccataaaccagctggagcagacccttttcatctcctgtgcctgtaacacccctcttcccccaccccctccgcaattcaatgagggctttcttgggtcagaggacttcaaggttgtctagagaagtttgccatgtgtgtaaggtgctgtgaactgtgagtgctgaagattcgcagcattcaataccaggcagccaaagagctgctcttgcaattattttggctctcaagctctgttcttcatcgcattctcatttctgtgtacatttgcaagatgtgtgtaatgtcattttccaaaaataaaatttgatttcaat

SEQ ID NO: 8768 - DNA, 2981 bp, Homo sapiens
gagattggttttctttctctcagcatctccacccaaccagcagaaaaccgcttctacctgggattttcctttggaaaagtctctgaggttccaccaaaatatggaacttgattttggacactttgacgaaagagataagacatccaggaacatgcgaggctcccggatgaatgggttgcctagccccactcacagcgcccactgtagcttctaccgaaccagaaccttgcaggcactgagtaatgagaagaaagccaagaaggtacgtttctaccgcaatggggaccgctacttcaaggggattgtgtacgctgtgtcctctgaccgttttcgcagctttgacgccttgctggctgacctgacgcgatctctgtctgacaacatcaacctgcctcagggagtgcgttacatttacaccattgatggatccaggaagatcggaagcatggatgaactggaggaaggggaaagctatgtctgttcctcagacaacttctttaaaaaggtggagtacaccaagaatgtcaatcccaactggtctgtcaacgtaaaaacatctgccaatatgaaagccccccagtccttggctagcagcaacagtgcacaggccagggagaacaaggactttgtgcgccccaagctggttaccatcatccgcagtggggtgaagcctcggaaggctgtgcgtgtgcttctgaacaagaagacagcccactcttttgagcaagtcctcactgatatcacagaagccatcaaactggagaccggggttgtcaaaaaactctacactctggatggaaaacaggtaacttgtctccatgatttctttggtgatgatgatgtgtttattgcctgtggtcctgaaaaatttcgctatgctcaggatgatttttctctggatgaaaatgaatgccgagtcatgaagggaaacccatcagccacagctggcccaaaggcatccccaacacctcagaagacttcagccaagagccctggtcctatgcgccgaagcaagtctccagctgactcaggtaacgaccaagacgcaaacggaacctccagcagccagctctctacccccaagtctaagcagtctcccatctctacgcccaccagtcctggcagcctccggaagcacaaggacctgtacctgcctctgtccttggatgactcggactcgcttggtgattccatgtaaaggaggggagagtgctcagagtccagagtacaaatccaagcctatcattgtagtagggtacttctgctcaagtgtccaacagggctattggtgctttcaagtttttattttgttgttgttgttattttgaaaaacacattgtaatatgttgggtttattttcctgtgatttctcctctgggccactgatccacagttaccaattatgagagatagattgataaccatcctttggggcagcattccagggatgcaaaatgtgctagtccatgacctttcaatggaaagcttaggtgcctgcgttatatttgccctgtctaattttgcccatacagtcttccttctgtagagggctgtttacatatacagcacttaaaatgtttgtgtgggaaaaaaaaaactcattggcagatccaagaatgacaaacacaagtgccccttttctctggatctcaagaatggtggaggaccctggaaggacagcaaggcagctccccagcctcactcttcactcctgattgaggcccgggtttgttgtccagcaccaattctggctgtcaatggggagaaataaaccaacaacttataattgtgacaccagatgcttaggatcctggtgctgggttagctaagagaatagacagaattggaaaatactgcagacatttccgaagagtttataaagcacagtgaattcctggtcaatctctccactgaggcaatttggaatcaataagcaattgataatagtttggagtaagggacttcatatacctgattcctctagaaggctgtctaacataccacatgattacatgaactgtatggtatccatctatctctgttctattgaatgccttgttaacagccaacactgaaaacactgtgagaatttgttttcaggtctgacacctttcagtctctttttatagcaagaaatcaatatcctttttataaaaattcatgtctgtatttcaggagcaaactcttcaggctccttttttataaactggtgatttttcttttgtctaaaaaacacatgaagaaaatttaccaaaaaaaaaaaaaaaagcagaagaataatgtagtttagaaattatgctgtcactgccaaacagtaacctccaggagaaaacaagatgaatagcagaggccaattcaatagaatcagttttttgatagctttttaacagttatgcttgcattaataatttcaatgtggaccagacattctaattatattttaaatgaaatgttacagcatattttaagcaactctttttatctataatcctaatatttcatactgaagacacagaaatctttcacttgtctttaacattagaaaggatttctctttactaaggactgatcatttgaaatagttttcagtcttttgagatacaggtttataacactgcttttttttttctgtaatcatagcccataatggcaaagacaactaaatttaagtgaaggtcatgcatgccaattctgtgtttgcttttagcagatatgaagatttccttatttctttgtaattgtgcagatattttgaaaggcacagcattcgaagccaagctgctgtttggctactgaatggcttgcagttgttcctccactctaaatggaatgagcttgctgtgtgtgtgtgtggtggtggtgggagggggtggtgcatgtgtgtgtgtgtgtgtgcatctgcagctgcttcaaaattaggaaatactacaggacacccctgtaatggattggtggcaactgggtggcactgctgatgtgca

SEQ ID NO: 8769 - DNA, 9069 bp, Homo sapiens
tttctttctctcagcatctccacccaaccagcagaaaaccggtctctgaggttccaccaaaatatggaacttgattttggacactttgacgaaagagataagacatccaggaacatgcgaggctcccggatgaatgggttgcctagccccactcacagcgcccactgtagcttctaccgaaccagaaccttgcaggcactgagtaatgagaagaaagccaagaaggtacgtttctaccgcaatggggaccgctacttcaaggggattgtgtacgctgtgtcctctgaccgttttcgcagctttgacgccttgctggctgacctgacgcgatctctgtctgacaacatcaacctgcctcagggagtgcgttacatttacaccattgatggatccaggaagatcggaagcatggatgaactggaggaaggggaaagctatgtctgttcctcagacaacttctttaaaaaggtggagtacaccaagaatgtcaatcccaactggtctgtcaacgtaaaaacatctgccaatatgaaagccccccagtccttggctagcagcaacagtgcacaggccagggagaacaaggactttgtgcgccccaagctggttaccatcatccgcagtggggtgaagcctcggaaggctgtgcgtgtgcttctgaacaagaagacagcccactcttttgagcaagtcctcactgatatcacagaagccatcaaactggagaccggggttgtcaaaaaactctacactctggatggaaaacaggtaacttgtctccatgatttctttggtgatgatgatgtgtttattgcctgtggtcctgaaaaatttcgctatgctcaggatgatttttctctggatgaaaatgaatgccgagtcatgaagggaaacccatcagccacagctggcccaaaggcatccccaacacctcagaagacttcagccaagagccctggtcctatgcgccgaagcaagtctccagctgactcaggtaacgaccaagacgcaaacggaacctccagcagccagctctctacccccaagtctaagcagtctcccatctctacgcccaccagtcctggcagcctccggaagcacaaggacctgtacctgcctctgtccttggatgactcggactcgcttggtgattccatgtaaaggaggggagagtgctcagagtccagagtacaaatccaagcctatcattgtagtagggtacttctgctcaagtgtccaacagggctattggtgctttcaagtttttattttgttgttgttgttattttgaaaaacacattgtaatatgttgggtttattttcctgtgatttctcctctgggccactgatccacagttaccaattatgagagatagattgataaccatcctttggggcagcattccagggatgcaaaatgtgctagtccatgacctttcaatggaaagcttaggtgcctgcgttatatttgccctgtctaattttgcccatacagtcttccttctgtagagggctgtttacatatacagcacttaaaatgtttgtgtgggaaaaaaaaaactcattggcagatccaagaatgacaaacacaagtgccccttttctctggatctcaagaatggtggaggaccctggaaggacagcaaggcagctccccagcctcactcttcactcctgattgaggcccgggtttgttgtccagcaccaattctggctgtcaatggggagaaataaaccaacaacttataattgtgacaccagatgcttaggatcctggtgctgggttagctaagagaatagacagaattggaaaatactgcagacatttccgaagagtttataaagcacagtgaattcctggtcaatctctccactgaggcaatttggaatcaataagcaattgataatagtttggagtaagggacttcatatacctgattcctctagaaggctgtctaacataccacatgattacatgaactgtatggtatccatctatctctgttctattgaatgccttgttaacagccaacactgaaaacactgtgagaatttgttttcaggtctgacacctttcagtctctttttatagcaagaaatcaatatcctttttataaaaattcatgtctgtatttcaggagcaaactcttcaggctccttttttataaactggtgatttttcttttgtctaaaaaacacatgaagaaaatttaccaaaaaaaaaaaaaaaagcagaagaataatgtagtttagaaattatgctgtcactgccaaacagtaacctccaggagaaaacaagatgaatagcagaggccaattcaatagaatcagttttttgatagctttttaacagttatgcttgcattaataatttcaatgtggaccagacattctaattatattttaaatgaaatgttacagcatattttaagcaactctttttatctataatcctaatatttcatactgaagacacagaaatctttcacttgtctttaacattagaaaggatttctctttactaaggactgatcatttgaaatagttttcagtcttttgagatacaggtttataacactgcttttttttttctgtaatcatagcccataatggcaaagacaactaaatttaagtgaaggtcatgcatgccaattctgtgtttgcttttagcagatatgaagatttccttatttctttgtaattgtgcagatattttgaaaggcacagcattcgaagccaagctgctgtttggctactgaatggcttgcagttgttcctccactctaaatggaatgagcttgctgtgtgtgtgtgtggtggtggtgggagggggtggtgcatgtgtgtgtgtgtgtgtgcatctgcagctgcttcaaaattaggaaatactacaggacacccctgtaatggattggtggcaactgggtggcactgctgatgtgcactgtgtaggggggaacccagtggtggtggggtagctcagatgcccctagacaagcttcagatgtctgtagctaccagaaacattttcggttcaggaaaagtgagatgatggtagtactggtttctggtgaaattgaagaaccccaaatgatgaggatctctttttgccccctctcctttttttgtagacccattcaaaaccattaataagcccattttactaagcccctatttctttctagaagctcagggttttcttagtgcctcccagaacattttgtagttaattgggaaaaagtgatacttggattagggggtgtgggcataaagaatggtgggaggcctgattttaaacttcaggccagaacccccaatgactccacccatagtctcactttaggtctcatttagtccatcacctttattttaagttgaggaagtggaggctggtaaagagcaggaccagaggaagaatccagatttccttatgcttgggcctcacactagctctctgagtatttccttgattgcggtatatgtactactagaaaataccaaatggatatattttctttaggataacctttgaaccaacaatcttcaataacaatagtacatcttccatcttacttttaatcgagtataaggaaatgtttctttatggccattttggagggagcaggggatgaggcttggcatagtccaaaatttaagtctccaataattaattgcattttaaattggcccactttcaaggcaattttttttgtgtgtctgtaactgagctcctccacccctgtcattcacttccaattttacccaatccaattttagcactcaagttccattgtgttaatttctgcacggtcaacaaacatcaagtcagcaagcatttgccaccactccctatacttctccctccttcttacacacacacacacacacacacacacaatccatctcttgcttgttcctacctcctgatttttcttccctacagaaatagaaatagggacaaagaaggggaaaatgtatatattggggctgggctgaacaactaacttcataagtagtattaactaggggtaaattgagagaaaagctccttttctcttcactgttttggaaaggatagccattagcatgactgctttgtgtccttatggactttagtattagcctagattgaattatagcgttttctagctggaaggaaccttaagatcacatcatctactcctctactccaaatttctcattcttcaggccaggaaaccgagacacagaggtaaagtaatttccccaaggtcacacagctggctggggcaggattgggtttacaacccacatctcctggctcttattccagggccttttcccactaagtagtattgccttccattaggctcctgagagttatttctcagggtcatgttgcatcttggagccacatgctgctgccctgatctcagtgggaaatccacccagcaacctaatacagccccttttccctgcattcacctggttcccatccacatgggttgcagatgtccttgaagagagtgaggcattgagggccaataggagcaatggggtccctggccttgtccatctgattcaggagatcactgctccatcgtgaggagccctctgaatagccccccactgaatgcttgccttgcccaaatggaatggaggaagattgattttctccatcagttcaccttgtgtcatctcataatggttggtctttccaggctgagggaaatgtttcttgtttccagagtagaaaaagaaagagtggaacaatagctttgttcatcctaactttctgagatggcttttcaacattttaaaaaaactagtgtggctaccattcactggcaatgatttcttttagaatatgggagtaagatgagctagagaaaataacctggtctcactgtggttgccctcatccacaatgtccccaaagccatcctgctctgatgaggacaatttccaggtataagcaaggggctttgtgacaaaaatgtaccctggctgatgttaaacattggctcctgtgtttgcaccaaaatagcaagctgtgtgctctatacactcttcccatcgtcttgtgtacactgctcctgtggccttccacagcagaaaccagggcaaaagggtccaaacacatggttttccttgctgcaaggctcttcctgggaactaagggggtatttattagttcagttctaagagacctccttctgggcttaccccactcctcaggtacttctctctccttcctccttctcctccacagtcacaagtaaccaaggaacctgaaagtggatgtgtagctatttgaagaaggcaaggaaccctgagattcttctttgaatcctctagtccaagtcttagaccagtgattggtgcttaccttgaacaaaattttgtctgtgttcctaatcccttcaatactctgggtacaatgctcccaatcaccctgcacatttgattctaaatggcttttattttttaaaaatccatatccctaggacaagagaacaggatgcctatatccccaaaatgagctccaggacactgatgggaatgatcccaaagatcaccccacctcagaaacgtctgtgccaagagacttccccagatagaaacactgggacagtggtttgaacgacttcttttatggttgtccagtttgctatggaaataaaaggcattgattttttaaaaagatgattggaacctgtctttggccacatagggccacttggatccatttccaggccttactcatatattgccttcactgaagggctttggctttaagtcccagactggtctcccaagtgaaccataagtgttttggagctcatctggggtgaggcatgagaatgttgccccatctatcccttcaggaaaaggtgccttccctccctttctcctaaagcctggtccccagaaattgtttttgtctccaaaagtctagtatggtctttatacacccagactcttagtgttgcgtcctgccttgtttccttgttaaggatctatgcagacctcccgctttggcttagctagcgtgacattggctatcatttgacaagactaacttttttttttttttttttttgactgagtctccctctgtcacctaggctggagtgcagtggcacaatcttggctcgctgcaaccttcacccttcacctcccaggtcgaagcgattctcctgcctcagtctcccgagtagctgggattacaggcgtgcgccaccaaatctggctatttttttattattattatttttagtagagatggggtttcaccatgttggccagactggtcttgaactcttggcctcaaattatctgcccacctcggcctcccaaagtgctgggattacaggcatgagccaccatgcccagctgacaagactaattttttatcccttggtttattggcttcaacatcttctggaatcagaggtgattttttcttaccttggatgcctgagactaggggagtatagaattccaattggtaattaaggcatctttctgctcctgatcagaagggcaggttagttgggagaggtcagatggcacaacagaagtcaccttgtaagtaaggcaaagacttgaaggcattagcgtttctcattactaggtcaataacctgagggaatcaatggctttttgccgctctacctcttgtgtatctctttgacttttctttctctgtctagtttcctctgttctcagtttatattctatgttatcagtctctctttccacagtacaaacatccatcctttctcctgtgcaattctgtctctccctcttattatctttatttgtactttttccttcctccctgtctaggcattgggcatgtgcctcttcttagcctgtgattttgccttgggactgatgataaattatttccagattcaatcagccctggtcctaccccagtccaatcagaagtatgttggtgggaatcaacctgatcctggccctttcttcttctccattttcattcgtaatccccctcagcagatctttacaagcagtttccttatagctcatgtatctttaggtctttgccttccaagcactgtacagaatactttgtggttcctttttagtctgacattttgtggagcagtgaagcgtgctcagagacataatcagctgaagagaaaaaatccacccatggatttatatcagctaaatactaataattgattttgtttgatgtgcccataatttttaaagctgcaatataatataatgagggaccacaggtaatttctcctgtcatttgttttggctggatgggggtgggggagtaattgcttaaagttttaccattacacattaaactctctataataatcttgtttggggcttgctaactgttgagctgttttaactaaactggtaggcaatcggagttgatttaaatgaaaagataatttaacaaatctatactataaaaagagacatttgcttaattgacatgtattttttccttctgagtcacctaaacatttactcttgacaccaactgttcatgatactgaatagacagtccatataagagaaattagtggacctaaagaagccagattgtaggtgttaatttattaaacagagtgcaaagcccttggaaatgtcactgcttggcaataccatatggaatgccaaaatttacaatgacttttctttataagttatccaaaagggatttgaacaagtaagaggttatgccaaaatgtctccaatgtatggtcctgtaatatattgcagcttgaagccaatgatcccttatgacttgtatacaactaatgcatgttttattgaattttgcatttcccacgtgtggtaagttctttaaaatgtttttgatcacctttttgtgccattaaacttgtacagaaaatgtttttatggccattttcaaagggagaaagtttaaaatggaaacagcccaccctttctgccctatagctgtagttagaattgagtacctgtagcaaaacagctgtaattggtggttgtagtgttagaggtgttagcttgctagtgactagctttggagagtaaatgcatggtattgtacatcacatttcttaactcgttttaacctctgaaaagaatatattcttctttgtagtccttcttcccacccccttgccctctccctctccctgctcccagttgtcttacagttgtaaatatctgatttgaggcccaataactcttgccaagtaaagtcagcaaacaacaaacaaaccaaaatgtggggaaaaggcatttctcaaccatctctcagcagttattgatcatttcttaaggaacagcattgtgatcaaagactcaactttacgtaaaaatcagtggtaaattggggttgtatttggccatttgattacatttcaggattgaatagttttcagaatcacatgtaatccaaagacagtaggtagtgatgtcccttatccctgcagctgttttaagatagagacctcagaagactctgcttgaccgatgaccaataattatttgaaaaaaaaagaaaaaatgagagaaataaaacagatatttaagaactttagccacctatttagaatagttatagccagaaaaaaaaacaagggcatgagttcaaatgcattactatcagtgtcctaggcaatacctaacctactctgaaattgtgattcaaaagcagtatttcaagaggcattctccttttttggtttgctgaccccacttggactggtaggtttggtgaggcccccataaaccagctggagcagacccttttcatctcctgtgcctgtaacacccctcttcccccaccccctccgcaattcaatgagggctttcttgggtcagaggacttcaaggttgtctagagaagtttgccatgtgtgtaaggtgctgtgaactgtgagtgctgaagattcgcagcattcaataccaggcagccaaagagctgctcttgcaattattttggctctcaagctctgttcttcatcgcattctcatttctgtgtacatttgcaagatgtgtgtaatgtcattttccaaaaataaaatttgatttcaata

SEQ ID NO: 8770 - DNA, 9223 bp, Homo sapiens
attgtactgaaatgcaaagactgcttcctaagctggagatgctaaccttgggtagctccttctgttctcttcaaggggaattttgtcaggctatggattcatttacaactgttagtcatgtgggcatgtgtgaggaaacagatgccagttttaatgtatttagcccgaagttccaatttgataggagccactgtcagtctctgaggttccaccaaaatatggaacttgattttggacactttgacgaaagagataagacatccaggaacatgcgaggctcccggatgaatgggttgcctagccccactcacagcgcccactgtagcttctaccgaaccagaaccttgcaggcactgagtaatgagaagaaagccaagaaggtacgtttctaccgcaatggggaccgctacttcaaggggattgtgtacgctgtgtcctctgaccgttttcgcagctttgacgccttgctggctgacctgacgcgatctctgtctgacaacatcaacctgcctcagggagtgcgttacatttacaccattgatggatccaggaagatcggaagcatggatgaactggaggaaggggaaagctatgtctgttcctcagacaacttctttaaaaaggtggagtacaccaagaatgtcaatcccaactggtctgtcaacgtaaaaacatctgccaatatgaaagccccccagtccttggctagcagcaacagtgcacaggccagggagaacaaggactttgtgcgccccaagctggttaccatcatccgcagtggggtgaagcctcggaaggctgtgcgtgtgcttctgaacaagaagacagcccactcttttgagcaagtcctcactgatatcacagaagccatcaaactggagaccggggttgtcaaaaaactctacactctggatggaaaacaggtaacttgtctccatgatttctttggtgatgatgatgtgtttattgcctgtggtcctgaaaaatttcgctatgctcaggatgatttttctctggatgaaaatgaatgccgagtcatgaagggaaacccatcagccacagctggcccaaaggcatccccaacacctcagaagacttcagccaagagccctggtcctatgcgccgaagcaagtctccagctgactcaggtaacgaccaagacgcaaacggaacctccagcagccagctctctacccccaagtctaagcagtctcccatctctacgcccaccagtcctggcagcctccggaagcacaaggacctgtacctgcctctgtccttggatgactcggactcgcttggtgattccatgtaaaggaggggagagtgctcagagtccagagtacaaatccaagcctatcattgtagtagggtacttctgctcaagtgtccaacagggctattggtgctttcaagtttttattttgttgttgttgttattttgaaaaacacattgtaatatgttgggtttattttcctgtgatttctcctctgggccactgatccacagttaccaattatgagagatagattgataaccatcctttggggcagcattccagggatgcaaaatgtgctagtccatgacctttcaatggaaagcttaggtgcctgcgttatatttgccctgtctaattttgcccatacagtcttccttctgtagagggctgtttacatatacagcacttaaaatgtttgtgtgggaaaaaaaaaactcattggcagatccaagaatgacaaacacaagtgccccttttctctggatctcaagaatggtggaggaccctggaaggacagcaaggcagctccccagcctcactcttcactcctgattgaggcccgggtttgttgtccagcaccaattctggctgtcaatggggagaaataaaccaacaacttataattgtgacaccagatgcttaggatcctggtgctgggttagctaagagaatagacagaattggaaaatactgcagacatttccgaagagtttataaagcacagtgaattcctggtcaatctctccactgaggcaatttggaatcaataagcaattgataatagtttggagtaagggacttcatatacctgattcctctagaaggctgtctaacataccacatgattacatgaactgtatggtatccatctatctctgttctattgaatgccttgttaacagccaacactgaaaacactgtgagaatttgttttcaggtctgacacctttcagtctctttttatagcaagaaatcaatatcctttttataaaaattcatgtctgtatttcaggagcaaactcttcaggctccttttttataaactggtgatttttcttttgtctaaaaaacacatgaagaaaatttaccaaaaaaaaaaaaaaaagcagaagaataatgtagtttagaaattatgctgtcactgccaaacagtaacctccaggagaaaacaagatgaatagcagaggccaattcaatagaatcagttttttgatagctttttaacagttatgcttgcattaataatttcaatgtggaccagacattctaattatattttaaatgaaatgttacagcatattttaagcaactctttttatctataatcctaatatttcatactgaagacacagaaatctttcacttgtctttaacattagaaaggatttctctttactaaggactgatcatttgaaatagttttcagtcttttgagatacaggtttataacactgcttttttttttctgtaatcatagcccataatggcaaagacaactaaatttaagtgaaggtcatgcatgccaattctgtgtttgcttttagcagatatgaagatttccttatttctttgtaattgtgcagatattttgaaaggcacagcattcgaagccaagctgctgtttggctactgaatggcttgcagttgttcctccactctaaatggaatgagcttgctgtgtgtgtgtgtggtggtggtgggagggggtggtgcatgtgtgtgtgtgtgtgtgcatctgcagctgcttcaaaattaggaaatactacaggacacccctgtaatggattggtggcaactgggtggcactgctgatgtgcactgtgtaggggggaacccagtggtggtggggtagctcagatgcccctagacaagcttcagatgtctgtagctaccagaaacattttcggttcaggaaaagtgagatgatggtagtactggtttctggtgaaattgaagaaccccaaatgatgaggatctctttttgccccctctcctttttttgtagacccattcaaaaccattaataagcccattttactaagcccctatttctttctagaagctcagggttttcttagtgcctcccagaacattttgtagttaattgggaaaaagtgatacttggattagggggtgtgggcataaagaatggtgggaggcctgattttaaacttcaggccagaacccccaatgactccacccatagtctcactttaggtctcatttagtccatcacctttattttaagttgaggaagtggaggctggtaaagagcaggaccagaggaagaatccagatttccttatgcttgggcctcacactagctctctgagtatttccttgattgcggtatatgtactactagaaaataccaaatggatatattttctttaggataacctttgaaccaacaatcttcaataacaatagtacatcttccatcttacttttaatcgagtataaggaaatgtttctttatggccattttggagggagcaggggatgaggcttggcatagtccaaaatttaagtctccaataattaattgcattttaaattggcccactttcaaggcaattttttttgtgtgtctgtaactgagctcctccacccctgtcattcacttccaattttacccaatccaattttagcactcaagttccattgtgttaatttctgcacggtcaacaaacatcaagtcagcaagcatttgccaccactccctatacttctccctccttcttacacacacacacacacacacacacacaatccatctcttgcttgttcctacctcctgatttttcttccctacagaaatagaaatagggacaaagaaggggaaaatgtatatattggggctgggctgaacaactaacttcataagtagtattaactaggggtaaattgagagaaaagctccttttctcttcactgttttggaaaggatagccattagcatgactgctttgtgtccttatggactttagtattagcctagattgaattatagcgttttctagctggaaggaaccttaagatcacatcatctactcctctactccaaatttctcattcttcaggccaggaaaccgagacacagaggtaaagtaatttccccaaggtcacacagctggctggggcaggattgggtttacaacccacatctcctggctcttattccagggccttttcccactaagtagtattgccttccattaggctcctgagagttatttctcagggtcatgttgcatcttggagccacatgctgctgccctgatctcagtgggaaatccacccagcaacctaatacagccccttttccctgcattcacctggttcccatccacatgggttgcagatgtccttgaagagagtgaggcattgagggccaataggagcaatggggtccctggccttgtccatctgattcaggagatcactgctccatcgtgaggagccctctgaatagccccccactgaatgcttgccttgcccaaatggaatggaggaagattgattttctccatcagttcaccttgtgtcatctcataatggttggtctttccaggctgagggaaatgtttcttgtttccagagtagaaaaagaaagagtggaacaatagctttgttcatcctaactttctgagatggcttttcaacattttaaaaaaactagtgtggctaccattcactggcaatgatttcttttagaatatgggagtaagatgagctagagaaaataacctggtctcactgtggttgccctcatccacaatgtccccaaagccatcctgctctgatgaggacaatttccaggtataagcaaggggctttgtgacaaaaatgtaccctggctgatgttaaacattggctcctgtgtttgcaccaaaatagcaagctgtgtgctctatacactcttcccatcgtcttgtgtacactgctcctgtggccttccacagcagaaaccagggcaaaagggtccaaacacatggttttccttgctgcaaggctcttcctgggaactaagggggtatttattagttcagttctaagagacctccttctgggcttaccccactcctcaggtacttctctctccttcctccttctcctccacagtcacaagtaaccaaggaacctgaaagtggatgtgtagctatttgaagaaggcaaggaaccctgagattcttctttgaatcctctagtccaagtcttagaccagtgattggtgcttaccttgaacaaaattttgtctgtgttcctaatcccttcaatactctgggtacaatgctcccaatcaccctgcacatttgattctaaatggcttttattttttaaaaatccatatccctaggacaagagaacaggatgcctatatccccaaaatgagctccaggacactgatgggaatgatcccaaagatcaccccacctcagaaacgtctgtgccaagagacttccccagatagaaacactgggacagtggtttgaacgacttcttttatggttgtccagtttgctatggaaataaaaggcattgattttttaaaaagatgattggaacctgtctttggccacatagggccacttggatccatttccaggccttactcatatattgccttcactgaagggctttggctttaagtcccagactggtctcccaagtgaaccataagtgttttggagctcatctggggtgaggcatgagaatgttgccccatctatcccttcaggaaaaggtgccttccctccctttctcctaaagcctggtccccagaaattgtttttgtctccaaaagtctagtatggtctttatacacccagactcttagtgttgcgtcctgccttgtttccttgttaaggatctatgcagacctcccgctttggcttagctagcgtgacattggctatcatttgacaagactaacttttttttttttttttttttgactgagtctccctctgtcacctaggctggagtgcagtggcacaatcttggctcgctgcaaccttcacccttcacctcccaggtcgaagcgattctcctgcctcagtctcccgagtagctgggattacaggcgtgcgccaccaaatctggctatttttttattattattatttttagtagagatggggtttcaccatgttggccagactggtcttgaactcttggcctcaaattatctgcccacctcggcctcccaaagtgctgggattacaggcatgagccaccatgcccagctgacaagactaattttttatcccttggtttattggcttcaacatcttctggaatcagaggtgattttttcttaccttggatgcctgagactaggggagtatagaattccaattggtaattaaggcatctttctgctcctgatcagaagggcaggttagttgggagaggtcagatggcacaacagaagtcaccttgtaagtaaggcaaagacttgaaggcattagcgtttctcattactaggtcaataacctgagggaatcaatggctttttgccgctctacctcttgtgtatctctttgacttttctttctctgtctagtttcctctgttctcagtttatattctatgttatcagtctctctttccacagtacaaacatccatcctttctcctgtgcaattctgtctctccctcttattatctttatttgtactttttccttcctccctgtctaggcattgggcatgtgcctcttcttagcctgtgattttgccttgggactgatgataaattatttccagattcaatcagccctggtcctaccccagtccaatcagaagtatgttggtgggaatcaacctgatcctggccctttcttcttctccattttcattcgtaatccccctcagcagatctttacaagcagtttccttatagctcatgtatctttaggtctttgccttccaagcactgtacagaatactttgtggttcctttttagtctgacattttgtggagcagtgaagcgtgctcagagacataatcagctgaagagaaaaaatccacccatggatttatatcagctaaatactaataattgattttgtttgatgtgcccataatttttaaagctgcaatataatataatgagggaccacaggtaatttctcctgtcatttgttttggctggatgggggtgggggagtaattgcttaaagttttaccattacacattaaactctctataataatcttgtttggggcttgctaactgttgagctgttttaactaaactggtaggcaatcggagttgatttaaatgaaaagataatttaacaaatctatactataaaaagagacatttgcttaattgacatgtattttttccttctgagtcacctaaacatttactcttgacaccaactgttcatgatactgaatagacagtccatataagagaaattagtggacctaaagaagccagattgtaggtgttaatttattaaacagagtgcaaagcccttggaaatgtcactgcttggcaataccatatggaatgccaaaatttacaatgacttttctttataagttatccaaaagggatttgaacaagtaagaggttatgccaaaatgtctccaatgtatggtcctgtaatatattgcagcttgaagccaatgatcccttatgacttgtatacaactaatgcatgttttattgaattttgcatttcccacgtgtggtaagttctttaaaatgtttttgatcacctttttgtgccattaaacttgtacagaaaatgtttttatggccattttcaaagggagaaagtttaaaatggaaacagcccaccctttctgccctatagctgtagttagaattgagtacctgtagcaaaacagctgtaattggtggttgtagtgttagaggtgttagcttgctagtgactagctttggagagtaaatgcatggtattgtacatcacatttcttaactcgttttaacctctgaaaagaatatattcttctttgtagtccttcttcccacccccttgccctctccctctccctgctcccagttgtcttacagttgtaaatatctgatttgaggcccaataactcttgccaagtaaagtcagcaaacaacaaacaaaccaaaatgtggggaaaaggcatttctcaaccatctctcagcagttattgatcatttcttaaggaacagcattgtgatcaaagactcaactttacgtaaaaatcagtggtaaattggggttgtatttggccatttgattacatttcaggattgaatagttttcagaatcacatgtaatccaaagacagtaggtagtgatgtcccttatccctgcagctgttttaagatagagacctcagaagactctgcttgaccgatgaccaataattatttgaaaaaaaaagaaaaaatgagagaaataaaacagatatttaagaactttagccacctatttagaatagttatagccagaaaaaaaaacaagggcatgagttcaaatgcattactatcagtgtcctaggcaatacctaacctactctgaaattgtgattcaaaagcagtatttcaagaggcattctccttttttggtttgctgaccccacttggactggtaggtttggtgaggcccccataaaccagctggagcagacccttttcatctcctgtgcctgtaacacccctcttcccccaccccctccgcaattcaatgagggctttcttgggtcagaggacttcaaggttgtctagagaagtttgccatgtgtgtaaggtgctgtgaactgtgagtgctgaagattcgcagcattcaataccaggcagccaaagagctgctcttgcaattattttggctctcaagctctgttcttcatcgcattctcatttctgtgtacatttgcaagatgtgtgtaatgtcattttccaaaaataaaatttgatttcaat

SEQ ID NO: 8771 - DNA, 9122 bp, Homo sapiens
cacaaggcaaagcctgctctctctgtctctctgtctcctcttctccttttttgccttattctatccgattttttccctaagcttctacctgggattttcctttggaaaagtctctgaggttccaccaaaatatggaacttgattttggacactttgacgaaagagataagacatccaggaacatgcgaggctcccggatgaatgggttgcctagccccactcacagcgcccactgtagcttctaccgaaccagaaccttgcaggcactgagtaatgagaagaaagccaagaaggtacgtttctaccgcaatggggaccgctacttcaaggggattgtgtacgctgtgtcctctgaccgttttcgcagctttgacgccttgctggctgacctgacgcgatctctgtctgacaacatcaacctgcctcagggagtgcgttacatttacaccattgatggatccaggaagatcggaagcatggatgaactggaggaaggggaaagctatgtctgttcctcagacaacttctttaaaaaggtggagtacaccaagaatgtcaatcccaactggtctgtcaacgtaaaaacatctgccaatatgaaagccccccagtccttggctagcagcaacagtgcacaggccagggagaacaaggactttgtgcgccccaagctggttaccatcatccgcagtggggtgaagcctcggaaggctgtgcgtgtgcttctgaacaagaagacagcccactcttttgagcaagtcctcactgatatcacagaagccatcaaactggagaccggggttgtcaaaaaactctacactctggatggaaaacaggtaacttgtctccatgatttctttggtgatgatgatgtgtttattgcctgtggtcctgaaaaatttcgctatgctcaggatgatttttctctggatgaaaatgaatgccgagtcatgaagggaaacccatcagccacagctggcccaaaggcatccccaacacctcagaagacttcagccaagagccctggtcctatgcgccgaagcaagtctccagctgactcagcaaacggaacctccagcagccagctctctacccccaagtctaagcagtctcccatctctacgcccaccagtcctggcagcctccggaagcacaaggacctgtacctgcctctgtccttggatgactcggactcgcttggtgattccatgtaaaggaggggagagtgctcagagtccagagtacaaatccaagcctatcattgtagtagggtacttctgctcaagtgtccaacagggctattggtgctttcaagtttttattttgttgttgttgttattttgaaaaacacattgtaatatgttgggtttattttcctgtgatttctcctctgggccactgatccacagttaccaattatgagagatagattgataaccatcctttggggcagcattccagggatgcaaaatgtgctagtccatgacctttcaatggaaagcttaggtgcctgcgttatatttgccctgtctaattttgcccatacagtcttccttctgtagagggctgtttacatatacagcacttaaaatgtttgtgtgggaaaaaaaaaactcattggcagatccaagaatgacaaacacaagtgccccttttctctggatctcaagaatggtggaggaccctggaaggacagcaaggcagctccccagcctcactcttcactcctgattgaggcccgggtttgttgtccagcaccaattctggctgtcaatggggagaaataaaccaacaacttataattgtgacaccagatgcttaggatcctggtgctgggttagctaagagaatagacagaattggaaaatactgcagacatttccgaagagtttataaagcacagtgaattcctggtcaatctctccactgaggcaatttggaatcaataagcaattgataatagtttggagtaagggacttcatatacctgattcctctagaaggctgtctaacataccacatgattacatgaactgtatggtatccatctatctctgttctattgaatgccttgttaacagccaacactgaaaacactgtgagaatttgttttcaggtctgacacctttcagtctctttttatagcaagaaatcaatatcctttttataaaaattcatgtctgtatttcaggagcaaactcttcaggctccttttttataaactggtgatttttcttttgtctaaaaaacacatgaagaaaatttaccaaaaaaaaaaaaaaaagcagaagaataatgtagtttagaaattatgctgtcactgccaaacagtaacctccaggagaaaacaagatgaatagcagaggccaattcaatagaatcagttttttgatagctttttaacagttatgcttgcattaataatttcaatgtggaccagacattctaattatattttaaatgaaatgttacagcatattttaagcaactctttttatctataatcctaatatttcatactgaagacacagaaatctttcacttgtctttaacattagaaaggatttctctttactaaggactgatcatttgaaatagttttcagtcttttgagatacaggtttataacactgcttttttttttctgtaatcatagcccataatggcaaagacaactaaatttaagtgaaggtcatgcatgccaattctgtgtttgcttttagcagatatgaagatttccttatttctttgtaattgtgcagatattttgaaaggcacagcattcgaagccaagctgctgtttggctactgaatggcttgcagttgttcctccactctaaatggaatgagcttgctgtgtgtgtgtgtggtggtggtgggagggggtggtgcatgtgtgtgtgtgtgtgtgcatctgcagctgcttcaaaattaggaaatactacaggacacccctgtaatggattggtggcaactgggtggcactgctgatgtgcactgtgtaggggggaacccagtggtggtggggtagctcagatgcccctagacaagcttcagatgtctgtagctaccagaaacattttcggttcaggaaaagtgagatgatggtagtactggtttctggtgaaattgaagaaccccaaatgatgaggatctctttttgccccctctcctttttttgtagacccattcaaaaccattaataagcccattttactaagcccctatttctttctagaagctcagggttttcttagtgcctcccagaacattttgtagttaattgggaaaaagtgatacttggattagggggtgtgggcataaagaatggtgggaggcctgattttaaacttcaggccagaacccccaatgactccacccatagtctcactttaggtctcatttagtccatcacctttattttaagttgaggaagtggaggctggtaaagagcaggaccagaggaagaatccagatttccttatgcttgggcctcacactagctctctgagtatttccttgattgcggtatatgtactactagaaaataccaaatggatatattttctttaggataacctttgaaccaacaatcttcaataacaatagtacatcttccatcttacttttaatcgagtataaggaaatgtttctttatggccattttggagggagcaggggatgaggcttggcatagtccaaaatttaagtctccaataattaattgcattttaaattggcccactttcaaggcaattttttttgtgtgtctgtaactgagctcctccacccctgtcattcacttccaattttacccaatccaattttagcactcaagttccattgtgttaatttctgcacggtcaacaaacatcaagtcagcaagcatttgccaccactccctatacttctccctccttcttacacacacacacacacacacacacacaatccatctcttgcttgttcctacctcctgatttttcttccctacagaaatagaaatagggacaaagaaggggaaaatgtatatattggggctgggctgaacaactaacttcataagtagtattaactaggggtaaattgagagaaaagctccttttctcttcactgttttggaaaggatagccattagcatgactgctttgtgtccttatggactttagtattagcctagattgaattatagcgttttctagctggaaggaaccttaagatcacatcatctactcctctactccaaatttctcattcttcaggccaggaaaccgagacacagaggtaaagtaatttccccaaggtcacacagctggctggggcaggattgggtttacaacccacatctcctggctcttattccagggccttttcccactaagtagtattgccttccattaggctcctgagagttatttctcagggtcatgttgcatcttggagccacatgctgctgccctgatctcagtgggaaatccacccagcaacctaatacagccccttttccctgcattcacctggttcccatccacatgggttgcagatgtccttgaagagagtgaggcattgagggccaataggagcaatggggtccctggccttgtccatctgattcaggagatcactgctccatcgtgaggagccctctgaatagccccccactgaatgcttgccttgcccaaatggaatggaggaagattgattttctccatcagttcaccttgtgtcatctcataatggttggtctttccaggctgagggaaatgtttcttgtttccagagtagaaaaagaaagagtggaacaatagctttgttcatcctaactttctgagatggcttttcaacattttaaaaaaactagtgtggctaccattcactggcaatgatttcttttagaatatgggagtaagatgagctagagaaaataacctggtctcactgtggttgccctcatccacaatgtccccaaagccatcctgctctgatgaggacaatttccaggtataagcaaggggctttgtgacaaaaatgtaccctggctgatgttaaacattggctcctgtgtttgcaccaaaatagcaagctgtgtgctctatacactcttcccatcgtcttgtgtacactgctcctgtggccttccacagcagaaaccagggcaaaagggtccaaacacatggttttccttgctgcaaggctcttcctgggaactaagggggtatttattagttcagttctaagagacctccttctgggcttaccccactcctcaggtacttctctctccttcctccttctcctccacagtcacaagtaaccaaggaacctgaaagtggatgtgtagctatttgaagaaggcaaggaaccctgagattcttctttgaatcctctagtccaagtcttagaccagtgattggtgcttaccttgaacaaaattttgtctgtgttcctaatcccttcaatactctgggtacaatgctcccaatcaccctgcacatttgattctaaatggcttttattttttaaaaatccatatccctaggacaagagaacaggatgcctatatccccaaaatgagctccaggacactgatgggaatgatcccaaagatcaccccacctcagaaacgtctgtgccaagagacttccccagatagaaacactgggacagtggtttgaacgacttcttttatggttgtccagtttgctatggaaataaaaggcattgattttttaaaaagatgattggaacctgtctttggccacatagggccacttggatccatttccaggccttactcatatattgccttcactgaagggctttggctttaagtcccagactggtctcccaagtgaaccataagtgttttggagctcatctggggtgaggcatgagaatgttgccccatctatcccttcaggaaaaggtgccttccctccctttctcctaaagcctggtccccagaaattgtttttgtctccaaaagtctagtatggtctttatacacccagactcttagtgttgcgtcctgccttgtttccttgttaaggatctatgcagacctcccgctttggcttagctagcgtgacattggctatcatttgacaagactaacttttttttttttttttttttgactgagtctccctctgtcacctaggctggagtgcagtggcacaatcttggctcgctgcaaccttcacccttcacctcccaggtcgaagcgattctcctgcctcagtctcccgagtagctgggattacaggcgtgcgccaccaaatctggctatttttttattattattatttttagtagagatggggtttcaccatgttggccagactggtcttgaactcttggcctcaaattatctgcccacctcggcctcccaaagtgctgggattacaggcatgagccaccatgcccagctgacaagactaattttttatcccttggtttattggcttcaacatcttctggaatcagaggtgattttttcttaccttggatgcctgagactaggggagtatagaattccaattggtaattaaggcatctttctgctcctgatcagaagggcaggttagttgggagaggtcagatggcacaacagaagtcaccttgtaagtaaggcaaagacttgaaggcattagcgtttctcattactaggtcaataacctgagggaatcaatggctttttgccgctctacctcttgtgtatctctttgacttttctttctctgtctagtttcctctgttctcagtttatattctatgttatcagtctctctttccacagtacaaacatccatcctttctcctgtgcaattctgtctctccctcttattatctttatttgtactttttccttcctccctgtctaggcattgggcatgtgcctcttcttagcctgtgattttgccttgggactgatgataaattatttccagattcaatcagccctggtcctaccccagtccaatcagaagtatgttggtgggaatcaacctgatcctggccctttcttcttctccattttcattcgtaatccccctcagcagatctttacaagcagtttccttatagctcatgtatctttaggtctttgccttccaagcactgtacagaatactttgtggttcctttttagtctgacattttgtggagcagtgaagcgtgctcagagacataatcagctgaagagaaaaaatccacccatggatttatatcagctaaatactaataattgattttgtttgatgtgcccataatttttaaagctgcaatataatataatgagggaccacaggtaatttctcctgtcatttgttttggctggatgggggtgggggagtaattgcttaaagttttaccattacacattaaactctctataataatcttgtttggggcttgctaactgttgagctgttttaactaaactggtaggcaatcggagttgatttaaatgaaaagataatttaacaaatctatactataaaaagagacatttgcttaattgacatgtattttttccttctgagtcacctaaacatttactcttgacaccaactgttcatgatactgaatagacagtccatataagagaaattagtggacctaaagaagccagattgtaggtgttaatttattaaacagagtgcaaagcccttggaaatgtcactgcttggcaataccatatggaatgccaaaatttacaatgacttttctttataagttatccaaaagggatttgaacaagtaagaggttatgccaaaatgtctccaatgtatggtcctgtaatatattgcagcttgaagccaatgatcccttatgacttgtatacaactaatgcatgttttattgaattttgcatttcccacgtgtggtaagttctttaaaatgtttttgatcacctttttgtgccattaaacttgtacagaaaatgtttttatggccattttcaaagggagaaagtttaaaatggaaacagcccaccctttctgccctatagctgtagttagaattgagtacctgtagcaaaacagctgtaattggtggttgtagtgttagaggtgttagcttgctagtgactagctttggagagtaaatgcatggtattgtacatcacatttcttaactcgttttaacctctgaaaagaatatattcttctttgtagtccttcttcccacccccttgccctctccctctccctgctcccagttgtcttacagttgtaaatatctgatttgaggcccaataactcttgccaagtaaagtcagcaaacaacaaacaaaccaaaatgtggggaaaaggcatttctcaaccatctctcagcagttattgatcatttcttaaggaacagcattgtgatcaaagactcaactttacgtaaaaatcagtggtaaattggggttgtatttggccatttgattacatttcaggattgaatagttttcagaatcacatgtaatccaaagacagtaggtagtgatgtcccttatccctgcagctgttttaagatagagacctcagaagactctgcttgaccgatgaccaataattatttgaaaaaaaaagaaaaaatgagagaaataaaacagatatttaagaactttagccacctatttagaatagttatagccagaaaaaaaaacaagggcatgagttcaaatgcattactatcagtgtcctaggcaatacctaacctactctgaaattgtgattcaaaagcagtatttcaagaggcattctccttttttggtttgctgaccccacttggactggtaggtttggtgaggcccccataaaccagctggagcagacccttttcatctcctgtgcctgtaacacccctcttcccccaccccctccgcaattcaatgagggctttcttgggtcagaggacttcaaggttgtctagagaagtttgccatgtgtgtaaggtgctgtgaactgtgagtgctgaagattcgcagcattcaataccaggcagccaaagagctgctcttgcaattattttggctctcaagctctgttcttcatcgcattctcatttctgtgtacatttgcaagatgtgtgtaatgtcattttccaaaaataaaatttgatttcaata

SEQ ID NO: 8772 - DNA, 518 bp, Homo sapiens
aatgctgagctcagcataggtcatggtgacattggaaaaaaggcggaattgagcctggcagacccattaggcaccagtctttcttatctcctgtcctcctggtcccttgcaaatatattgatgtggcagtgtgtagcagctgagccctgcttgctttgtctctgaggttccaccaaaatatggaacttgattttggacactttgacgaaagagataagacatccaggaacatgcgaggctcccggatgaatgggttgcctagccccactcacagcgcccactgtagcttctaccgaaccagaaccttgcaggcactgagtaatgagaagaaagccaagaaggtacgtttctaccgcaatggggaccgctacttcaaggggattgtgtacgctgtgtcctctgaccgttttcgcagctttgacgccttgctggctgacctgacgcgatctctgtctgacaacatcaacctgcctcagggagtgcgttacatttacaccattgatggatccaggaagatc

SEQ ID NO: 8773 - DNA, 2422 bp, Homo sapiens
gaaacctttctagctgttaatgcagcctgtgaatttttttaaaagcatgtaattaatcataggaggttggggggattcactaagcctgagttacatgggagaagctggacaaggcactaggacctagaaggcatctatccaccctggcaggaatttcttgcttggagctcagacaacaaaggcatagagagattggttttctttctctcagcatctccacccaaccagcagaaaaccggtctctgaggttccaccaaaatatggaacttgattttggacactttgacgaaagagataagacatccaggaacatgcgaggctcccggatgaatgggttgcctagccccactcacagcgcccactgtagcttctaccgaaccagaaccttgcaggcactgagtaatgagaagaaagccaagaaggtacgtttctaccgcaatggggaccgctacttcaaggggattgtgtacgctgtgtcctctgaccgttttcgcagctttgacgccttgctggctgacctgacgcgatctctgtctgacaacatcaacctgcctcagggagtgcgttacatttacaccattgatggatccaggaagatcggaagcatggatgaactggaggaaggggaaagctatgtctgttcctcagacaacttctttaaaaaggtggagtacaccaagaatgtcaatcccaactggtctgtcaacgtaaaaacatctgccaatatgaaagccccccagtccttggctagcagcaacagtgcacaggccagggagaacaaggactttgtgcgccccaagctggttaccatcatccgcagtggggtgaagcctcggaaggctgtgcgtgtgcttctgaacaagaagacagcccactcttttgagcaagtcctcactgatatcacagaagccatcaaactggagaccggggttgtcaaaaaactctacactctggatggaaaacaggtaacttgtctccatgatttctttggtgatgatgatgtgtttattgcctgtggtcctgaaaaatttcgctatgctcaggatgatttttctctggatgaaaatgaatgccgagtcatgaagggaaacccatcagccacagctggcccaaaggcatccccaacacctcagaagacttcagccaagagccctggtcctatgcgccgaagcaagtctccagctgactcagcaaacggaacctccagcagccagctctctacccccaagtctaagcagtctcccatctctacgcccaccagtcctggcagcctccggaagcacaaggacctgtacctgcctctgtccttggatgactcggactcgcttggtgattccatgtaaaggaggggagagtgctcagagtccagagtacaaatccaagcctatcattgtagtagggtacttctgctcaagtgtccaacagggctattggtgctttcaagtttttattttgttgttgttgttattttgaaaaacacattgtaatatgttgggtttattttcctgtgatttctcctctgggccactgatccacagttaccaattatgagagatagattgataaccatcctttggggcagcattccagggatgcaaaatgtgctagtccatgacctttcaatggaaagcttaggtgcctgcgttatatttgccctgtctaattttgcccatacagtcttccttctgtagagggctgtttacatatacagcacttaaaatgtttgtgtgggaaaaaaaaaactcattggcagatccaagaatgacaaacacaagtgccccttttctctggatctcaagaatggtggaggaccctggaaggacagcaaggcagctccccagcctcactcttcactcctgattgaggcccgggtttgttgtccagcaccaattctggctgtcaatggggagaaataaaccaacaacttataattgtgacaccagatgcttaggatcctggtgctgggttagctaagagaatagacagaattggaaaatactgcagacatttccgaagagtttataaagcacagtgaattcctggtcaatctctccactgaggcaatttggaatcaataagcaattgataatagtttggagtaagggacttcatatacctgattcctctagaaggctgtctaacataccacatgattacatgaactgtatggtatccatctatctctgttctattgaatgccttgttaacagccaacactgaaaacactgtgagaatttgttttcaggtctgacacctttcagtctctttttatagcaagaaatcaatatcctttttataaaaattcatgtctgtatttcaggagcaaactcttcaggctccttttttataaactggtgatttttcttttgtctaaaaaacacatgaagaaaatttaccaaaaaaaaaaaaaaaagcagaagaa

SEQ ID NO: 8774 - DNA, 1706 bp, Homo sapiens
agaagcgacgctccgcccaccccgacgcggtctctatggtaaccggtcaccgcttctatggagtggcgtttactaccaattgcaaataagaaaattccagattccattccaagatggccaaataggaacagctccagcctgcagctcccagcgtgattaatgtagaagatgggtgatttctgcatttccaactaagctgaaaatggcaaaaacaggagcagaagatcacagagaagcactatctcagtcttccttatccctcttgactgaagcaatggaagtattacagcaaagtagccctgaaggcactttggatgggaatactgtaaacccaatttacaaatatattttgaatgatttaccaagagagtttatgtcatcccaggcaaaagcagttattaaaactactgatgattatttgcagtctcagtttggccccaacagactcgtgcattcagcagcagtatcagaagggtcaggacttcaagattgctccacacatcaaacagcatcagatcacagccatgatgaaatatcagacctagatagctacaaatcaaacagtaaaaacaattcttgttctatatcagcatccaagagaaacagacctgtcagtgctccagtgggtcaactgagggttgcagagttctcttctttaaaatttcagtcagcccggaattggcagaaattgtctcaaagacacaaacttcaaccaagagtgattaaagtaacagcttacaaaaatggatctagaacagtctttgccagagttactgtaccaaccatcaccttgctgctggaggagtgcacagaaaagctgaatctgaacatggccgcaagacgagtgttcttggcagacggcaaggaagccctcgaacctgaagatataccccatgaagccgatgtttatgtttcaacgggagagccctttttaaatccattcaaaaaaattaaagaccatctgttgttaattaagaaagtaacttggacaatgaatgggttgatgcttcctactgatatcaaaagacggaaaaccaagcctgttctttctattagaatgaagaaacttactgagaggacctcagtccgaattctgttctttaagaatggcatggggcaggatgggcatgagattacagtgggaaaagaaacaatgaaaaaggttttagatacttgtacaataagaatgaatctaaatttaccagccagatatttttatgatttgtatggcagaaaaattgaagatatttcaaaaggaaagcactgactctgagacgtgatacttcatggatgccagaggcattcggattcatgactcgtgcttcacgtatcccagaagtgtgctattatcacattttaatgcatgccttgccctctgtttttgcatccttataaaagcttatgccagctgaaattagcctgtgcaaccactaacatgtggaagcattacaagttcactggacttaaaatatttaaagaagctaatcctgttggaggaacttccagtctgtagcaccctagtcacttaacattaggtttttgaacttcttttttctttgtttctatgatgttgtgcatcaaatgattgagatccctaaacttttgtgttggatggttttctgaacttcaacttgggaaaggtcaagttttatgtgaaagttatcttttaatttaaacaaataaatgctgatactcttttgattcga

SEQ ID NO: 8775 - DNA, 3684 bp, Homo sapiens
gaccactgaatgttttctcaatgaaaatgtggaacaactgggggtggtgtggtggtcggaggagggggtgcacaaaaatactatcaactaaaaagggaatccaaatgtctattaaaaataagcatttgattgtaattccagcattcagccacacgatgtcacaattggattttgattttcactgtgtgtttgtctcaatagatgaaggcattttcaaagctggagcagagaggtctgaaacacggggggcagcagaagtccaagaagatgaagatactcaggttgaggttccagtcgatcagaggccagcagaaatagtagacgaggaagaagatggagagaaggcaaacaaggatgcagaacagaaagaagacttttcaggaatgaatggtgaccttgaagaggaaggaggtagggaggctacagatgcccctgagcaagtcgaggagattctggatcacagtgagcagcaggcacgccctgctcgtgtaaatggaggcaccgatgaggagaatggtgaggagctgcagcaggttaataatgagcttcaactggtcctagacaaggaaagaaagtctcaaggagctggcagtggacaagatgaggctgatgtagaccctcaaagaccaccaaggccagaagtaaaaattaccagtccagaagaaaatgaaaacaaccaacaaaacaaggactatgctgccgtggcttagaacatttttaaaaagagagtatatggatcgcaagaaaaatgaagggttatcatacttgaaagataagcacatagttattgctgaatataatgtgacactatggtcgaatactacctacgaattataacattagaagcctagtggaaagaccagataactttaaatggctactaaaggataattacttacttttattgcatgtgttttaaaagtcatatagaaatattaaataagacggacagaggagaatttgcactggaagacaattgccacttgtaaaggatgaaaaataggatcactcttattgtacgctttattataagtttagaaggcagtttattctaaataatttttctctaggaaggcgtagaattttaaagaactggtaataggaaagcatgtactattttcttaaagcaataaactcttgaatgaacagattgcgatttactttcagacataatttggagatggcagtagatcaaaatgtgtccatgacttgttaacatgcctttctttcttcctccttagccaaaatccacctttgaactacaaagacagagcaaggcgttcattttggtgggaggaagcattggttcagagtgttagtgactagtatcgccatgccgtcacttaaatgctttcaggcttgcatgcttgtggctccaatggcgcacactcaggaaggaattgtaaaggagcacccagttatattataaagcctggatgtatggtttgcagataatggaaatcctgtggattttcactgatccagtctatctttaccaatagtatctctctcttctcccttatgttattagagaacctgatattggctattccaaagattaaattattttcaaatagttttcaacaaaaataaaagtgtattaggaagaaaaaagtagactatatgaagagtttgtgactgctcaatttaacttgttttttgccttatttctattaagactgttttactatgtttttgccctagggatatcagcaaatatttatttttcctagcatgatatagttagaatttcaagcagatttctttgtaattagaaggcatctgatagaaattgtaaaactttagaagttattataatgaaaccaattcctgaatcacaacttcatggactgactaaattgatttatagttgccttgtgaggtatgtatggggaaaacataaaaacataattaaaacataatttcgtcctttttatgaattcttaagagatgttcttccataaatatagaaataatatatttttcttaaaggatatatttttaattatgtggaagttgtaagcttgaaattttaacttctagtgcttttctaaaattcacaattacaagtttaaaacattttttctcttccaggtttcatttggaataaagagttggcagttatataaagcacttaataatactatagaaaatagatgtgttttttcttaatatgattttggtattttccacagatcagaagtgtaaacagagagataatgtaacagtatttggaagagataatgacacaaggatatagtgatctgggagcatgaattagaaacagggtactatgtttctggtgtaaaatctaaattgtgctttctactagcgttactttttcaaatgggatgatataaagcactgtgggctataagcaacaatcttgggttggtaggcaaatagaccaattgatctttattattattattattattattattattattttttgagatgaagtcttgctcttgtcgcccaggctgggtgcagtggcatgatcttggcttactgcaacctctgcctcctgggttcaagcacctgagcctcccgagtagctgggattacaggcatctgccaccacacctggctaatttttgtattttttgtagagacagatgtttcaccatgttggccaggctggtctcaaactcctgacctcaggtgatccgcccgcctttgcatcccaaaatgctgggattacaggtgtgagccacagcacccggtcccagttggtcttttaatattaaatttgtgcactattactgggtctggagttaatgatttcaaatagtttctaaaaataactgattaaatgtaagaaattataactaattatcaaggtgattctcttttgtttcttcaatggagagtttctctttctcttttcctcctctaataaaaatatttctttttttcctgtccttttattcattatattatgaaacttaggttttaggaaacaccttaagcgtcattttaatgaagcacaacattgatattttacatgaataataacgtttggtattttaaatatacttcaagggggtaataagccacaataactgtaccaaaaaaacttaaaaatggggacatattcatcccttgtgtgtgcatattttaccacttgttgacaagatacaattgtgacctactttgaggggatgaataacgacttatcactttaagacactttgcaaacatgttactaaaaaaaggtgcctagccaaggaaaaaaccattcacttggaattaaaattgtggatgtcacttcagagatgactttaacataaatgctgaaagttcattcacctcacaaatgtggcagttttctctgtggagaatggtggtctccgtggcagactggctctccaaattaaatgaaactcattgacagacctgggaccttttatgtgagtggacagacaagatcttggtttggcttcatgtactgttttctagagagagtgctacgaaaaacttatgatgcttttatgtgataaccaatataatgctttaatatgttaattctttgtgatgctatatacatagtttttatagttttatgaaaccactttgttaaacttatctggattttaagacacttgtaaacaaatggtttgttagtaaaattggggcattaagagttttacagagcaaataaagaagattttgacaaaagtc

SEQ ID NO: 8776 - DNA, 4707 bp, Homo sapiens
gtccaccttgattctgcccgtagcaggtgaacctggtgtggtgcgcgcactgcgggtcctgattggctgtgcacgccacggtgaaaaacttgagcgtctactccgagtcctgcaagctcctagtgtctcctctgggtggacgcctaggcgcacggccgttacttctctttcacctgtggattcgtcagtttctcgttcgtttcaggaggcgatcccgcgccctgggtgcggtgaggccgctgggacagcggaggtgcctcccgacgcgaagcagcgagctgaggcggcggccagcggggaagatgagcggcagcagcgccaggtccagccacctgtctcagcccgtcgtgaagagcgtgcttgtgtaccgcaacggggaccccttctacgcggggcgccgcgtcgtcatccatgagaagaaggtgtccagcttcgaagtcttcctgaaggaggtgaccggcggcgttcaggcaccctttggggccgtcaggaacatctacaccccgcggactggccaccgaatccggaagctagaccagatccagagcgggggcaattacgtggctggaggccaggaagccttcaagaaactcaattacttggacataggagaaatcaagaaaagaccaatggaagttgttaatacagaggtaaaaccagtaatccatagcaggatcaacgtgtcagctcgctttagaaaaccgcttcaggagccgtgcactatcttcttgattgcaaatggagacctcataaacccagcttctcgcctccttatccccagaaaaaccttgaatcagtgggatcatgtactacaaatggtcacagaaaaaatcactctgaggagcggggctgttcacaggctttatactttagaaggaaaacttgttgagagtggagcagagttggagaatgggcagttttatgtggctgttggcagagataagtttaagaaactgccttacagtgagttactttttgacaagtcaacgatgagaaggccttttggtcagaaagcttcttcactacctcctattgtaggatccagaaagtctaaagggagtggaaatgatcgccactctaagtcaacagttggatccagtgacaactcatctcctcagcccctgaagaggaaagggaaaaaagaagacgtgaattcagaaaaactgacgaaattgaaacaaaatgtaaaattaaagaattcacaagaaaccattccaaatagtgatgaaggcattttcaaagctggagcagagaggtctgaaacacggggggcagcagaagtccaagaagatgaagatactcaggttgaggttccagtcgatcagaggccagcagaaatagtagacgaggaagaagatggagagaaggcaaacaaggatgcagaacagaaagaagacttttcaggaatgaatggtgaccttgaagaggaaggaggtagggaggctacagatgcccctgagcaagtcgaggagattctggatcacagtgagcagcaggcacgccctgctcgtgtaaatggaggcaccgatgaggagaatggtgaggagctgcagcaggttaataatgagcttcaactggtcctagacaaggaaagaaagtctcaaggagctggcagtggacaagatgaggctgatgtagaccctcaaagaccaccaaggccagaagtaaaaattaccagtccagaagaaaatgaaaacaaccaacaaaacaaggactatgctgccgtggcttagaacatttttaaaaagagagtatatggatcgcaagaaaaatgaagggttatcatacttgaaagataagcacatagttattgctgaatataatgtgacactatggtcgaatactacctacgaattataacattagaagcctagtggaaagaccagataactttaaatggctactaaaggataattacttacttttattgcatgtgttttaaaagtcatatagaaatattaaataagacggacagaggagaatttgcactggaagacaattgccacttgtaaaggatgaaaaataggatcactcttattgtacgctttattataagtttagaaggcagtttattctaaataatttttctctaggaaggcgtagaattttaaagaactggtaataggaaagcatgtactattttcttaaagcaataaactcttgaatgaacagattgcgatttactttcagacataatttggagatggcagtagatcaaaatgtgtccatgacttgttaacatgcctttctttcttcctccttagccaaaatccacctttgaactacaaagacagagcaaggcgttcattttggtgggaggaagcattggttcagagtgttagtgactagtatcgccatgccgtcacttaaatgctttcaggcttgcatgcttgtggctccaatggcgcacactcaggaaggaattgtaaaggagcacccagttatattataaagcctggatgtatggtttgcagataatggaaatcctgtggattttcactgatccagtctatctttaccaatagtatctctctcttctcccttatgttattagagaacctgatattggctattccaaagattaaattattttcaaatagttttcaacaaaaataaaagtgtattaggaagaaaaaagtagactatatgaagagtttgtgactgctcaatttaacttgttttttgccttatttctattaagactgttttactatgtttttgccctagggatatcagcaaatatttatttttcctagcatgatatagttagaatttcaagcagatttctttgtaattagaaggcatctgatagaaattgtaaaactttagaagttattataatgaaaccaattcctgaatcacaacttcatggactgactaaattgatttatagttgccttgtgaggtatgtatggggaaaacataaaaacataattaaaacataatttcgtcctttttatgaattcttaagagatgttcttccataaatatagaaataatatatttttcttaaaggatatatttttaattatgtggaagttgtaagcttgaaattttaacttctagtgcttttctaaaattcacaattacaagtttaaaacattttttctcttccaggtttcatttggaataaagagttggcagttatataaagcacttaataatactatagaaaatagatgtgttttttcttaatatgattttggtattttccacagatcagaagtgtaaacagagagataatgtaacagtatttggaagagataatgacacaaggatatagtgatctgggagcatgaattagaaacagggtactatgtttctggtgtaaaatctaaattgtgctttctactagcgttactttttcaaatgggatgatataaagcactgtgggctataagcaacaatcttgggttggtaggcaaatagaccaattgatctttattattattattattattattattattattttttgagatgaagtcttgctcttgtcgcccaggctgggtgcagtggcatgatcttggcttactgcaacctctgcctcctgggttcaagcacctgagcctcccgagtagctgggattacaggcatctgccaccacacctggctaatttttgtattttttgtagagacagatgtttcaccatgttggccaggctggtctcaaactcctgacctcaggtgatccgcccgcctttgcatcccaaaatgctgggattacaggtgtgagccacagcacccggtcccagttggtcttttaatattaaatttgtgcactattactgggtctggagttaatgatttcaaatagtttctaaaaataactgattaaatgtaagaaattataactaattatcaaggtgattctcttttgtttcttcaatggagagtttctctttctcttttcctcctctaataaaaatatttctttttttcctgtccttttattcattatattatgaaacttaggttttaggaaacaccttaagcgtcattttaatgaagcacaacattgatattttacatgaataataacgtttggtattttaaatatacttcaagggggtaataagccacaataactgtaccaaaaaaacttaaaaatggggacatattcatcccttgtgtgtgcatattttaccacttgttgacaagatacaattgtgacctactttgaggggatgaataacgacttatcactttaagacactttgcaaacatgttactaaaaaaaggtgcctagccaaggaaaaaaccattcacttggaattaaaattgtggatgtcacttcagagatgactttaacataaatgctgaaagttcattcacctcacaaatgtggcagttttctctgtggagaatggtggtctccgtggcagactggctctccaaattaaatgaaactcattgacagacctgggaccttttatgtgagtggacagacaagatcttggtttggcttcatgtactgttttctagagagagtgctacgaaaaacttatgatgcttttatgtgataaccaatataatgctttaatatgttaattctttgtgatgctatatacatagtttttatagttttatgaaaccactttgttaaacttatctggattttaagacacttgtaaacaaatggtttgttagtaaaattggggcattaagagttttacagagcaaataaagaagattttgacaaaagtc

SEQ ID NO: 8777 - DNA, 339 bp, Homo sapiens
gcgtcgtcatccatgagaagaaggtgtccagcttcgaagtcttcctgaaggaggtgaccggcggcgttcaggcaccctttggggccgtcaggaacatctacaccccgcggactggccaccgaatccggaagctagaccagatccagagcgggggcaattacgtggctggaggccaggaagccttcaagaaactcaattacttggacataggagaaatcaagaaaagaccaatggaagttgttaatacagagctacatgttctctgattgaaatccatgggaaggttccctgtcaagtgagaagattctgagcgttgttaaataaatctttaccaaagct

SEQ ID NO: 8778 - DNA, 665 bp, Homo sapiens
gtccaccttgattctgcccgtagcaggtgaacctggtgtggtgcgcgcactgcgggtcctgattggctgtgcacgccacggtgaaaaacttgagcgtctactccgagtcctgcaagctcctagtgtctcctctgggtggacgcctaggcgcacggccgttacttctctttcacctgtggattcgtcagtttctcgttcgtttcaggaggcgatcccgcgccctgggtgcggtgaggccgctgggacagcggaggtgcctcccgacgcgaagcagcgagctgaggcggcggccagcggggaagatgagcggcagcagcgccaggtccagccacctgtctcagcccgtcgtgaagagcgtgcttgtgtaccgcaacggggaccccttctacgcggggcgccgcgtcgtcatccatgagaagaaggtgtccagcttcgaagtcttcctgaaggaggtgaccggcggcgttcaggcaccctttggggccgtcaggaacatctacaccccgcggactggccaccgaatccggaagctagaccagatccagagcgggggcaattacgtggctggaggccaggaagccttcaagaaactcaattacttggacataggagaaatcaagaaaagaccaatggaagttgttaatacagagctacatgttctctga

SEQ ID NO: 8779 - DNA, 2347 bp, Homo sapiens
agctttgtgtctctcagtaccatcatggcctctccatgtatctttacagtataccttctgagacctgctgaggatatgactcagcaaatcaccatggtgatgggagaaagccaggttgtgggggcaccagctataacggggtaatacttggaaggcaatttctttctgagaacttgctgcagcctagcttggagtcctggcctggaaagcttgaatatgaaaagtcaggtgggccataaaacatgaaggaaccagtaagccaggccagtggaaacattctagagttgaaaatcctctatggaacaagcttacctacatgtggcctgtccttcccagtggccaacttaatgaggagtttgattggccaatacaaggactgcttgttccgagcagtcctcccatgaagaaacccatctgtaagacaacagagccatatgcccctgtgcgactcagagttttgcagaatggagagaagaataaaaacagatccgttactatccttggtccagatatctcacctggacggaaaacgcagtgcactgagattttaaatttaccttctgcagctcggagattgtacaatgaaaaggggaaggaaatatttgccttaaaagacctgcaaagagatgaactggtgtatgtttcatgtggagaactctggatcaatcctgacctgtccattgctcagcaaaagaaacaaatattcctgaggaacctagaatcagacattgccaaaattcaaatcttctgcagcacacataaaatagaagctcttgttttagaagtccaaagtgacattgtatctggaagcaagcttgctgtgcataaacctgtagcaatttttggagaagagaagcaagttacagaaccggaagaaaagcaaatgcaagaagatcctctaacaacggaaaatgcttccagtgaaattctagattcacacgtaagagctcatcttcgaatgaaggcttgtcacacacttcccaggtatgcctggcaggaaacttcacatgactttgatgaggatgacagtcttccaaagaaaacggaaaaagggctctttgaaaatgtggaaccacagaagaaacacagctgttcaccaaagcatagtaaattgcacaagcattgtcatcagcagttcgaatacagagatgggcagattataagccatgctgctcctcagctagtcttgggggttcaaggtcccaatctccgatcaggcatggaggtggttttggtggagaagaaatctgatggtagtcatcagcgctggatacaccaggaagacagcaggacctttcaccttgtgagtaaccctgaccttgtgctggcagtgtctatgaccaagactagaaatgaagtttgtggctatccagttattgttcagaaatataagccgtacaacaatggagctgccaatcaaaagtggcattacatgaaaaatataaaagcacttgtggcctttcatagcactgccttggataaggaaattacatcagcaaattatgctggtgtctgtacatcatctgtgattaaagaagaaaacattgatcaaccaggatactgttatctctcacctgatggaaagagaaaaactatgctctgcttggcttgtggacaatccatgagaacagagaaaggactgaaacaattgcttccaggggttccattcctctgtatttcaggcaccaagactcagaagcccttcttacaagggcccttcaaggtcatcagtgtggctgaggttgatttgtcgtgtgacaaggctgaaaaaactctaagttactaccaagcacgtctattgtctttacggatgaagacctgcacgcaagctgcatctcacagtggcatggcagccacacaccagaaggcagtgaaaataattgcatacaaaaatggggatgggtatcgtaatgggaagttaattgtggctggaacattccccatgcttcttacagaatgcacggaacaacttgggcttgccagagcagcctccaaagtatataccaaagatggaaccccaatctttaccttgcgtgatttggttttatgggctctagatgaatcctttctccagagagactctgagaaacaaaagcaagatgcagctcctgttggaaaagaacagataattgttgaaaaaaatccaagaatgaaagtgaaaaacagattatttgcaaaatctgtgacatccgatagtttggatggtatagacaagtctttgcttaccctcatcctcagaaatcctattgccatctgggtgtcttgtggtgaaccatttctacctccaaatgaaagcagaaaaattagagaaacagaactggctaaaaaaggacagaattttggctga

SEQ ID NO: 8780 - DNA, 2797 bp, Homo sapiens
agctttgtgtctctcagtaccatcatggcctctccatgtatctttacagtataccttctgagacctgctgaggatatgactcagcaaatcaccatggtgatgggagaaagccaggttgtgggggcaccagctataacggggtaatacttggaaggcaatttctttctgagaacttgctgcagcctagcttggagtcctggcctggaaagcttgaatatgaaaagtcaggtgggccataaaacatgaaggaaccagtaagccaggccagtggaaacattctagagttgaaaatcctctatggaacaagcttacctacatgtggcctgtccttcccagtggccaacttaatgaggagtttgattggccaatacaaggactgcttgttccgagcagtcctcccatgaagaaacccatctgtaagacaacagagccatatgcccctgtgcgactcagagttttgcagaatggagagaagaataaaaacagatccgttactatccttggtccagatatctcacctggacggaaaacgcagtgcactgagattttaaatttaccttctgcagctcggagattgtacaatgaaaaggggaaggaaatatttgccttaaaagacctgcaaagagatgaactggtgtatgtttcatgtggagaactctggatcaatcctgacctgtccattgctcagcaaaagaaacaaatattcctgaggaacctagaatcagacattgccaaaattcaaatcttctgcagcacacataaaatagaagctcttgttttagaagtccaaagtgacattgtatctggaagcaagcttgctgtgcataaacctgtagcaatttttggagaagagaagcaagttacagaaccggaagaaaagcaaatgcaagaagatcctctaacaacggaaaatgcttccagtgaaattctagattcacacgtaagagctcatcttcgaatgaaggcttgtcacacacttcccaggtatgcctggcaggaaacttcacatgactttgatgaggatgacagtcttccaaagaaaacggaaaaagggctctttgaaaatgtggaaccacagaagaaacacagctgttcaccaaagcatagtaaattgcacaagcattgtcatcagcagttcgaatacagagatgggcagattataagccatgctgctcctcagctagtcttgggggttcaaggtcccaatctccgatcaggcatggaggtggttttggtggagaagaaatctgatggtagtcatcagcgctggatacaccaggaagacagcaggacctttcaccttgtgagtaaccctgaccttgtgctggcagtgtctatgaccaagactagaaatgaagtttgtggctatccagttattgttcagaaatataagccgtacaacaatggagctgccaatcaaaagtggcattacatgaaaaatataaaagcacttgtggcctttcatagcactgccttggataaggaaattacatcagcaaattatgctggtgtctgtacatcatctgtgattaaagaagaaaacattgatcaaccaggatactgttatctctcacctgatggaaagagaaaaactatgctctgcttggcttgtggacaatccatgagaacagagaaaggactgaaacaattgcttccaggggttccattcctctgtatttcaggcaccaagactcagaagcccttcttacaagggcccttcaaggtcatcagtgtggctgaggttgatttgtcgtgtgacaaggctgaaaaaactctaagttactaccaagcacgtctattgtctttacggatgaagacctgcacgcaagctgcatctcacagtggcatggcagccacacaccagaaggcagtgaaaataattgcatacaaaaatggggatgggtatcgtaatgggaagttaattgtggctggaacattccccatgcttcttacagaatgcacggaacaacttgggcttgccagagcagcctccaaagtatataccaaagatggaaccccaatctttaccttgcgtgatttggttttatgggctctagatgaatcctttctccagagagactctgagaaacaaaagcaagatgcagctcctgttggaaaagaacagataattgttgaaagtatggaagaaaatccaagaatgaaagtgaaaaacagattatttgcaaaatctgtgacatccgatagtttggatggtatagacaagtctttgcttaccctcatcctcagaaatcctattgccatctgggtgtcttgtggtgaaccatttctacctccaaatgctttgcagaaagcagaaaaattagagaaacagaactggctaaaaaaggacagaattttggctgatctagataccatgagacacaaaatgagacagttaaaagggcggcgagtagcggcatgtcagccagccaccatggttcctaccaagagccctgtgcagcccgtggtggttgaaggaggctggaccgaacagactcaacaggaaattaaactcatggaacttataagacatacagaggcacacctttctgaaatccaagaaatggaatccaaaataaattttccaattgcaaccaaacgtatagcagtcaagccgagcaacctgtataagcagcccaacacaaaacgagtgtggatttatctaaatggaggcagacctgaagatggcacttatgcctggggcaaaactatttcagaggtcagcttactttatctgaagacatggatctttatttggagcaggaaagttttcttctattttttgataactgcttaa

SEQ ID NO: 8781 - DNA, 5703 bp, Homo sapiens
gcacatccctgcactagtggccgcaaccgaggcgccgcgctccagcagctgctgccgcccagcccggccccgccgccgccccccagccctgcagccccgcagccccggccgcgcccagcccggcgaggacagcaccaggaggcggcccccagcgcggccacaaagacccccggcggcgtctctccgcggaccggtcctacttgaagtccatcatgtccttcggcagagacatggagctggagcacttcgacgagcgggataaggcgcagagatacagccgagggtcgcgggtgaacggcctgccgagcccgacgcacagcgcccactgcagcttctaccgcacccgcacgctgcagacgctcagctccgagaagaaggccaagaaagttcgtttctatcgaaacggagatcgatacttcaaagggattgtgtatgccatctccccagaccggttccgatcttttgaggccctgctggctgatttgacccgaactctgtcggataacgtgaatttgccccagggagtgagaacaatctacaccattgatgggctcaagaagatttccagcctggaccaactggtggaaggagagagttatgtatgtggctccatagagcccttcaagaaactggagtacaccaagaatgtgaaccccaactggtcggtgaacgtcaagaccacctcggcttctcgggcagtgtcttcactggccactgccaaaggaagcccttcagaggtgcgagagaataaggatttcattcggcccaagctggtcaccatcatcagaagtggcgtgaagccacggaaagctgtcaggattctgctgaacaagaaaacggctcattcctttgagcaggtcctcaccgatatcaccgatgccatcaagctggactcgggagtggtgaaacgcctgtacacgttggatgggaaacaggtgatgtgccttcaggacttttttggtgatgatgacatttttattgcatgtggaccggagaagttccgttaccaggatgatttcttgctagatgaaagtgaatgtcgagtggtaaagtccacttcttacaccaaaatagcttcatcatcccgcaggagcaccaccaagagcccaggaccgtccaggcgtagcaagtcccctgcctccaccagctcagttaatggaacccctggtagtcagctctctactccgcgctcaggcaagtcgccaagcccatcacccaccagcccaggaagcctgcggaagcagaggagctctcagcatggcggctcctctacgtcacttgcgtccaccaaagtctgcagctcgatggatgagaacgatggccctggagaagaagtgtcggaggaaggcttccagattccagctacaataacagaacgatataaagtcggaagaacaataggagatggaaattttgctgttgtcaaggaatgtgtagaaagatcgactgctagagagtatgctctgaaaattatcaagaaaagcaaatgtcgaggcaaagagcacatgatccagaatgaagtgtctattttaagaagagtgaagcatcccaatatcgttcttctgattgaggagatggatgtgccaactgaactgtatcttgtcatggaattagtaaaggggggagacctttttgatgccattacttccactaacaaatacaccgagagagacgccagtgggatgctgtacaacctagccagcgccatcaaatacctgcatagcctgaacatcgtccaccgtgatatcaagccagagaacctgctggtgtatgagcaccaagatggcagcaaatcactgaagctgggtgactttggactggccaccattgtagacggccccctgtacacagtctgtggcaccccaacatacgtggctccagaaatcattgcagagactggatacggcctcaaggtggacatctgggcagcaggtgtaatcacttatatcctgctgtgtggtttccctccattccgtggaagtggtgatgaccaggaggtgctttttgatcagattttgatggggcaggtggactttccttctccatactgggataatgtttccgattctgcaaaggagctcattaccatgatgctgttggtcgatgtagatcagcgattttctgctgttcaagtacttgagcatccctgggttaatgatgatggcctcccagaaaatgaacatcagctgtcagtagctggaaagataaagaagcatttcaacacaggccccaagccgaatagcacagcagctggagtttctgtcatagcactggaccacgggtttaccatcaagagatcagggtctttggactactaccagcaaccaggaatgtattggataagaccaccgctcttgataaggagaggcaggttttccgacgaagacgcaaccaggatgtgaggagccggtacaaggcgcagccagctcctcccgaactcaactcggaatcggaagactactccccaagctcctccgagactgttcgctcccctaactcgcccttttaataagacccttttactcaaagtcctagcttaaccctttgagactctgagatttttttcccccaaatttgtgtaaaacagtttcatctgatctatctagcgctcaatgcttgaatggcagaactgaaagtgttttcaggtatctttgtagcggtttccctttactgaataagatgacacgtggtgattgtgaagatggtaatttgctgctaatagagtcctcaaagggttaaggccaatttgcaatttttttttaaacttagaagcaatgaatgttttcatcagtcaagctaggatctgcagtatgtaatatagcacttgttaaccctctgagtgcatagaattttattgagaattcttgtttgggaatttttcaggcctttggatgtatacacacatgtttcttgattttactgcagatcaaggggtgttgttagatgctgaaatgtccagaaaagaaggacatttagaatgatatcttgtttgtccttttctgtgggtttagaacgtggcaggtttataacttcgacacacgcacggttctttcttcttcacaatcctattcagaaacagattttttttttcattagagatatgactgtcagttgcagtgagttctgcatcccaagtggagggaattgggtttgtggcaaagagcttgacccaggaaatagatggtgccccccaaattgtctccacatgaagatgtactgatgacgccccagaaatgctgcttccatatcagctgctgctagcgccagcgcagactctcagggagtcaccacagcttgtcttgtgcttggtgagtgagggtctctctactcagtgtcagacatctacaggaaagaaacaactggtggaaaagagcaataaattgcccggtgctctgcagggctggaatttcaaacagaaagagggaataagatcctgtgatttttctcacctgcttttccacgcactgtggtcatcactgtgcaatctacatctagtatgaaatccacacataggagagctggggcacaaggggactggaggcagttgctttgcaagatggctgaggagaaagcacactgggaacacaatccagaatgttctaacaataagttttcagtgaataaaccactggcaagacaattccatgtgcacctttaggttacctatatagtctcctaggaagatcaggatgaaagacctagatgatacccctgaggataaaacctccatcccctaaaatgattttttttaaataccactgtctttagctgtccaggaggtcagagtgttttttctgtctttgggccaagtcctgtctgagacctgtattttcactcttgttaccaaatctatctccctagtgcagtgtctccaggcctgagtttcttctggaacagattccattttagaatggggattcacaggttctgtgcatcaccacagtgctcagagaggattctcctggggtgtcttagaggcaggtgcccaactcaaatgtattcccaaggtttgctgggctctgggatccacgagacaaccagagagggatatctcatgaaatttgcatctggtggctgaacagtacctatgttctctgttttgaatatactttaatacctgagagtcttaaaatttgtgaacaacgtttctatagtcctttattttcaaatgcacattgatcttcacttgctgcatttttactcttcaaccctgaaactatggtctacattaatatggatttttaaatcacatgtcattacttttgcaacaccatcaccaaaattttttgctcttttacatttaggttcatctctgtggtctgtgttgtcctgacatgtaaaaagcatatcgtttattgaggtttttttcccccccttttagagcatccggaagtgataacacgcaaaatcacaaagtagcataaatcagtaaattagttgagttgtttttgggggggaggtgggggtagggggcacagaacaccagaaagagtgttggtgtgtaggtagattccatattaatgaggaacactgaactagttggaaattactgctttctctagaaatataaagcaaagcactattccaaggctatggagtagctctacagcctggcctcaactctaaaagtgtgaagaatgcaatgggcagagacctacctgcagtggactgtcattttcctttctttctctgaattactgctttttctgtgggcattaactatattgctacagcatctagtgtactgagcctgcggtgcatggctcaggccttttcccatcgacgtctagggggactctggaccgtgtgaagctagggggtgtttctcagcacactgcagaagggcagctcagaagaatgcagggcccattcagcatggggatcccagcacatcactgtagaatttgagtgatctatgctgaataaacagtggaatgtgaccagtcaagtagaaatcttgagtaatcagatggaatgcaatctttctaacattaagctaccaagatcctgaatgtcagagatgtactcagagggttaacagacaagcacaaggcatgctgactacattggtgtatccagattgctttgcttttagccagtgctttctaatttttttctcgacattcttgggatagttcaagtttgaaataattaagtggtggtgttctttaaggaatttctataaccaaattgatcttatttttgatttcacttatcatagaacaaatatgtatcattatggcagtgtatctatgtaattatcaatttaatcatcaccaccggtgtttccatattttttcccaagtatttaatatagctctcttatggtggtggcctggtgatggggaccgtctttcttttactgacacatgaccaatcatatggtattttcaagggaattttaagattcatcttttcagtttgatagtagactagttaaggaagaactctttcattacttgcatcgtgtaaatcatctctgtagacatgtgttcatattaatgaacacattttttctcaacattgtagcagaaatcattttattcgtcatgatcaatgaatatgtgatttgctccagatcgttagaaggaaaagtaagatttcagtcatcaaaaatgtttttaccgtagccctcatctaacttacacgtggtgcatattaaaataagcagagaaaaaaaaatgtgaataaactactgaaaac

SEQ ID NO: 8782 - DNA, 5629 bp, Homo sapiens
gcacatccctgcactagtggccgcaaccgaggcgccgcgctccagcagctgctgccgcccagcccggccccgccgccgccccccagccctgcagccccgcagccccggccgcgcccagcccggcgaggacagcaccaggaggcggcccccagcgcggccacaaagacccccggcggcgtctctccgcggaccggtcctacttgaagtccatcatgtccttcggcagagacatggagctggagcacttcgacgagcgggataaggcgcagagatacagccgagggtcgcgggtgaacggcctgccgagcccgacgcacagcgcccactgcagcttctaccgcacccgcacgctgcagacgctcagctccgagaagaaggccaagaaagttcgtttctatcgaaacggagatcgatacttcaaagggattgtgtatgccatctccccagaccggttccgatcttttgaggccctgctggctgatttgacccgaactctgtcggataacgtgaatttgccccagggagtgagaacaatctacaccattgatgggctcaagaagatttccagcctggaccaactggtggaaggagagagttatgtatgtggctccatagagcccttcaagaaactggagtacaccaagaatgtgaaccccaactggtcggtgaacgtcaagaccacctcggcttctcgggcagtgtcttcactggccactgccaaaggaagcccttcagaggtgcgagagaataaggatttcattcggcccaagctggtcaccatcatcagaagtggcgtgaagccacggaaagctgtcaggattctgctgaacaagaaaacggctcattcctttgagcaggtcctcaccgatatcaccgatgccatcaagctggactcgggagtggtgaaacgcctgtacacgttggatgggaaacaggtgatgtgccttcaggacttttttggtgatgatgacatttttattgcatgtggaccggagaagttccgttaccaggatgatttcttgctagatgaaagtgaatgtcgagtggtaaagtccacttcttacaccaaaatagcttcatcatcccgcaggagcaccaccaagagcccaggaccgtccaggcgtagcaagtcccctgcctccaccagctcagttaatggaacccctggtagtcagctctctactccgcgctcaggcaagtcgccaagcccatcacccaccagcccaggaagcctgcggaagcagaggagctctcagcatggcggctcctctacgtcacttgcgtccaccaaagtctgcagctcgatggatgagaacgatggccctggagaagaagtgtcggaggaaggcttccagattccagctacaataacagaacgatataaagtcggaagaacaataggagatggaaattttgctgttgtcaaggaatgtgtagaaagatcgactgctagagagtatgctctgaaaattatcaagaaaagcaaatgtcgaggcaaagagcacatgatccagaatgaagtgtctattttaagaagagtgaagcatcccaatatcgttcttctgattgaggagatggatgtgccaactgaactgtatcttgtcatggaattagtaaaggggggagacctttttgatgccattacttccactaacaaatacaccgagagagacgccagtgggatgctgtacaacctagccagcgccatcaaatacctgcatagcctgaacatcgtccaccgtgatatcaagccagagaacctgctggtgtatgagcaccaagatggcagcaaatcactgaagctgggtgactttggactggccaccattgtagacggccccctgtacacagtctgtggcaccccaacatacgtggctccagaaatcattgcagagactggatacggcctcaaggtggacatctgggcagcaggtgtaatcacttatatcctgctgtgtggtttccctccattccgtggaagtggtgatgaccaggaggtgctttttgatcagattttgatggggcaggtggactttccttctccatactgggataatgtttccgattctgcaaaggagctcattaccatgatgctgttggtcgatgtagatcagcgattttctgctgttcaagtacttgagcatccctgggttaatgatgatggcctcccagaaaatgaacatcagctgtcagtagctggaaagataaagaagcatttcaacacaggccccaagccgaatagcacagcagctggagtttctgtcatagcaaccaccgctcttgataaggagaggcaggttttccgacgaagacgcaaccaggatgtgaggagccggtacaaggcgcagccagctcctcccgaactcaactcggaatcggaagactactccccaagctcctccgagactgttcgctcccctaactcgcccttttaataagacccttttactcaaagtcctagcttaaccctttgagactctgagatttttttcccccaaatttgtgtaaaacagtttcatctgatctatctagcgctcaatgcttgaatggcagaactgaaagtgttttcaggtatctttgtagcggtttccctttactgaataagatgacacgtggtgattgtgaagatggtaatttgctgctaatagagtcctcaaagggttaaggccaatttgcaatttttttttaaacttagaagcaatgaatgttttcatcagtcaagctaggatctgcagtatgtaatatagcacttgttaaccctctgagtgcatagaattttattgagaattcttgtttgggaatttttcaggcctttggatgtatacacacatgtttcttgattttactgcagatcaaggggtgttgttagatgctgaaatgtccagaaaagaaggacatttagaatgatatcttgtttgtccttttctgtgggtttagaacgtggcaggtttataacttcgacacacgcacggttctttcttcttcacaatcctattcagaaacagattttttttttcattagagatatgactgtcagttgcagtgagttctgcatcccaagtggagggaattgggtttgtggcaaagagcttgacccaggaaatagatggtgccccccaaattgtctccacatgaagatgtactgatgacgccccagaaatgctgcttccatatcagctgctgctagcgccagcgcagactctcagggagtcaccacagcttgtcttgtgcttggtgagtgagggtctctctactcagtgtcagacatctacaggaaagaaacaactggtggaaaagagcaataaattgcccggtgctctgcagggctggaatttcaaacagaaagagggaataagatcctgtgatttttctcacctgcttttccacgcactgtggtcatcactgtgcaatctacatctagtatgaaatccacacataggagagctggggcacaaggggactggaggcagttgctttgcaagatggctgaggagaaagcacactgggaacacaatccagaatgttctaacaataagttttcagtgaataaaccactggcaagacaattccatgtgcacctttaggttacctatatagtctcctaggaagatcaggatgaaagacctagatgatacccctgaggataaaacctccatcccctaaaatgattttttttaaataccactgtctttagctgtccaggaggtcagagtgttttttctgtctttgggccaagtcctgtctgagacctgtattttcactcttgttaccaaatctatctccctagtgcagtgtctccaggcctgagtttcttctggaacagattccattttagaatggggattcacaggttctgtgcatcaccacagtgctcagagaggattctcctggggtgtcttagaggcaggtgcccaactcaaatgtattcccaaggtttgctgggctctgggatccacgagacaaccagagagggatatctcatgaaatttgcatctggtggctgaacagtacctatgttctctgttttgaatatactttaatacctgagagtcttaaaatttgtgaacaacgtttctatagtcctttattttcaaatgcacattgatcttcacttgctgcatttttactcttcaaccctgaaactatggtctacattaatatggatttttaaatcacatgtcattacttttgcaacaccatcaccaaaattttttgctcttttacatttaggttcatctctgtggtctgtgttgtcctgacatgtaaaaagcatatcgtttattgaggtttttttcccccccttttagagcatccggaagtgataacacgcaaaatcacaaagtagcataaatcagtaaattagttgagttgtttttgggggggaggtgggggtagggggcacagaacaccagaaagagtgttggtgtgtaggtagattccatattaatgaggaacactgaactagttggaaattactgctttctctagaaatataaagcaaagcactattccaaggctatggagtagctctacagcctggcctcaactctaaaagtgtgaagaatgcaatgggcagagacctacctgcagtggactgtcattttcctttctttctctgaattactgctttttctgtgggcattaactatattgctacagcatctagtgtactgagcctgcggtgcatggctcaggccttttcccatcgacgtctagggggactctggaccgtgtgaagctagggggtgtttctcagcacactgcagaagggcagctcagaagaatgcagggcccattcagcatggggatcccagcacatcactgtagaatttgagtgatctatgctgaataaacagtggaatgtgaccagtcaagtagaaatcttgagtaatcagatggaatgcaatctttctaacattaagctaccaagatcctgaatgtcagagatgtactcagagggttaacagacaagcacaaggcatgctgactacattggtgtatccagattgctttgcttttagccagtgctttctaatttttttctcgacattcttgggatagttcaagtttgaaataattaagtggtggtgttctttaaggaatttctataaccaaattgatcttatttttgatttcacttatcatagaacaaatatgtatcattatggcagtgtatctatgtaattatcaatttaatcatcaccaccggtgtttccatattttttcccaagtatttaatatagctctcttatggtggtggcctggtgatggggaccgtctttcttttactgacacatgaccaatcatatggtattttcaagggaattttaagattcatcttttcagtttgatagtagactagttaaggaagaactctttcattacttgcatcgtgtaaatcatctctgtagacatgtgttcatattaatgaacacattttttctcaacattgtagcagaaatcattttattcgtcatgatcaatgaatatgtgatttgctccagatcgttagaaggaaaagtaagatttcagtcatcaaaaatgtttttaccgtagccctcatctaacttacacgtggtgcatattaaaataagcagagaaaaaaaaatgtgaataaactactgaaaac

SEQ ID NO: 8783 - DNA, 2101 bp, Homo sapiens
gcacatccctgcactagtggccgcaaccgaggcgccgcgctccagcagctgctgccgcccagcccggccccgccgccgccccccagccctgcagccccgcagccccggccgcgcccagcccggcgaggacagcaccaggaggcggcccccagcgcggccacaaagacccccggcggcgtctctccgcggaccggtcctacttgaagtccatcatgtccttcggcagagacatggagctggagcacttcgacgagcgggataaggcgcagagatacagccgagggtcgcgggtgaacggcctgccgagcccgacgcacagcgcccactgcagcttctaccgcacccgcacgctgcagacgctcagctccgagaagaaggccaagaaagttcgtttctatcgaaacggagatcgatacttcaaagggattgtgtatgccatctccccagaccggttccgatcttttgaggccctgctggctgatttgacccgaactctgtcggataacgtgaatttgccccagggagtgagaacaatctacaccattgatgggctcaagaagatttccagcctggaccaactggtggaaggagagagttatgtatgtggctccatagagcccttcaagaaactggagtacaccaagaatgtgaaccccaactggtcggtgaacgtcaagaccacctcggcttctcgggcagtgtcttcactggccactgccaaaggaagcccttcagaggtgcgagagaataaggatttcattcggcccaagctggtcaccatcatcagaagtggcgtgaagccacggaaagctgtcaggattctgctgaacaagaaaacggctcattcctttgagcaggtcctcaccgatatcaccgatgccatcaagctggactcgggagtggtgaaacgcctgtacacgttggatgggaaacaggtgatgtgccttcaggacttttttggtgatgatgacatttttattgcatgtggaccggagaagttccgttaccaggatgatttcttgctagatgaaagtgaatgtcgagtggtaaagtccacttcttacaccaaaatagcttcatcatcccgcaggagcaccaccaagagcccaggaccgtccaggcgtagcaagtcccctgcctccaccagctcagttaatggaacccctggtagtcagctctctactccgcgctcaggcaagtcgccaagcccatcacccaccagcccaggaagcctgcggaagcagagggacctgtaccgccccctctcttcggatgacttggattcagtaggagactcagtgtaaaagaaacaatggagcaatgtatatggtttgtgattgggtgaaggtttcacatttctgaagcaaaagtcttacagcaaaatacacaaaagagttttgcataccttgaaatgataaaagaccaaatcatccaaaagtaaatatgtatgcattttgttttcgtgatgttcaaccttgaaattgagagatttttaaaaatatctcccacatggatttgattggggagagtttgaacacaaaatgctgagatttttgtacagggcctggctctagatgaatttcatacacggacccaatattgagtacaagaacacactaaccatgtggcaatatagagccagaatttctgcagatggagttttcttcttaattataagtagacatagagatataatttttctgtactttctgtaaagcatattaaaacggcactagcaggcatattttttctaaaggttatattgtttttaaaatttgaattgcttggtttttagaggtacttttattacaaaataataaaaatacttgggtagattttttttctccctagacagtagaaaaagctacttactgttttgtgggttagtacatccgagagaaaaagaaaaattatgacaacgacacatctcataaagactctgaagttaggctttaggaacttgccttgtttttgttgtcaagtaaattttattttttaaagttattttattagaaacagtataaatttagcttaagctatatgccaatatgaagaacttggccaatggcattgctatagattgtataattttttcttacaa

SEQ ID NO: 8784 - DNA, 4610 bp, Homo sapiens
agccttagccatccttaaactcatccaaccgattcccatttccgcgggtgcttggcttagtgctgagacgggattccgccgttggtattcaggtccaacactaagactgtgtccatgttagaactcatagaagttaatggaacccctggtagtcagctctctactccgcgctcaggcaagtcgccaagcccatcacccaccagcccaggaagcctgcggaagcagaggagctctcagcatggcggctcctctacgtcacttgcgtccaccaaagtctgcagctcgatggatgagaacgatggccctggagaagaagtgtcggaggaaggcttccagattccagctacaataacagaacgatataaagtcggaagaacaataggagatggaaattttgctgttgtcaaggaatgtgtagaaagatcgactgctagagagtatgctctgaaaattatcaagaaaagcaaatgtcgaggcaaagagcacatgatccagaatgaagtgtctattttaagaagagtgaagcatcccaatatcgttcttctgattgaggagatggatgtgccaactgaactgtatcttgtcatggaattagtaaaggggggagacctttttgatgccattacttccactaacaaatacaccgagagagacgccagtgggatgctgtacaacctagccagcgccatcaaatacctgcatagcctgaacatcgtccaccgtgatatcaagccagagaacctgctggtgtatgagcaccaagatggcagcaaatcactgaagctgggtgactttggactggccaccattgtagacggccccctgtacacagtctgtggcaccccaacatacgtggctccagaaatcattgcagagactggatacggcctcaaggtggacatctgggcagcaggtgtaatcacttatatcctgctgtgtggtttccctccattccgtggaagtggtgatgaccaggaggtgctttttgatcagattttgatggggcaggtggactttccttctccatactgggataatgtttccgattctgcaaaggagctcattaccatgatgctgttggtcgatgtagatcagcgattttctgctgttcaagtacttgagcatccctgggttaatgatgatggcctcccagaaaatgaacatcagctgtcagtagctggaaagataaagaagcatttcaacacaggccccaagccgaatagcacagcagctggagtttctgtcatagcaaccaccgctcttgataaggagaggcaggttttccgacgaagacgcaaccaggatgtgaggagccggtacaaggcgcagccagctcctcccgaactcaactcggaatcggaagactactccccaagctcctccgagactgttcgctcccctaactcgcccttttaataagacccttttactcaaagtcctagcttaaccctttgagactctgagatttttttcccccaaatttgtgtaaaacagtttcatctgatctatctagcgctcaatgcttgaatggcagaactgaaagtgttttcaggtatctttgtagcggtttccctttactgaataagatgacacgtggtgattgtgaagatggtaatttgctgctaatagagtcctcaaagggttaaggccaatttgcaatttttttttaaacttagaagcaatgaatgttttcatcagtcaagctaggatctgcagtatgtaatatagcacttgttaaccctctgagtgcatagaattttattgagaattcttgtttgggaatttttcaggcctttggatgtatacacacatgtttcttgattttactgcagatcaaggggtgttgttagatgctgaaatgtccagaaaagaaggacatttagaatgatatcttgtttgtccttttctgtgggtttagaacgtggcaggtttataacttcgacacacgcacggttctttcttcttcacaatcctattcagaaacagattttttttttcattagagatatgactgtcagttgcagtgagttctgcatcccaagtggagggaattgggtttgtggcaaagagcttgacccaggaaatagatggtgccccccaaattgtctccacatgaagatgtactgatgacgccccagaaatgctgcttccatatcagctgctgctagcgccagcgcagactctcagggagtcaccacagcttgtcttgtgcttggtgagtgagggtctctctactcagtgtcagacatctacaggaaagaaacaactggtggaaaagagcaataaattgcccggtgctctgcagggctggaatttcaaacagaaagagggaataagatcctgtgatttttctcacctgcttttccacgcactgtggtcatcactgtgcaatctacatctagtatgaaatccacacataggagagctggggcacaaggggactggaggcagttgctttgcaagatggctgaggagaaagcacactgggaacacaatccagaatgttctaacaataagttttcagtgaataaaccactggcaagacaattccatgtgcacctttaggttacctatatagtctcctaggaagatcaggatgaaagacctagatgatacccctgaggataaaacctccatcccctaaaatgattttttttaaataccactgtctttagctgtccaggaggtcagagtgttttttctgtctttgggccaagtcctgtctgagacctgtattttcactcttgttaccaaatctatctccctagtgcagtgtctccaggcctgagtttcttctggaacagattccattttagaatggggattcacaggttctgtgcatcaccacagtgctcagagaggattctcctggggtgtcttagaggcaggtgcccaactcaaatgtattcccaaggtttgctgggctctgggatccacgagacaaccagagagggatatctcatgaaatttgcatctggtggctgaacagtacctatgttctctgttttgaatatactttaatacctgagagtcttaaaatttgtgaacaacgtttctatagtcctttattttcaaatgcacattgatcttcacttgctgcatttttactcttcaaccctgaaactatggtctacattaatatggatttttaaatcacatgtcattacttttgcaacaccatcaccaaaattttttgctcttttacatttaggttcatctctgtggtctgtgttgtcctgacatgtaaaaagcatatcgtttattgaggtttttttcccccccttttagagcatccggaagtgataacacgcaaaatcacaaagtagcataaatcagtaaattagttgagttgtttttgggggggaggtgggggtagggggcacagaacaccagaaagagtgttggtgtgtaggtagattccatattaatgaggaacactgaactagttggaaattactgctttctctagaaatataaagcaaagcactattccaaggctatggagtagctctacagcctggcctcaactctaaaagtgtgaagaatgcaatgggcagagacctacctgcagtggactgtcattttcctttctttctctgaattactgctttttctgtgggcattaactatattgctacagcatctagtgtactgagcctgcggtgcatggctcaggccttttcccatcgacgtctagggggactctggaccgtgtgaagctagggggtgtttctcagcacactgcagaagggcagctcagaagaatgcagggcccattcagcatggggatcccagcacatcactgtagaatttgagtgatctatgctgaataaacagtggaatgtgaccagtcaagtagaaatcttgagtaatcagatggaatgcaatctttctaacattaagctaccaagatcctgaatgtcagagatgtactcagagggttaacagacaagcacaaggcatgctgactacattggtgtatccagattgctttgcttttagccagtgctttctaatttttttctcgacattcttgggatagttcaagtttgaaataattaagtggtggtgttctttaaggaatttctataaccaaattgatcttatttttgatttcacttatcatagaacaaatatgtatcattatggcagtgtatctatgtaattatcaatttaatcatcaccaccggtgtttccatattttttcccaagtatttaatatagctctcttatggtggtggcctggtgatggggaccgtctttcttttactgacacatgaccaatcatatggtattttcaagggaattttaagattcatcttttcagtttgatagtagactagttaaggaagaactctttcattacttgcatcgtgtaaatcatctctgtagacatgtgttcatattaatgaacacattttttctcaacattgtagcagaaatcattttattcgtcatgatcaatgaatatgtgatttgctccagatcgttagaaggaaaagtaagatttcagtcatcaaaaatgtttttaccgtagccctcatctaacttacacgtggtgcatattaaaataagcagagaaaaaaaaatgtgaataaactactgaaaac

SEQ ID NO: 8785 - DNA, 6923 bp, Homo sapiens
ctttctctgattaaatttaatggaacccctggtagtcagctctctactccgcgctcaggcaagtcgccaagcccatcacccaccagcccaggaagcctgcggaagcagaggagctctcagcatggcggctcctctacgtcacttgcgtccaccaaagtctgcagctcgatggatgagaacgatggccctggagaagaagtgtcggaggaaggcttccagattccagctacaataacagaacgatataaagtcggaagaacaataggagatggaaattttgctgttgtcaaggaatgtgtagaaagatcgactgctagagagtatgctctgaaaattatcaagaaaagcaaatgtcgaggcaaagagcacatgatccagaatgaagtgtctattttaagaagagtgaagcatcccaatatcgttcttctgattgaggagatggatgtgccaactgaactgtatcttgtcatggaattagtaaaggggggagacctttttgatgccattacttccactaacaaatacaccgagagagacgccagtgggatgctgtacaacctagccagcgccatcaaatacctgcatagcctgaacatcgtccaccgtgatatcaagccagagaacctgctggtgtatgagcaccaagatggcagcaaatcactgaagctgggtgactttggactggccaccattgtagacggccccctgtacacagtctgtggcaccccaacatacgtggctccagaaatcattgcagagactggatacggcctcaaggtggacatctgggcagcaggtgtaatcacttatatcctgctgtgtggtttccctccattccgtggaagtggtgatgaccaggaggtgctttttgatcagattttgatggggcaggtggactttccttctccatactgggataatgtttccgattctgcaaaggagctcattaccatgatgctgttggtcgatgtagatcagcgattttctgctgttcaagtacttgagcatccctgggttaatgatgatggcctcccagaaaatgaacatcagctgtcagtagctggaaagataaagaagcatttcaacacaggccccaagccgaatagcacagcagctggagtttctgtcatagcactggaccacgggtttaccatcaagagatcagggtctttggactactaccagcaaccaggaatgtattggataagaccaccgctcttgataaggagaggcaggttttccgacgaagacgcaaccaggatgtgaggagccggtacaaggcgcagccagctcctcccgaactcaactcggaatcggaagactactccccaagctcctccgagactgttcgctcccctaactcgcccttttaataagacccttttactcaaagtcctagcttaaccctttgagactctgagatttttttcccccaaatttgtgtaaaacagtttcatctgatctatctagcgctcaatgcttgaatggcagaactgaaagtgttttcaggtatctttgtagcggtttccctttactgaataagatgacacgtggtgattgtgaagatggtaatttgctgctaatagagtcctcaaagggttaaggccaatttgcaatttttttttaaacttagaagcaatgaatgttttcatcagtcaagctaggatctgcagtatgtaatatagcacttgttaaccctctgagtgcatagaattttattgagaattcttgtttgggaatttttcaggcctttggatgtatacacacatgtttcttgattttactgcagatcaaggggtgttgttagatgctgaaatgtccagaaaagaaggacatttagaatgatatcttgtttgtccttttctgtgggtttagaacgtggcaggtttataacttcgacacacgcacggttctttcttcttcacaatcctattcagaaacagattttttttttcattagagatatgactgtcagttgcagtgagttctgcatcccaagtggagggaattgggtttgtggcaaagagcttgacccaggaaatagatggtgccccccaaattgtctccacatgaagatgtactgatgacgccccagaaatgctgcttccatatcagctgctgctagcgccagcgcagactctcagggagtcaccacagcttgtcttgtgcttggtgagtgagggtctctctactcagtgtcagacatctacaggaaagaaacaactggtggaaaagagcaataaattgcccggtgctctgcagggctggaatttcaaacagaaagagggaataagatcctgtgatttttctcacctgcttttccacgcactgtggtcatcactgtgcaatctacatctagtatgaaatccacacataggagagctggggcacaaggggactggaggcagttgctttgcaagatggctgaggagaaagcacactgggaacacaatccagaatgttctaacaataagttttcagtgaataaaccactggcaagacaattccatgtgcacctttaggttacctatatagtctcctaggaagatcaggatgaaagacctagatgatacccctgaggataaaacctccatcccctaaaatgattttttttaaataccactgtctttagctgtccaggaggtcagagtgttttttctgtctttgggccaagtcctgtctgagacctgtattttcactcttgttaccaaatctatctccctagtgcagtgtctccaggcctgagtttcttctggaacagattccattttagaatggggattcacaggttctgtgcatcaccacagtgctcagagaggattctcctggggtgtcttagaggcaggtgcccaactcaaatgtattcccaaggtttgctgggctctgggatccacgagacaaccagagagggatatctcatgaaatttgcatctggtggctgaacagtacctatgttctctgttttgaatatactttaatacctgagagtcttaaaatttgtgaacaacgtttctatagtcctttattttcaaatgcacattgatcttcacttgctgcatttttactcttcaaccctgaaactatggtctacattaatatggatttttaaatcacatgtcattacttttgcaacaccatcaccaaaattttttgctcttttacatttaggttcatctctgtggtctgtgttgtcctgacatgtaaaaagcatatcgtttattgaggtttttttcccccccttttagagcatccggaagtgataacacgcaaaatcacaaagtagcataaatcagtaaattagttgagttgtttttgggggggaggtgggggtagggggcacagaacaccagaaagagtgttggtgtgtaggtagattccatattaatgaggaacactgaactagttggaaattactgctttctctagaaatataaagcaaagcactattccaaggctatggagtagctctacagcctggcctcaactctaaaagtgtgaagaatgcaatgggcagagacctacctgcagtggactgtcattttcctttctttctctgaattactgctttttctgtgggcattaactatattgctacagcatctagtgtactgagcctgcggtgcatggctcaggccttttcccatcgacgtctagggggactctggaccgtgtgaagctagggggtgtttctcagcacactgcagaagggcagctcagaagaatgcagggcccattcagcatggggatcccagcacatcactgtagaatttgagtgatctatgctgaataaacagtggaatgtgaccagtcaagtagaaatcttgagtaatcagatggaatgcaatctttctaacattaagctaccaagatcctgaatgtcagagatgtactcagagggttaacagacaagcacaaggcatgctgactacattggtgtatccagattgctttgcttttagccagtgctttctaatttttttctcgacattcttgggatagttcaagtttgaaataattaagtggtggtgttctttaaggaatttctataaccaaattgatcttatttttgatttcacttatcatagaacaaatatgtatcattatggcagtgtatctatgtaattatcaatttaatcatcaccaccggtgtttccatattttttcccaagtatttaatatagctctcttatggtggtggcctggtgatggggaccgtctttcttttactgacacatgaccaatcatatggtattttcaagggaattttaagattcatcttttcagtttgatagtagactagttaaggaagaactctttcattacttgcatcgtgtaaatcatctctgtagacatgtgttcatattaatgaacacattttttctcaacattgtagcagaaatcattttattcgtcatgatcaatgaatatgtgatttgctccagatcgttagaaggaaaagtaagatttcagtcatcaaaaatgtttttaccgtagccctcatctaacttacacgtggtgcatattaaaataagcagagaaaaaaaaatgtgaataaactactgaaaacacttggtgttttgtgttcaatgagaccttcctgcaacctgctccccatgggtggcagttaacaggcccatcagatattgttgaaagaaagcaatatatccatgaatgaaggctaaaattgcaatcctttaccctttgaggcatatttcagttgaaaacaaaaagaaaagaaaatttggcttagagggtcacagagctcccatatgaccaagtctcaagcacattaaatcatggttgtttactggccaagggcgtccactagacaactctatcccttgcgctgaagctcaatcgtgctgagggagagctttcttaatattactgtgttgctcttagcccttctctgggttaggatctgtcagcatttctatgataaactcctattctcaaaggtttttaatttgaccataaaaatgtgccccaggctgaagtttgctatacagggctgtaccaaagagtgaaggtttacttccttctctttccaacttcttccccattctccaaggaaaagaacaacaaaaaaatctggtatggtccctccttaatagtgatttcagaattttggaaagcaccaagatccaagatggtagttttaatgtagttactcattcgcacacattttttaaatttaatgggtcacctggcatatattgtagataacatatcttttctataatttgtaagtcaataatttttttaactgctacatgatatttttttttgcccaaagattttaaaagacttgaagttggtcagttcaaaactcagatttttctacacattgtctgccatgtccattaggagtttggggaaaatactctcacacagacccttactttgcatgcagtttagagggtaagatacgtgcttcttttggggataaagatttccttacttaattgtcaaatttcatggagccattctagtctgttggggaaaatagtgattaaaagcacttccaaaattaacattttttgacaattcagatatgaaaagaagcaggggaaaataatacactttactcttttcttgcttaaaggcaaacaaatcaatgaaacttgaggacacactaaacatttgataactgcaaatgtgctttaaaaattggttcaatggtgcttacacatgaaacggtaacaaatggggttcctaggacgtcagaaggaatctttagtttgtatgtaattacacactagaggaggaggtgcttttaagccagtcttttatttttaatcatctcaaatatgcaaccatacatgcagtaacattaagggtcgtaaactggtgggaaacaggaacttcagtggagaggcttaaatgcctctggttagagtgggggtttttgtttgtttgtttattgttgggtttcaacactgagcatcatttctgtgatcaagtttctaactggcatgtgttttgatcatgaggtttaccatatcttgcccatacagacaaatgagagatctagtttcattttgttccctaaagaaagaacactctctaaaattaaatcatacctgtaaatttcttcagcatttgtttctgttcaatgaaattgagacccttaatgttgctttaatgtaaaattgaatattttgtctgtgatatactttaataatttaaagtaagtaatagttctaaagtcttcactgttgctactaagagaaaatagaattttaaaggtgatgataaagatgctataatgtcagttcactccagtccaatcaaatgtagtaagaaaaagtccttgaatagttctctagggacaatttctcacttgccattgacattaatctttggtgtattctcagaaaaaataaaaagaaattgaaactggtccaaggttatagtcatatcctcgataacttttgaaaaaaaattttattaggaaattaatactagcctttttcattctggctgaaagaaaattattaaaggattagttgagtgtgaaattcaacagtattttgctcatacatactaaaaaggtgcgtagggacttggcgcatttaaacaagtttctgaaaggtttcaatttgactcaagaaaaaaattcaatatttcttttgaaaatactgaatttatcacttgctgcatggatcagatggcataggttaatctttgattttcagaatcctaatgaaataactttcaaacaatttgtgtccttaattaaaggtggaatgagatccaatttttccccctaatccttcagtttaagctgatacatgtaggttaatgtggaatgaaatcatctgtgatatattatgttcatttatcaactgagcttttttgatgttgcctgtttttatgtaaaacatgttcttaaagttaataaaataatagtacttggtgta

SEQ ID NO: 8786 - DNA, 2337 bp, Homo sapiens
gcatttcaatgaggacgggccgaggcacatccctgcactagtggccgcaaccgaggcgccgcgctccagcagctgctgccgcccagcccggccccgccgccgccccccagccctgcagccccgcagccccggccgcgcccagcccggcgaggacagcaccaggaggcggcccccagcgcggccacaaagacccccggcggcgtctctccgcggaccggtcctacttgaagtccatcatgtccttcggcagagacatggagctggagcacttcgacgagcgggataaggcgcagagatacagccgagggtcgcgggtgaacggcctgccgagcccgacgcacagcgcccactgcagcttctaccgcacccgcacgctgcagacgctcagctccgagaagaaggccaagaaagttcgtttctatcgaaacggagatcgatacttcaaagggattgtgtatgccatctccccagaccggttccgatcttttgaggccctgctggctgatttgacccgaactctgtcggataacgtgaatttgccccagggagtgagaacaatctacaccattgatgggctcaagaagatttccagcctggaccaactggtggaaggagagagttatgtatgtggctccatagagcccttcaagaaactggagtacaccaagaatgtgaaccccaactggtcggtgaacgtcaagaccacctcggcttctcgggcagtgtcttcactggccactgccaaaggaagcccttcagaggtgcgagagaataaggatttcattcggcccaagctggtcaccatcatcagaagtggcgtgaagccacggaaagctgtcaggattctgctgaacaagaaaacggctcattcctttgagcaggtcctcaccgatatcaccgatgccatcaagctggactcgggagtggtgaaacgcctgtacacgttggatgggaaacaggtgatgtgccttcaggacttttttggtgatgatgacatttttattgcatgtggaccggagaagttccgttaccaggatgatttcttgctagatgaaagtgaatgtcgagtggtaaagtccacttcttacaccaaaatagcttcatcatcccgcaggagcaccaccaagagcccaggaccgtccaggcgtagcaagtcccctgcctccaccagctcagttaatggaacccctggtagtcagctctctactccgcgctcaggcaagtcgccaagcccatcacccaccagcccaggaagcctgcggaagcagaggagctctcagcatggcggctcctctacgtcacttgcgtccaccaaagtctgcagctcgatggatgagaacgatggccctggagaagaagtgtcggaggaaggcttccagattccagctacaataacagaacgatataaagtcggaagaacaataggagatggaaattttgctgttgtcaaggaatgtgtagaaagatcgactgctagagagtatgctctgaaaattatcaagaaaagcaaatgtcgaggcaaagagcacatgatccagaatgaagtgtctattttaagaagagtgaagcatcccaatatcgttcttctgattgaggagatggatgtgccaactgaactgtatcttgtcatggaattagtaaaggggggagacctttttgatgccattacttccactaacaaatacctgcatagcctgaacatcgtccaccgtgatatcaagccagagaacctgctggtgtatgagcaccaagatggcagcaaatcactgaagctgggtgactttggactggccaccattgtagacggccccctgtacacagtctgtggcaccccaacatacgtggctccagaaatcattgcagagactggatacggcctcaaggtggacatctgggcagcaggtgtaatcacttatatcctgctgtgtggtttccctccattccgtggaagtggtgatgaccaggaggtgctttttgatcagattttgatggggcaggtggactttccttctccatactgggataatgtttccgattctgcaaaggagctcattaccatgatggcctcccagaaaatgaacatcagctgtcagtagctggaaagataaagaagcatttcaacacaggccccaagccgaatagcacagcagctggagtttctgtcatagcagcccctgctagaccaccgctcttgataaggagaggcaggttttccgacgaagacgcaaccaggatgtgaggagccggtacaaggcgcagccagctcctcccgaactcaactcggaatcggaagactactccccaagctcctccgagactgttcgctcccctaactcg

SEQ ID NO: 8787 - DNA, 4265 bp, Homo sapiens
ccgcggtttggcatccccggggccgggaagcctcctccagcgctgacagcctgtcggcggcggagggaggccagagcgcggatgcttgccagtgggccgggcctgaccgctgcgtgggaggcgggctgcattatttcccgctagggccgcgctccagggaaggaaggggccagacacggccctctcagccccgaacggcgcgcgctgcccggcgggcgggatccgggcgcggccgaggcggcggcgctgcaccccgggcctgggcccgcgcgactcccccgggggcctctcccacgctccgcgccccgccccacccttccttccttcctcccctcggcgctcccgggagcgctcggcagacgcccgagctttgtgggcgcccgcgggcccagcgcgagcctcgggcggcccaactttgcctctcccggtcggctcccgagcgggacttgtgaggcgtggccgggtggaggaggcgcttgcgggggcgtggggctccccggcaggcgggaggcacggagcaagtcgcactggacaatgacctgggcagctcggcgctgcggacacttttagctgagggcgcgggcgggtcggctcctccgcggctcctcggccccacctgcgcggagagggcgggatgccagagccaggtgtcccggcgcgttaagggccctcgcagtcagacgtccctgcaccggcgctcgcacccttagtcggcccggaacgtctttttgcggacgccctcggagcagccgcgatggccagcaccaggagtatcgagctggagcactttgaggaacgggacaaaaggccgcggccggggtcgcggagaggggcccccagctcctccgggggcagcagcagctcgggccccaaggggaacgggctcatccccagtccggcgcacagtgcccactgcagcttctaccgcacgcggaccctgcaggccctcagctcggagaagaaggccaagaaggcgcgcttctaccggaacggggaccgctacttcaagggcctggtgtttgccatctccagcgaccgcttccggtccttcgatgcgctcctcatagagctcacccgctccctgtcggacaacgtgaacctgccccagggtgtccgcactatctacaccatcgacggcagccggaaggtcaccagcctggacgagctgctggaaggtgagagttacgtgtgtgcatccaatgaaccatttcgtaaagtcgattacaccaaaaatattaatccaaactggtctgtgaacatcaagggtgggacatcccgagcgctggctgctgcctcctctgtgaaaagtgaagtaaaagaaagtaaagatttcatcaaacccaagttagtgactgtgattcgaagtggagtgaagcctagaaaagccgtgcggatccttctgaataaaaagactgctcattcctttgaacaagtcttaacagatatcaccgaagccattaaactagactcaggagtcgtcaagaggctctgcaccctggatggaaagcaggttacttgtctgcaagacttttttggtgatgacgatgtttttattgcatgtggaccagaaaaatttcgttatgcccaagatgactttgtcctggatcatagtgaatgtcgtgtcctgaagtcatcttattctcgatcctcagctgttaagtattctggatccaaaagccctgggccctctcgacgcagcaaatcaccagcttcagttaatggaactcccagcagccaactttctactcctaaatctacgaaatcctccagttcctctccaactagtccaggaagtttcagaggattaaagcagatttctgctcatggcagatcttcttccaatgtaaacggtggacctgagcttgaccgttgcataagtcctgaaggtgtgaatggaaacagatgctctgaatcatcaactcttcttgagaaatacaaaattggaaaggtcattggtgatggcaattttgcagtagtcaaagagtgtatagacaggtccactggaaaggagtttgccctaaagattatagacaaagccaaatgttgtggaaaggaacacctgattgagaatgaagtgtcaatactgcgccgagtgaaacatcccaatatcattatgctggtcgaggagatggaaacagcaactgagctctttctggtgatggaattggtcaaaggtggagatctctttgatgcaattacttcgtcgaccaagtacactgagagagatggcagtgccatggtgtacaacttagccaatgccctcaggtatctccatggcctcagcatcgtgcacagagacatcaaaccagagaatctcttggtgtgtgaatatcctgatggaaccaagtctttgaaactgggagactttgggcttgcgactgtggtagaaggccctttatacacagtctgtggcacacccacttatgtggctccagaaatcattgctgaaactggctatggcctgaaggtggacatttgggcagctggtgtgatcacatacatacttctctgtggattcccaccattccgaagtgagaacaatctccaggaagatctcttcgaccagatcttggctgggaagctggagtttccggccccctactgggataacatcacggactctgccaaggaattaatcagtcaaatgcttcaggtaaatgttgaagctcggtgtaccgcgggacaaatcctgagtcacccctgggtgtcagatgatgcctcccaggagaataacatgcaagctgaggtgacaggtaaactaaaacagcactttaataatgcgctccccaaacagaacagcactaccaccggggtctccgtcatcatgaacacggctctagataaggaggggcagattttctgcagcaagcactgtcaagacagcggcaggcctgggatggagcccatctctccagttcctccctcagtggaggagatccctgtgcctggggaagcagtcccggcccccacccctccggaatctcccaccccccaccctcctcccgctgccccgggtggtgagcgggcaggaacctggcgccgccaccgagactgagcctcctgcagacgggcgaagccgcctgctgcagcccaggaagccagccctctgctcggcctcgccggcctccctgctgcaggcctccctctcttcaccgcctgcgcctgagttcgcgggtcctccgcaggccgcctgggaaccggagcctggcgtgccggagcctggcctggtgctctgggctctgccttctggttcctggaggcatcaaaggctgcatccgttctgccaacagctgttcggagagactcgttccagatcatcccgtcattttcagtttgttggacattttacagcttcaccaggagaatgtgcaactttattccagcattcgatgcatttttatagaaacactttggaaacactttggatgaaccaaggccttttccttatttaagtagactcagaacactccctttcttttcttttctctctctctctctcttttttttttacgaaagacttagaattgcatttgtccttttgtgggtgtcctgtgagaggtgatatgggggctaagaggactggctttctaatagaagaagtgagcgcctgagaggacaatttggtcattggacacggattgcaggctttgagaagcgctcagaggcccagggcggcgggctcagccattcggcttggggcaccaggctccccagagacaatgctcagtattcattcatacacagacgatggaagaagccacttcttccctgggcggtgtgggtttcccccagctcttcccacacgtgtgttaggaaatgcccgtgaacttgccctctgggctttttaatgagaggcttggcgcatgcggcacccagcggctgcttccctgcaagccagcgacttgccgagcagaatgagctctgctcctgagccccggtagctgcttcctcatctgcatttcatctggagcagggcaggtaaccacaggaggaggcatgcccgaggcagccaggactgggcgggaaggtgctccctggatatactctgtgaaccttctggaaggctgctggcagtttttcctttttgtccaccaccctgctctttttaataattgtacataatccgtgtatttgttttacctgctcatcttctaaactggcgagccctatagttcgttctcattgttagattttgccttttacaagtgtccccaacctgcaataaacttttccctcttgaaaaaaagtaatcagggatgggcaaa

SEQ ID NO: 8788 - DNA, 3543 bp, Homo sapiens
atggccagcaccaggagtatcgagctggagcactttgaggaacgggacaaaaggccgcggccggggtcgcggagaggggcccccagctcctccgggggcagcagcagctcgggccccaaggggaacgggctcatccccagtccggcgcacagtgcccactgcagcttctaccgcacgcggaccctgcaggccctcagctcggagaagaaggccaagaaggcgcgcttctaccggaacggggaccgctacttcaagggcctggtgtttgccatctccagcgaccgcttccggtccttcgatgcgctcctcatagagctcacccgctccctgtcggacaacgtgaacctgccccagggtgtccgcactatctacaccatcgacggcagccggaaggtcaccagcctggacgagctgctggaaggtgagagttacgtgtgtgcatccaatgaaccatttcgtaaagtcgattacaccaaaaatattaatccaaactggtctgtgaacatcaagggtgggacatcccgagcgctggctgctgcctcctctgtgaaaagtgaagtaaaagaaagtaaagatttcatcaaacccaagttagtgactgtgattcgaagtggagtgaagcctagaaaagccgtgcggatccttctgaataaaaagactgctcattcctttgaacaagtcttaacagatatcaccgaagccattaaactagactcaggagtcgtcaagaggctctgcaccctggatggaaagcaggttacttgtctgcaagacttttttggtgatgacgatgtttttattgcatgtggaccagaaaaatttcgttatgcccaagatgactttgtcctggatcatagtgaatgtcgtgtcctgaagtcatcttattctcgatcctcagctgttaagtattctggatccaaaagccctgggccctctcgacgcagcaaatcaccagcttcagtaaagcggggtggccactactccagtgcctattctacagccaaatccccagttaatggaactcccagcagccaactttctactcctaaatctacgaaatcctccagttcctctccaactagtccaggaagtttcagaggattaaagcagatttctgctcatggcagatcttcttccaatgtaaacggtggacctgagcttgaccgttgcataagtcctgaaggtgtgaatggaaacagatgctctgaatcatcaactcttcttgagaaatacaaaattggaaaggtcattggtgatggcaattttgcagtagtcaaagagtgtatagacaggtccactggaaaggagtttgccctaaagattatagacaaagccaaatgttgtggaaaggaacacctgattgagaatgaagtgtcaatactgcgccgagtgaaacatcccaatatcattatgctggtcgaggagatggaaacagcaactgagctctttctggtgatggaattggtcaaaggtggagatctctttgatgcaattacttcgtcgaccaagtacactgagagagatggcagtgccatggtgtacaacttagccaatgccctcaggtatctccatggcctcagcatcgtgcacagagacatcaaaccagagaatctcttggtgtgtgaatatcctgatggaaccaagtctttgaaactgggagactttgggcttgcgactgtggtagaaggccctttatacacagtctgtggcacacccacttatgtggctccagaaatcattgctgaaactggctatggcctgaaggtggacatttgggcagctggtgtgatcacatacatacttctctgtggattcccaccattccgaagtgagaacaatctccaggaagatctcttcgaccagatcttggctgggaagctggagtttccggccccctactgggataacatcacggactctgccaaggaattaatcagtcaaatgcttcaggtaaatgttgaagctcggtgtaccgcgggacaaatcctgagtcacccctgggtgtcagatgatgcctcccaggagaataacatgcaagctgaggtgacaggtaaactaaaacagcactttaataatgcgctccccaaacagaacagcactaccaccggggtctccgtcatcatgaacacggctctagataaggaggggcagattttctgcagcaagcactgtcaagacagcggcaggcctgggatggagcccatctctccagttcctccctcagtggaggagatccctgtgcctggggaagcagtcccggcccccacccctccggaatctcccaccccccaccctcctcccgctgccccgggtggtgagcgggcaggaacctggcgccgccaccgagactgagcctcctgcagacgggcgaagccgcctgctgcagcccaggaagccagccctctgctcggcctcgccggcctccctgctgcaggcctccctctcttcaccgcctgcgcctgagttcgcgggtcctccgcaggccgcctgggaaccggagcctggcgtgccggagcctggcctggtgctctgggctctgccttctggttcctggaggcatcaaaggctgcatccgttctgccaacagctgttcggagagactcgttccagatcatcccgtcattttcagtttgttggacattttacagcttcaccaggagaatgtgcaactttattccagcattcgatgcatttttatagaaacactttggaaacactttggatgaaccaaggccttttccttatttaagtagactcagaacactccctttcttttcttttctctctctctctctcttttttttttacgaaagacttagaattgcatttgtccttttgtgggtgtcctgtgagaggtgatatgggggctaagaggactggctttctaatagaagaagtgagcgcctgagaggacaatttggtcattggacacggattgcaggctttgagaagcgctcagaggcccagggcggcgggctcagccattcggcttggggcaccaggctccccagagacaatgctcagtattcattcatacacagacgatggaagaagccacttcttccctgggcggtgtgggtttcccccagctcttcccacacgtgtgttaggaaatgcccgtgaacttgccctctgggctttttaatgagaggcttggcgcatgcggcacccagcggctgcttccctgcaagccagcgacttgccgagcagaatgagctctgctcctgagccccggtagctgcttcctcatctgcatttcatctggagcagggcaggtaaccacaggaggaggcatgcccgaggcagccaggactgggcgggaaggtgctccctggatatactctgtgaaccttctggaaggctgctggcagtttttcctttttgtccaccaccctgctctttttaataattgtacataatccgtgtatttgttttacctgctcatcttctaaactggcgagccctatagttcgttctcattgttagattttgccttttacaagtgtccccaacctgcaataaacttttccctcttgaaaaaaa

SEQ ID NO: 8789 - DNA, 2298 bp, Homo sapiens
atggccagcaccaggagtatcgagctggagcactttgaggaacgggacaaaaggccgcggccggggtcgcggagaggggcccccagctcctccgggggcagcagcagctcgggccccaaggggaacgggctcatccccagtccggcgcacagtgcccactgcagcttctaccgcacgcggaccctgcaggccctcagctcggagaagaaggccaagaaggcgcgcttctaccggaacggggaccgctacttcaagggcctggtgtttgccatctccagcgaccgcttccggtccttcgatgcgctcctcatagagctcacccgctccctgtcggacaacgtgaacctgccccagggtgtccgcactatctacaccatcgacggcagccggaaggtcaccagcctggacgagctgctggaaggtgagagttacgtgtgtgcatccaatgaaccatttcgtaaagtcgattacaccaaaaatattaatccaaactggtctgtgaacatcaagggtgggacatcccgagcgctggctgctgcctcctctgtgaaaagtgaagtaaaagaaagtaaagatttcatcaaacccaagttagtgactgtgattcgaagtggagtgaagcctagaaaagccgtgcggatccttctgaataaaaagactgctcattcctttgaacaagtcttaacagatatcaccgaagccattaaactagactcaggagtcgtcaagaggctctgcaccctggatggaaagcaggttacttgtctgcaagacttttttggtgatgacgatgtttttattgcatgtggaccagaaaaatttcgttatgcccaagatgactttgtcctggatcatagtgaatgtcgtgtcctgaagtcatcttattctcgatcctcagctgttaagtattctggatccaaaagccctgggccctctcgacgcagcaaatcaccagcttcagttaatggaactcccagcagccaactttctactcctaaatctacgaaatcctccagttcctctccaactagtccaggaagtttcagaggattaaagatttctgctcatggcagatcttcttccaatgtaaacggtggacctgagcttgaccgttgcataagtcctgaaggtgtgaatggaaacagatgctctgaatcatcaactcttcttgagaaatacaaaattggaaaggtcattggtgatggcaattttgcagtagtcaaagagtgtatagacaggtccactggaaaggagtttgccctaaagattatagacaaagccaaatgttgtggaaaggaacacctgattgagaatgaagtgtcaatactgcgccgagtgaaacatcccaatatcattatgctggtcgaggagatggaaacagcaactgagctctttctggtgatggaattggtcaaaggtggagatctctttgatgcaattacttcgtcgaccaagtacactgagagagatggcagtgccatggtgtacaacttagccaatgccctcaggtatctccatggcctcagcatcgtgcacagagacatcaaaccagagaatctcttggtgtgtgaatatcctgatggaaccaagtctttgaaactgggagactttgggcttgcgactgtggtagaaggccctttatacacagtctgtggcacacccacttatgtggctccagaaatcattgctgaaactggctatggcctgaaggtggacatttgggcagctggtgtgatcacatacatacttctctgtggattcccaccattccgaagtgagaacaatctccaggaagatctcttcgaccagatcttggctgggaagctggagtttccggccccctactgggataacatcacggactctgccaaggaattaatcagtcaaatgcttcaggtaaatgttgaagctcggtgtaccgcgggacaaatcctgagtcacccctgggtgtcagatgatgcctcccaggagaataacatgcaagctgaggtgacaggtaaactaaaacagcactttaataatgcgctccccaaacagaacagcactaccaccggggtctccgtcatcatgaacacggctctagataaggaggggcagattttctgcagcaagcactgtcaagacagcggcaggcctgggatggagcccatctctccagttcctccctcagtggaggagatccctgtgcctggggaagcagtcccggcccccacccctccggaatctcccaccccccaccctcctcccgctgccccgggtggtgagcgggcaggaacctggcgccgccaccgagactga

SEQ ID NO: 8790 - DNA, 5344 bp, Homo sapiens
gactcttgttggtgtttcatgggcagcaaaactggccctttttatctcagctgtagatccttgaaggacagcaaggcctatgtgaccattctctaaaatatttaagctcgagaatcacagagcggaagctgcaaggctcctggctgcctgccagccgagggaatctggagaaaccattcctggggccgcgtggccccgtcgtgcccttgttctgccctcggaatggccttcactcagcacatcctgagaacagccctctgaagcccagggtcgtgaccgtagtgaagctgggtgggcagcgcccccgaaagatcactctgctcctcaacaggcgatcagtgcagacgttcgagcagctcttagctgacatctcagaagccttgggctctcccagatggaagaatgaccgtgtgaggaaactgtttaacctcaagggcagggaaatcaggagcgtctctgatttcttcagggaaggggatgctttcatagctatgggcaaagaaccactgacactgaagagcattcaggtggctgtagaagaactgtaccccaacaaagcccgggccctgacactggcccagcacagccgtgccccttctccaaggctgaggagcaggctgtttagcaaggctctgaaaggagaccaccgctgtggggagaccgagacccccaagagctgcagcgaagttgcaggatgcaaggcagccatgaggcaccaggggaagatccccgaggagctttcactagatgacagagcgaggacccagaagaagtgggggagggggaaatgggagccagaacccagtagcaagccccccagggaagccactctggaagagaggcacgcaaggggagagaagcatcttggggtggagattgaaaagacctcgggtgaaattatcagatgcgagaagtgcaagagagagagggagctccagcagagcctggagcgtgagaggctttctctggggaccagtgagctggatatggggaagggcccaatgtatgatgtggagaagctggtgaggaccagaagctgcaggaggtctcccgaggcaaatcctgcaagtggggaggaagggtggaagggtgacagccacaggagcagccccaggaatcccactcaagagctgaggagacccagcaagagcatggacaagaaagaggacagaggcccagaggatcaagaaagccatgctcagggagcagccaaggccaagaaggaccttgtggaagttcttcctgtcacagaggaggggctgagggaggtgaagaaggacaccaggcccatgagcaggagcaaacatggtggctggctcctgagagagcaccaggcgggctttgagaagctccgcaggacccgaggagaagagaaggaggcagagaaggagaaaaagccatgtatgtctggaggcagaaggatgactctcagagatgaccaacctgcaaagctagaaaaggagcccaagacgaggccagaagagaacaagccagagcggcccagcggtcggaagccacggcccatgggcatcattgccgccaatgtggaaaagcattatgagactggccgggtcattggggatgggaactttgctgtcgtgaaggagtgcagacaccgcgagaccaggcaggcctatgcgatgaagatcattgacaagtccagactcaagggcaaggaggacatggtggacagtgagatcttgatcatccagagcctctctcaccccaacatcgtgaaattgcatgaagtctacgaaacagacatggaaatctacctgatcctggagtacgtgcagggaggagacctttttgacgccatcatagaaagtgtgaagttcccggagcccgatgctgccctcatgatcatggacttatgcaaagccctcgtccacatgcacgacaagagcattgtccaccgggacctcaagccggaaaaccttttggttcagcgaaatgaggacaaatctactaccttgaaattggctgattttggacttgcaaagcatgtggtgagacctatatttactgtgtgtgggaccccaacttacgtagctcccgaaattctttctgagaaaggttatggactggaggtggacatgtgggctgctggcgtgatcctctatatcctgctgtgtggctttcccccattccgcagccctgagagggaccaggacgagctctttaacatcatccagctgggccactttgagttcctccccccttactgggacaatatctctgatgctgctaaagatctggtgagccggttgctggtggtagaccccaaaaagcgctacacagctcatcaggttcttcagcacccctggatcgaaacagctggcaagaccaatacagtgaaacgacagaagcaggtgtcccccagcagcgagggtcacttccggagccagcacaagagggttgtggagcaggtatcatagtcaccaccttgggaatctgtccagcccccagttctgctcaaggacagagaaaaggatagaagtttgagagaaaaacaatgaaagaggcttcttcacataattggtgaatcagagggagagacactgagtatattttaaagcatattaaaaaaattaagtcaatgttaaatgtcacaacatatttttagatttgtatatttaaagcctttaatacatttttggggggtaagcattgtcatcagtgaggaattttggtaataatgatgtgttttgcttcccctttgtaaccaagtttattctgtactacaggagtggtgcttaccagggtctaaactccccctgtgagattaataaggtgcattgtggtctttctgtgttaataaaatgtgctctgaataacagaagtgggcctgtattctgattacttctttgtgctggtgatgacagcacaaaaattcaaaaatgaattatagttcaggcatatctcctgaagctgatatgactacatatagatgtgaaggacacttgattagttgacaagacctgtttatttaggatgcactaatcttggtctcttgcatttcagtcttaccaaaaatcagttttggtgcagtctgagacatggaaagaaaaaaaacaaaccattgaatcattcttgctcctgcaataccgttatactgcttttcagccccaattatccctgagcctgagtcatttctatgtgaagtcaggcgctcaggctgtgaccgtgttaacattttcagatcacgagggagccatttagtacattaatatgtcagaaatgcagtaaatggattacactggggctcgaaggagctcagagttcaagcacattcctacctgcagggcatacacccaggacacattccagatttctgtgctgaaatattggtctttgcagatgattctgggagtctgtgtgagctgacagcaagacatatcctaatatttcccaaattgaccttcctagattatgaatgacctggttagtaggccacaaaatctagtcaagagtgtggctttttcacgtctaccttccctaacagttttggagccatctgggcggaggcgtgtgttagttaggaaaaccggaatagtactagagaattcaacataaggaattgcttaatcaggttttggaaaatggaagaagcacaaaggaggctctggtataatttagagatagtaactgcaggaagtggctcctgttctttggagaaccaagggaagaagttggggttattagaacctattgaaggagaaatttcttgtagtggacactgtagtatgccactcaggtcctccaagactgaagggaataagctccttggggtgctgctggatgatggctctcagctttcagccctctacaggaattaccctccactggaagagacacctttcagctccctcctgaagcaggctatatcaaatgactagtccctgtagggtatggtggctcagctcctttgtcccaaacagggacaatactgaagggccatccaactacggacctgcccatgggggttggctgaactgttggttgagactgcatcatagcccactttctcccttgcccaatcctgcttctttcctttcccttccagaggtaatgatcctgagaccactccctaataagccttttggatgctaatctggattttagagttggcttctcgggaaaccaaaccgttgacaccccctagaaacttgaaaccacatcaaagaagtaccagctggtgctttaacctcagaagcttggagaaggggccctgtggagcagggactcagacccctgaggagtgggtgctgcccagcaggcagtgtaatgggactcattctgaacacgtgaaagaggctggaagctggattcagttgctactagaacatattttgataaagacaccagtaaccttcatttcactaaatccaaaagagaattttcaatcctcaaattagcatcacttgaccctattgaccactttctctttgaataatttctcctgttgactaccatgatgtcacatttttctggtttttttttctcctatacctttggatctcttgtatagattcagtcttcttccagttgctaaaagctgtagttgcatccttagtggctagggaaatgcaaattaaaatcacaatgaaatatcactatacacccattagaatagctaaaattaaatggctaaaatgagaagactgaccttaccaactactagcgaggatgcagagtgactggaacttcccgtacattgctgctgggagtataaaatgggacttctcctttggagaatggtttggtagttcctttaaaagttaaacatgtacctaccatatgatattccacttctagatgtttacccagcagaaattcaagcatatgtcctatgaagacttcacaatatttataggtgctttatttgtagtagccccaaagtggaaacatcttgaatgggcatgatttggtgcatggataaacagattgtatatccacacaatgaataacagccacaaaaaagggatgaactattcatacacgaacaacatggatggactgccaaagaattaggctgaatgaaagaagaaaaaaaagactacattttgattatttcatttacatactattccagaaaatacaagtgaatctatagtgacagaaagtgatcagggggtttgctggagatggaaatggggagaggagggacagaaggattgcaagggaacacttggtaactttggggaagagggacgtgttcattttcttgaatgtaataatggatttatgggggtatatatgtcaaaacttaccaaattgtacacttttgttatgtgcagtttattgtgtgtcaattatacctcaataaagttgttaaaaatat

SEQ ID NO: 8791 - DNA, 2222 bp, Homo sapiens
cctcgccactccagctgcgcctccggctgcagcgcacacgtctcctgcgcctcctcctccggagcgtcgctgtccgtcgggttcatccctcgcagcagtctccaggcgagagagggggccagagtgctcgcacttctcctaggggcaccatgcccaacgacgaggcattcagcaagccctctacaccgtcggaagcccctcacgcccccggggtaccgccgcagggcagagccgggggctttggcaaagcgtctggggcgctagtgggggcggccagcggctcgagcgccgggggcagcagcagaggaggcggctccggctccggggcgtcggacctgggtgccgggagcaagaagtccccgcggctgcccaagtgcgcacgctgcaggaaccacggctacgcctcgccgctcaagggccacaagcgcttctgcatgtggcgcgactgccagtgcaagaagtgcaacctgatcgccgagaggcagcgcgtgatggccgcgcaggtggccctgagaaggcagcaggcccaggaggaggaattgggtatcagccaccccatcccactgcccagtgcggccgagctgcttgtcaaaagagagaacaatggcagtaacccgtgcctcatgactgagtgcagtggcacctctcagccaccgccggccagtgtccccaccactgcagcttcagagggacgtatggtcatccaggatattcctgctgtcaccagcagagggcatgtggagaacacacctgacctggtttcagactccacctactacagcagcttctaccagccgtctctgtttccttattacaacaatctatacaactgcccgcagtactccatggccttggctgctgattctgcttctggggaggtgggaaatcccctcgggggatcccctgtgaagaacagccttcggggcctccccggaccttatgtgcctggtcagacaggaaaccagtggcagatgaagaacatggagaaccgccatgcaatgagctcccagtacaggatgcattcttactacccgcctccctcttacctgggccagagcgtgccccagttcttcacttttgaggatgctccctcttacccggaagccagggcgagcgtattctcgccgcccagcagtcaagattctggcttggtttccctctcgagcagctctcctattagtaacaagagcacaaaggcagtgcttgaatgtgagcctgcgtcggagcccagcagcttcacagtcactcccgtcatcgaggaggacgagtgagcagtgcctgctgccgatggcggttcacttggagtaacaggcttattccactttccatggggtttgttaatattttgcattgactcatactatcttaactgttgagaacgtatttggtttatattccttagagtttagtccagaggctgtaacacatttgtaatactttagggtccgtgactaccatctgcatggtttaagtgctttactcacggagtttaaataatagtgttcatttttttaatgacactggtttcatgtagttttcaagaaataaaagaattcattcaagtgaagccatttgtgtgcctctaaatgagtcatctaattagatgttacttttagttttaaaatgaaatcttaggtgccttaggggttttttttttttttaagtattttttaaaaacctgcaaagatataaatttagccaagttacctgacgggtgagaagaaaagagcaggcaaaattagtgatttttttagaagtctgctaaatggatatattgtgtgtgttgctgttggaaatagccccaccccatcctcccaatccaaaacgtaactgaaatataatcagaaacattaaagcctgtaaaaaaaaattgctgcgtttttggtaaagggtgtaatttgtaaacagtgcaatttaaagtgaccttagtgatgcagagttcctgagtggtgtttgtagaatgagtttatcatacattctttctactactggaaaaaaatggatgcagtctggactgttgtaaccttaggttgtaatctgatttggaaataagtacatctttaaaagttgctacagatttgagttcatgattttgttaaaaattgctatggagtactttgttatataacagaagccatcctgaaatgaaactagtctaaaaaaattcattgttctacttagttgcagctgtacctgaaataaaaatgttattgatgactgaa

SEQ ID NO: 8792 - DNA, 692 bp, Homo sapiens
cctcgccactccagctgcgcctccggctgcagcgcacacgtctcctgcgcctcctcctccggagcgtcgctgtccgtcgggttcatccctcgcagcagtctccaggcgagagagggggccagagtgctcgcacttctcctaggggcaccatgcccaacgacgaggcattcagcaagccctctacaccgtcggaagcccctcacgcccccggggtaccgccgcagggcagagccgggggctttggcaaagcgtctggggcgctagtgggggcggccagcggctcgagcgccgggggcagcagcagaggaggcggctccggctccggggcgtcggacctgggtgccgggagcaagaagtccccgcggctgcccaagtgcgcacgctgcaggaaccacggctacgcctcgccgctcaagggccacaagcgcttctgcatgtggcgcgactgccagtgcaagaagtgcaacctgatcgccgagaggcagcgcgtgatggccgcgcaggtgggtgcgggcgtgcgggagcccgggttcagccttagttttttttttttttttttttttagatggagtctcgctcggttgcccaggctgcagtgtagtggcgcgatcttggctcactgcaactccgcttcccgggttcaagcaattctcctgcctcagcctcccaagtagctgggactacaggcgcac

SEQ ID NO: 8793 - DNA, 2459 bp, Homo sapiens
atggccgacccgcaggctggctccgcggccggggactgggagatcgatgtcgagagcctggagctggaagaggacgtctgcggggcgccgcggtccacgccccccgggcccagcccgccgccggcggacggggactgcgaggacgacgaagatgacgacggggtggacgaagacgcggaagaagagggcgacggcgaggaggcaggcgcgtcccccgggatgcccggccagccggagcagcgggggggaccgcagccgaggccgccgctcgcgcctcaggcctcacccgccggcaccggtccccgagagcgctgcactcccgcgggcggcggcgcggagccgcgcaagctgagccgcacgcccaagtgcgcgcgctgccgcaaccacggcgtggtgtcctgcctgaagggccacaagcgcttctgtcgctggcgcgactgccagtgcgccaactgcctgctggtggtggagcggcagcgcgtcatggccgcccaggtggcgctccggaggcagcaggccaccgaggacaagaaggggctttccgggaaacagaataatttcgagcgcaaagctgtgtaccagaggcaagtcagagcccccagtttgctggccaaaagcattttagaagttctccttggattattctacagctattatgtgtacataatgaaccatctttagaaaataaaagtgacatcagctctaggtatagatatattttttaataatgaaaaaagatgacatggataataataaaacattgattgatacaagataaatagtcttgtctcttaatgcgtagggggcctgggaagaatattaaaattttaatcaataaagtatgtctgttgaagcaagcaagcaaacaaatccataacaaccacaacaagcaacaagaacaagaacaacaacaagaagaagttgcagtatggatatctttcaccctcccaggaaactctttcaaacctaatctgtacttttgcatctgtataaaaatatcagtgagatggaactgtaaataattgttctgctgatctgtagtgttgctgttaccttctgggtttccacatttttattccgtagatgttaatctctttcatgtgcaatctttgcttcttgtaggctatcgccccattccagcggagacttatgtaggagggaccttccctctacctcccccagttagtgacaggatgaggaaaagaagagcctttgctgataaagagttggagaacattatgctggagagagaatataaagaaagggagatgttggaaacttctcaagctgctgctctgtttctgcccaaccgcatggtgcctggacctgactacaattcctacaaaagtgcctacagccccagcccagtggaaccaccaagcaaggacttctgtaattttttgcccacctgccttgatttaaccatgcagtattcagggtctgggaatatggaactaatttcttctaatgtcagcgtggccacaacttatagacagtatcccttgtcctcaagatttttagtttggcccaagtgtggccccattagcgacaccctcctctaccagcaatgcctgctaaatgccaccacctcagttcaagccctgaagcctggggccagctgggacttgaagggagcacgagtccaggatggactcagtgcagagcaggacatgatgccatcgaaattggaaggttccctggtgctgcctcacactcctgagatccagaccacgagaagtgaccttcagggtcatcaggctgtcccagagaggtccgcgttctccccaccccgacggaatttctctcccattgttgacacggactccctggcagctcaagggcatgtcttaacgaagatcagcaaagaaaacaccaggcaccctctgccacttagacataatccattccactcattattccagcaaacacttactgacaaatcgggtcctgagttgaaaacaccatttgtcaaagaggcctttgaagagacccctaagaaacacagagagtgtttagttaaggacaaccagaagtacacatttacaatagatagatgtgcaaaagacctttttgtagccaaacaagttggaacaaaactctcggtgaatgaaccactgtcattttctgttgagtctattcttaagaggccttcatctgccatcactcgtgtctctcagtgaaaggctgcttaaacagaaagctggattttctgcagtcttagagcattatagccatttgctactttttttaaaagttaagatgtttgtgtaaagaaatttctaatgtaaagatgatgattttgaaaaattttatatattcctaatatgcatgtactttttcttatcacatatatttaaacttacagatggaaattgcccaatgtgcaaattgttaagtaccacactttacacagcatttcaaaaagcaataaaattgacactgtcttctcaaagacccaa

SEQ ID NO: 8794 - DNA, 2163 bp, Homo sapiens
tgggttcgttccgggcctccagctatcagctcccgatctcgtgtttgagggtagcgaccccgatttctgtttgcatgcacagccagcagccctagcgccagatcctaaagctggatatcttttaactgggctaccagcccgggcctcaaagttttgagtgagggccgccaggctcaggccccagcgaagccccgagcgccatggccgacccgcaggctggctccgcggccggggactgggagatcgatgtcgagagcctggagctggaagaggacgtctgcggggcgccgcggtccacgccccccgggcccagcccgccgccggcggacggggactgcgaggacgacgaagatgacgacggggtggacgaagacgcggaagaagagggcgacggcgaggaggcaggcgcgtcccccgggatgcccggccagccggagcagcgggggggaccgcagccgaggccgccgctcgcgcctcaggcctcacccgccggcaccggtccccgagagcgctgcactcccgcgggcggcggcgcggagccgcgcaagctgagccgcacgcccaagtgcgcgcgctgccgcaaccacggcgtggtgtcctgcctgaagggccacaagcgcttctgtcgctggcgcgactgccagtgcgccaactgcctgctggtggtggagcggcagcgcgtcatggccgcccaggtggcgctccggaggcagcaggccaccgaggacaagaaggggctttccgggaaacagaataatttcgagcgcaaagctgtgtaccagaggcaagtcagagcccccagtttgctggccaaaagcattttagaaggctatcgccccattccagcggagacttatgtaggagggaccttccctctacctcccccagttagtgacaggatgaggaaaagaagagcctttgctgataaagagttggagaacattatgctggagagagaatataaagaaagggagatgttggaaacttctcaagctgctgctctgtttctgcccaaccgcatggtgcctggacctgactacaattcctacaaaagtgcctacagccccagcccagtggaaccaccaagcaaggacttctgtaattttttgcccacctgccttgatttaaccatgcagtattcagggtctgggaatatggaactaatttcttctaatgtcagcgtggccacaacttatagacagtatcccttgtcctcaagatttttagtttggcccaagtgtggccccattagcgacaccctcctctaccagcaatgcctgctaaatgccaccacctcagttcaagccctgaagcctggggccagctgggacttgaagggagcacgagtccaggatggactcagtgcagagcaggacatgatgccatcgaaattggaaggttccctggtgctgcctcacactcctgagatccagaccacgagaagtgaccttcagggtcatcaggctgtcccagagaggtccgcgttctccccaccccgacggaatttctctcccattgttgacacggactccctggcagctcaagggcatgtcttaacgaagatcagcaaagaaaacaccaggcaccctctgccacttagacataatccattccactcattattccagcaaacacttactgacaaatcgggtcctgagttgaaaacaccatttgtcaaagaggcctttgaagagacccctaagaaacacagagagtgtttagttaaggacaaccagaagtacacatttacaatagatagatgtgcaaaagacctttttgtagccaaacaagttggaacaaaactctcggtgaatgaaccactgtcattttctgttgagtctattcttaagaggccttcatctgccatcactcgtgtctctcagtgaaaggctgcttaaacagaaagctggattttctgcagtcttagagcattatagccatttgctactttttttaaaagttaagatgtttgtgtaaagaaatttctaatgtaaagatgatgattttgaaaaattttatatattcctaatatgcatgtactttttcttatcacatatatttaaacttacagatggaaattgcccaatgtgcaaattgttaagtaccacactttacacagcatttcaaaaagcaataaaattgacactgtcttctcaaagaccc

SEQ ID NO: 8795 - DNA, 1965 bp, Homo sapiens
atggccgacccgcaggctggctccgcggccggggactgggagatcgatgtcgagagcctggagctggaagaggacgtctgcggggcgccgcggtccacgccccccgggcccagcccgccgccggcggacggggactgcgaggacgacgaagatgacgacggggtggacgaagacgcggaagaagagggcgacggcgaggaggcaggcgcgtcccccgggatgcccggccagccggagcagcgggggggaccgcagccgaggccgccgctcgcgcctcaggcctcacccgccggcaccggtccccgagagcgctgcactcccgcgggcggcggcgcggagccgcgcaagctgagccgcacgcccaagtgcgcgcgctgccgcaaccacggcgtggtgtcctgcctgaagggccacaagcgcttctgtcgctggcgcgactgccagtgcgccaactgcctgctggtggtggagcggcagcgcgtcatggccgcccaggtggcgctccggaggcagcaggccaccgaggacaagaaggggctttccgggaaacagaataatttcgagcgcaaagctgtgtaccagaggcaagtcagagcccccagtttgctggccaaaagcattttagaaggctatcgccccattccagcggagacttatgtaggagggaccttccctctacctcccccagttagtgacaggatgaggaaaagaagagcctttgctgataaagagttggagaacattatgctggagagagaatataaagaaagggagatgttggaaacttctcaagctgctgctctgtttctgcccaaccgcatggtgcctggacctgactacaattcctacaaaagtgcctacagccccagcccagtggaaccaccaagcaaggacttctgtaattttttgcccacctgccttgatttaaccatgcagtattcagggtctgggaatatggaactaatttcttctaatgtcagcgtggccacaacttatagacagtatcccttgtcctcaagatttttagtttggcccaagtgtggccccattagcgacaccctcctctaccagcaatgcctgctaaatgccaccacctcagttcaagccctgaagcctggggccagctgggacttgaagggagcacgagtccaggatggactcagtgcagagcaggacatgatgccatcgaaattggaaggttccctggtgctgcctcacactcctgagatccagaccacgagaagtgaccttcagggtcatcaggctgtcccagagaggtccgcgttctccccaccccgacggaatttctctcccattgttgacacggactccctggcagctcaagggcatgtcttaacgaagatcagcaaagaaaacaccaggcaccctctgccacttagacataatccattccactcattattccagcaaacacttactgacaaatcgggtcctgagttgaaaacaccatttgtcaaagaggcctttgaagagacccctaagaaacacagagagtgtttagttaaggacaaccagaagtacacatttacaatagatagatgtgcaaaagacctttttgtagccaaacaagttggaacaaaactctcggtgaatgaaccactgtcattttctgttgagtctattcttaagaggccttcatctgccatcactcgtgtctctcagtgaaaggctgcttaaacagaaagctggattttctgcagtcttagagcattatagccatttgctactttttttaaaagttaagatgtttgtgtaaagaaatttctaatgtaaagatgatgattttgaaaaattttatatattcctaatatgcatgtactttttcttatcacatatatttaaacttacagatggaaattgcccaatgtgcaaattgttaagtaccacactttacacagcatttcaaaaagcaataaaattgacactgtcttctcaaagacccaa

SEQ ID NO: 8796 - DNA, 2292 bp, Homo sapiens
gccagtggcgctgcgctgaatgcaactgcgcgcgcccgccgggtgagccagcgatctgagccaggcgggggcggcccgacctttcccgcccagcctgggtcagaggaagccgaaagcggcctcagcaagtgggttcgttccgggcctccagctatcagctcccgatctcgtgtttgagggtagcgaccccgatttctgtttgcatgcacagccagcagccctagcgccagatcctaaagctggatatcttttaactgggctaccagcccgggcctcaaagttttgagtgagggccgccaggctcaggccccagcgaagccccgagcgccatggccgacccgcaggctggctccgcggccggggactgggagatcgatgtcgagagcctggagctggaagaggacgtctgcggggcgccgcggtccacgccccccgggcccagcccgccgccggcggacggggactgcgaggacgacgaagatgacgacggggtggacgaagacgcggaagaagagggcgacggcgaggaggcaggcgcgtcccccgggatgcccggccagccggagcagcgggggggaccgcagccgaggccgccgctcgcgcctcaggcctcacccgccggcaccggtccccgagagcgctgcactcccgcgggcggcggcgcggagccgcgcaagctgagccgcacgcccaagtgcgcgcgctgccgcaaccacggcgtggtgtcctgcctgaagggccacaagcgcttctgtcgctggcgcgactgccagtgcgccaactgcctgctggtggtggagcggcagcgcgtcatggccgcccaggtggcgctccggaggcagcaggccaccgaggacaagaaggggctttccgggaaacagaataatttcgagcgcaaagctgtgtaccagaggcaagtcagagcccccagtttgctggccaaaagcattttagaaggctatcgccccattccagcggagacttatgtaggagggaccttccctctacctcccccagttagtgacaggatgaggaaaagaagagcctttgctgataaagagttggagaacattatgctggagagagaatataaagaaagggagatgttggaaacttctcaagctgctgctctgtttctgcccaaccgcatggtgcctggacctgactacaattcctacaaaagtgcctacagccccagcccagtggaaccaccaagcaaggacttctgtaattttttgcccacctgccttgatttaaccatgcagtattcagggtctgggaatatggaactaatttcttctaatgtcagcgtggccacaacttatagacagtatcccttgtcctcaagatttttagtttggcccaagtgtggccccattagcgacaccctcctctaccagcaatgcctgctaaatgccaccacctcagttcaagccctgaagcctggggccagctgggacttgaagggagcacgagtccaggatggactcagtgcagagcaggacatgatgccatcgaaattggaaggttccctggtgctgcctcacactcctgagatccagaccacgagaagtgaccttcagggtcatcaggctgtcccagagaggtccgcgttctccccaccccgacggaatttctctcccattgttgacacggactccctggcagctcaagggcatgtcttaacgaagatcagcaaagaaaacaccaggcaccctctgccacttagacataatccattccactcattattccagcaaacacttactgacaaatcgggtcctgagttgaaaacaccatttgtcaaagaggcctttgaagagacccctaagaaacacagagagtgtttagttaaggacaaccagaagtacacatttacaatagatagatgtgcaaaagacctttttgtagccaaacaagttggaacaaaactctcggtgaatgaaccactgtcattttctgttgagtctattcttaagaggccttcatctgccatcactcgtgtctctcagtgaaaggctgcttaaacagaaagctggattttctgcagtcttagagcattatagccatttgctactttttttaaaagttaagatgtttgtgtaaagaaatttctaatgtaaagatgatgattttgaaaaattttatatattcctaatatgcatgtactttttcttatcacatatatttaaacttacagatggaaattgcccaatgtgcaaattgttaagtaccacactttacacagcatttcaaaaagcaataaaattgacactgtcttctcaaagaccc

SEQ ID NO: 8797 - DNA, 2367 bp, Homo sapiens
gccagtggcgctgcgctgaatgcaactgcgcgcgcccgccgggtgagccagcgatctgagccaggcgggggcggcccgacctttcccgcccagcctgggtcagaggaagccgaaagcggcctcagcaagtgggttcgttccgggcctccagctatcagctcccgatctcgtgtttgagggtagcgaccccgatttctgtttgcatgcacagccagcagccctagcgccagatcctaaagctggatatcttttaactgggctaccagcccgggcctcaaagttttgagtgagggccgccaggctcaggccccagcgaagccccgagcgccatggccgacccgcaggctggctccgcggccggggactgggagatcgatgtcgagagcctggagctggaagaggacgtctgcggggcgccgcggtccacgccccccgggcccagcccgccgccggcggacggggactgcgaggacgacgaagatgacgacggggtggacgaagacgcggaagaagagggcgacggcgaggaggcaggcgcgtcccccgggatgcccggccagccggagcagcgggggggaccgcagccgaggccgccgctcgcgcctcaggcctcacccgccggcaccggtccccgagagcgctgcactcccgcgggcggcggcgcggagccgcgcaagctgagccgcacgcccaagtgcgcgcgctgccgcaaccacggcgtggtgtcctgcctgaagggccacaagcgcttctgtcgctggcgcgactgccagtgcgccaactgcctgctggtggtggagcggcagcgcgtcatggccgcccaggtggcgctccggaggcagcaggccaccgaggacaagaaggggctttccgggaaacagaataatttcgagcgcaaagctgtgtaccagaggcaagtcagagcccccagtttgctggccaaaagcattttagaagttctccttggattattctacagctattatgtgtacataatgaaccatctttagaaaataaaagtgacatcagctctaggctatcgccccattccagcggagacttatgtaggagggaccttccctctacctcccccagttagtgacaggatgaggaaaagaagagcctttgctgataaagagttggagaacattatgctggagagagaatataaagaaagggagatgttggaaacttctcaagctgctgctctgtttctgcccaaccgcatggtgcctggacctgactacaattcctacaaaagtgcctacagccccagcccagtggaaccaccaagcaaggacttctgtaattttttgcccacctgccttgatttaaccatgcagtattcagggtctgggaatatggaactaatttcttctaatgtcagcgtggccacaacttatagacagtatcccttgtcctcaagatttttagtttggcccaagtgtggccccattagcgacaccctcctctaccagcaatgcctgctaaatgccaccacctcagttcaagccctgaagcctggggccagctgggacttgaagggagcacgagtccaggatggactcagtgcagagcaggacatgatgccatcgaaattggaaggttccctggtgctgcctcacactcctgagatccagaccacgagaagtgaccttcagggtcatcaggctgtcccagagaggtccgcgttctccccaccccgacggaatttctctcccattgttgacacggactccctggcagctcaagggcatgtcttaacgaagatcagcaaagaaaacaccaggcaccctctgccacttagacataatccattccactcattattccagcaaacacttactgacaaatcgggtcctgagttgaaaacaccatttgtcaaagaggcctttgaagagacccctaagaaacacagagagtgtttagttaaggacaaccagaagtacacatttacaatagatagatgtgcaaaagacctttttgtagccaaacaagttggaacaaaactctcggtgaatgaaccactgtcattttctgttgagtctattcttaagaggccttcatctgccatcactcgtgtctctcagtgaaaggctgcttaaacagaaagctggattttctgcagtcttagagcattatagccatttgctactttttttaaaagttaagatgtttgtgtaaagaaatttctaatgtaaagatgatgattttgaaaaattttatatattcctaatatgcatgtactttttcttatcacatatatttaaacttacagatggaaattgcccaatgtgcaaattgttaagtaccacactttacacagcatttcaaaaagcaataaaattgacactgtcttctcaaaga

SEQ ID NO: 8798 - DNA, 1244 bp, Homo sapiens
ccagtggcgctgcgctgaatgcaactgcgcgcgcccgccgggtgagccagcgatctgagccaggcgggggcggcccgacctttcccgcccagcctgggtcagaggaagccgaaagcggcctcagcaaggtgaggcgcccgaggctgcagaagaccgagcagaactttgcagagttcgggatgtgctgggctaggtcgctgaggacttgactggcttcctccctccttccctccacctaccttctccctccccctccaccatccagtgggttcgttccgggcctccagctatcagctcccgatctcgtgtttgagggtagcgaccccgatttctgtttgcatgcacagccagcagccctagcgccagatcctaaagctggatatcttttaactgggctaccagcccgggcctcaaagttttgagtgagggccgccaggctcaggccccagcgaagccccgagcgccatggccgacccgcaggctggctccgcggccggggactgggagatcgatgtcgagagcctggagctggaagaggacgtctgcggggcgccgcggtccacgccccccgggcccagcccgccgccggcggacggggactgcgaggacgacgaagatgacgacggggtggacgaagacgcggaagaagagggcgacggcgaggaggcaggcgcgtcccccgggatgcccggccagccggagcagcgggggggaccgcagccgaggccgccgctcgcgcctcaggcctcacccgccggcaccggtccccgagagcgctgcactcccgcgggcggcggcgcggagccgcgcaagctgagccgcacgcccaagtgcgcgcgctgccgcaaccacggcgtggtgtcctgcctgaagggccacaagcgcttctgtcgctggcgcgactgccagtgcgccaactgcctgctggtggtggagcggcagcgcgtcatggccgcccaggtggcgctccggaggcagcaggccaccgaggacaagaaggggctttccgggaaacagaataatttcgagcgcaaagctgtgtaccagaggcaagtcagagcccccagtttgctggccaaaagcattttagaagttctccttggattattctacagctattatgtgtacataatgaaccatctttagaaaataaaagtgacatcagctctaggtatagatatattttttaataatgaaaaaagatgacatggataataataaaacattgattgatacaagataaa

SEQ ID NO: 8799 - DNA, 8552 bp, Homo sapiens
agggaaggttggcagagggatccatgtgactgaggccggagcacggcaaagatgagcctgcccgcccgcctgctgcctggatgcggagggtgagggctggcgcacgggaggccgctggctgcgcattctgggcgccgagtgcccgggatgagctcacgcccgcgtctgcggctctctccacctgccgacctgccgggggcccactgagctgacggcgcacctgggctccggccgcagcgtggggcgcggcgcccgggagcaggtgtgcaggagcgcagcgcgcggcgagcgcagccctcgctccggagcccggccgcgccgcgtgcccgggcggctaggcagcggcggcggcggcggcgggcggcgggcgggcggcggcccccgggcaggtgccgagcggcgagcggagccgggccgggcggagcgcggggggcgaggccggcgcgtcgctcgcgggaggccggggagcggcaggggcatgtggatactggctctctccttgttccagagcttcgcgaatgttttcagtgaagacctacactccagcctctactttgtcaatgcatctctgcaagaggtagtgtttgccagcaccacggggactctggtgccctgccccgcagcaggcatccctcctgtgactctcagatggtacctagccacgggcgaggagatctacgatgtccccgggatccgccacgtccaccccaacggcactctccaaattttccccttccctccttcaagcttcagtaccttaatccatgataatacttattattgcacagctgaaaatccttcagggaaaattagaagtcaggatgtccacatcaaggctgttttacgggagccctatacagtccgtgtggaggaccagaaaaccatgagaggcaatgttgcggtcttcaagtgcattatcccctcctcggtggaggcgtacatcactgtcgtctcatgggagaaagacactgtttcacttgtctcaggatctagatttctcatcacatccacgggagccttgtatattaaagatgtacagaatgaagatggattgtataactaccgctgcatcacgcggcatcgatacaccggagagacgaggcagagcaacagcgccagactttttgtatcagacccagcgaactcagccccatccatactggatgggtttgaccatcgcaaagccatggctgggcagcgtgtggagctgccttgcaaagcgctcgggcaccctgagccagattaccgctggctgaaggacaacatgcccctggaactttcagggaggttccagaagaccgtgacggggctgctcattgagaacattcgcccctcggactcaggcagctatgtttgtgaagtgtccaacagatacggaactgctaaggtgataggccgcctgtacgtgaaacagccactgaaagccaccatcagtcccaggaaggttaaaagcagcgtgggtagccaagtttccttgtcctgcagcgtgacaggaactgaggaccaggaactctcctggtaccgcaatggtgaaatcctcaaccctggaaaaaatgtgaggatcacagggatcaaccacgaaaaccttataatggatcacatggtcaaaagtgacgggggcgcataccagtgctttgtgcgcaaggacaagctgtccgctcaagactatgtgcaggtggtccttgaagatggaactcccaaaattatttctgcctttagtgaaaaggtggtgagtccagcagagccggtttcccttatgtgcaacgtgaagggaacacctttgcccacgatcacgtggaccctggacgatgacccgattctcaagggtggcagtcaccgcatcagccagatgatcacgtcggaggggaacgtggtcagctacctgaacatctccagctcccaggtccgggacgggggagtctaccgctgcactgccaacaactcggcgggagtcgtcctgtaccaggctcgaataaacgtaagagggcctgcaagcattcgaccaatgaaaaacatcacagcaatagcaggacgggacacatacattcactgtcgtgtgattggctatccgtattactccattaaatggtacaagaactctaacctgcttcctttcaaccaccgccaagtggcatttgagaacaatggaactcttaaactttcagatgtgcaaaaggaagtggacgagggggagtacacgtgcaacgtgttggttcaaccacaactctccaccagccagagcgtccacgtgaccgtgaaagttccgcctttcatacaaccctttgagtttccaagattctccattgggcagcgggtcttcatcccctgtgttgtggtctcaggggacttacccatcacgatcacctggcagaaggatggccggccaatccctgggagccttggggtgaccattgacaatattgacttcacgagctccttgaggatttccaatctctcgctcatgcacaatgggaattacacctgcatagcccggaatgaggccgccgctgtggagcaccaaagccagttgattgtcagagttcctcccaagtttgtggttcagccacgggaccaggacgggatttatggcaaagcagtcatcctcaattgttctgctgagggttaccctgtacctaccatcgtgtggaaattctctaaaggtgctggggttccccagttccagccaattgccctaaatggccgaatccaagttctcagcaatgggtcgttgctgatcaagcatgtcgtggaggaagacagtggctactacctctgcaaggtcagcaacgatgtgggcgcagacgtcagcaagtccatgtacctcacggttaaaattcctgcgatgataacatcctatccaaatactaccctggccacgcaggggcagaaaaaggagatgagctgcacggcgcatggtgagaagcccattatagtccgctgggagaaggaggaccgaatcattaaccctgagatggcccgttatcttgtgtccaccaaggaggtgggagaagaggtgatttctactctgcagattttgccaactgtgagagaagattctggtttcttttcctgccatgctattaattcttatggggaggaccgtggaataattcagctcacagtgcaagagcccccagaccctcccgaaattgagatcaaagatgtcaaagcacgcacaattacgctcaggtggaccatggggtttgatggaaacagtcccatcacaggctacgatattgaatgcaaaaataaatcagactcctgggattctgctcagagaaccaaagatgtttcccctcagctgaactcggccaccatcattgatatccacccttcctccacctacagcatccgcatgtacgccaagaaccggattggcaagagcgagcccagcaacgagctcaccatcacggcggacgaggcagctcctgatggtccacctcaggaagttcacctggagcctatatcatctcagagcatcagggtcacatggaaggctcccaagaaacatttgcaaaatgggattatccgtggctaccaaataggttaccgagagtacagcactgggggtaacttccaattcaacattatcagtgtcgacaccagcggggacagtgaggtttacaccctggacaacctgaataagttcactcagtacggcctggtggtgcaggcctgtaaccgggccggcacggggccttcttctcaggaaatcatcaccaccactctcgaggatgtgcccagttacccccccgaaaatgtccaagccatagcaacatcaccagaaagcatatcaatatcctggtccacactttccaaggaagccttgaatggaattctccaggggttcagagtcatttactgggccaacctcatggacggagagctgggtgagattaaaaacatcaccaccacacagccttcactggagctggacgggctggaaaagtacaccaactacagcatccaggtgctggccttcacccgcgcaggagacggggtcaggagtgagcagatcttcacccggaccaaagaggatgttccaggtcctcccgcgggtgtgaaggcagcggcggcctcagcctccatggtctttgtgtcctggcttccccctctcaagctgaacggcatcatccgaaagtacactgtattctgctcccacccctatcccacagtgatcagcgagtttgaggcctctcccgactcgttttcctacagaattcccaacctgagtaggaatcgtcagtacagcgtctgggtggtggctgttacttcagccggaagaggcaacagcagtgaaatcatcacagtcgagccactagcaaaagctcctgcacgaatcctgaccttcagtgggacagtgactactccatggatgaaagacattgtcttgccttgtaaggctgttggggacccttctcctgcagtcaaatggatgaaagacagtaacgggacacccagtctagtaacgattgatgggcggaggagcatctttagcaacggaagcttcattattcgcacggtgaaagcagaagactccggctattacagctgcattgccaataacaactggggatctgatgaaattattttaaacttacaagtacaagttccaccagatcagcctcggcttacagtctccaagaccacgtcttcctccatcaccctttcttggctccctggagacaacgggggcagctctatcagaggatacatactgcagtactccgaggacaatagtgagcagtgggggagttttccaatcagccccagcgaacgttcctatcgcttggaaaatctcaaatgtgggacttggtataagttcacactgacagcccaaaatggagtgggcccagggcgcataagtgaaatcatagaagcaaagaccttaggaaaagagccccagttctcaaaggagcaggagctgtttgccagcatcaacaccacacgcgtgaggctgaacctcattggctggaatgatggcggctgccccatcacctccttcacactagagtacaggccctttgggaccacagtttggaccacagctcagaggacctctctctccaagtcctacatcctgtatgacctgcaggaagccacctggtatgagctgcagatgcgggtgtgcaacagtgcgggctgcgcggagaagcaggccaacttcgctacgctgaactacgatggcagtacaattcctccactcattaagtcagttgtccaaaacgaagaagggctgacgaccaacgaggggctcaagatgctggtgaccatctcctgtatcctggtgggggtcttgctgctgtttgtgctcctgctggttgtgcggaggaggcggcgggagcagaggctaaagaggctgcgagatgcaaagagtttagctgaaatgctcatgagtaagaatacccggacttcagatacgttaagcaagcaacagcagaccctgcgaatgcacatcgacatacccagggctcagcttttgattgaagagagagacacgatggagaccattgatgatcgctccacggttctgttgacggatgctgactttggagaggcagctaagcagaagtccctgacggtcactcacacggtccattaccaatcggtgtctcaggccactgggcccttagtggatgtttcagacgctcggccgggaacgaatcccaccaccaggaggaatgccaaggctgggcccacagcgagaaaccgctatgccagccagtggaccctcaaccgaccccaccccaccatctcagcacacaccctcaccacagactggaggctgccaacacccagggctgcaggatcagtagacaaagagagcgacagttacagcgtcagcccctcgcaagacacagatcgagcaagaagcagcatggtctccacagaaagtgcctcctccacttacgaagaactggccagggcctacgaacacgccaagatggaagagcaactgaggcacgccaagttcaccatcacggagtgcttcatatcagacacgtcatcggagcagttgacggcagggacaaatgagtacacggacagtctgacctccagcaccccttccgaatcgggaatctgcaggttcactgcatctccccccaaacctcaggatggaggaagagtaatgaatatggcagttccaaaggcacatcggccaggtgacctcatacatttgcctccataccttagaatggactttttgttaaaccgaggtggtccaggcaccagcagggacctgagcttaggacaagcatgcttggaacctcagaaaagccggaccctgaagcgccccacggtcctggagcccatcccgatggaagccgcctcctccgcctcctccacgagagaaggacagtcgtggcagccgggggccgtggccacattacctcagcgggagggagcagagctgggacaggcagctaaaatgagcagctcccaagaatcactgctcgactcccggggccatttgaaaggaaacaatccttacgcaaaatcttacaccctggtataacagacagcatgactggacagcggttgtaaatacaattcaaacaattcaatcaaagctaccttttttttacggaattccaatatttataattaaagaaaattgccaaaatatattaaaaaaaaaaaagagaaaatactgaaaccacagacagtgcaaagactctcctgctttttttctgtctgagtgtgagctccatccgcctgggcatctgattttttgggaaagaagtccagttttatgatcttcacaggctattgcatttttactgattttctacaaaagtgcatgggggggattaattaaaccttctgactggaagttctatcacacaagaggcaagaaagaaaacagggtgggtgggaaatcagcctatttgtgaatttaaaaggaacaccgatttgcgggcaggggaaaacttcagtcacgtttgcacacctttctttcccattagaaaccgggttctcaatttggtcttcttttgttgttaattaggatgagtgccgtcagtgaaggggtggggggaatcaatttggttttctctcttgtttcttttttaatttaatgagacactctttgcattttgtctaagcgaaataaaaaagaaaaggttgtctgcctttatttccatgtctgcttctctcgtcttctgccagtggcctggtcctccttcccattgacacttctgtttggaaacaccaggcctgaacccagagcccaattcaataaaccagagtcgatactaacaccctgaactcctcaggaatctccaggaagcacaaagaaggtgcagctcctgctctcaagctggagaggacaaaatgcaggctggtctccaccgcaaccagaggccagcccaagtattcgaagcccgtcgcaaagctctgccccttgcctgcccatggccagagttcaactgactgtggcctatgggccaaatccagcctcctgctgttttttaaataaagttttattgaaacaaggccacatgcactatttgctattgtctatggctgctttcatggcacaatggtagagctgaatagttgcagcagagatggtatagcccatgaagcctaaaatatttattacctggcccattacaggaaacatttgccagacccgtgctctggagtctgaaatgtagccccagcttgcgtgacaaggggcaagatcgtgcatcttaccctccatgacttttcctatctccactatgcctggtatgcaaatttgtgatagaccatcttaataaacattgcctgaatcctctgtaaccagaggaaagtgatgttcctctaaaatctaagtttttactttcctttccctcactttatctcccatgtggctcatcctaagagagaatttactcataaatagtcggaactgcattctttatcccacaaccctcacagggtttgctttatgaaagaggatgtaatcctcccctggctgcaacactccattccaggctcacttccataaaatggaaagataaacaggtctttgtgtcagagatttggcattaaccagaaaacatgatcaaatatccacagctgctcagtctcccaggctgaagattctctacaggcttccattaaggccaccaacatagactggtgccagttattaccatcttgggaacatattcagaaatgtctttccttccctccctccctccttctttcccatcctttcttccttctatttattttccaggcaggcccatttgtctgcttagattcagtgacacagaatgggtccaggaccatgtcaagaccacctgctgatgctagtgttagatgactccaggaatgtgaggtgtgcatccatggtttcagaatgtaatccgtgttgacgtgtactgtttgcatactctcagactgttttttttttatgcaaaagaaatgttactttctgggggaaaaaattaaaagtctatctttcatcaacctaaaacttctatatcccccaaacatagaagtttacctttttaacatttttctctcaacctgtacaaaaataaaaaaattctacatta

SEQ ID NO: 8800 - DNA, 6899 bp, Homo sapiens
ggatgacaggagccggggagccgaggagggaggagccgccgccgcagccgagcgctgggctgaggagcagagagagcggggcgccgagtgcgggcggctgggagcgcgctgagcgggggagaggcgctgccgcacggccggccacaggaccacctccccggagaatagggcctctttatggcatgtggctggtaactttcctcctgctcctggactctttacacaaagcccgccctgaagatgttggcaccagcctctactttgtaaatgactccttgcagcaggtgaccttttccagctccgtgggggtggtggtgccctgcccggccgcgggctcccccagcgcggcccttcgatggtacctggccacaggggacgacatctacgacgtgccgcacatccggcacgtccacgccaacgggacgctgcagctctaccccttctccccctccgccttcaatagctttatccacgacaatgactacttctgcaccgcggagaacgctgccggcaagatccggagccccaacatccgcgtcaaagcagttttcagggaaccctacaccgtccgggtggaggatcaaaggtcaatgcgtggcaacgtggccgtcttcaagtgcctcatcccctcttcagtgcaggaatatgttagcgttgtatcttgggagaaagacacagtctccatcatcccagaacacaggttttttattacctaccacggcgggctgtacatctctgacgtacagaaggaggacgccctctccacctatcgctgcatcaccaagcacaagtatagcggggagacccggcagagcaatggggcacgcctctctgtgacagaccctgctgagtcgatccccaccatcctggatggcttccactcccaggaagtgtgggccggccacaccgtggagctgccctgcaccgcctcgggctaccctatccccgccatccgctggctcaaggatggccggcccctcccggctgacagccgctggaccaagcgcatcacagggctgaccatcagcgacttgcggaccgaggacagcggcacctacatttgtgaggtcaccaacaccttcggttcggcagaggccacaggcatcctcatggtcattgatccccttcatgtgaccctgacaccaaagaagctgaagaccggcattggcagcacggtcatcctctcctgtgccctgacgggctccccagagttcaccatccgctggtatcgcaacacggagctggtgctgcctgacgaggccatctccatccgcgggctcagcaacgagacgctgctcatcacctcggcccagaagagccattccggggcctaccagtgcttcgctacccgcaaggcccagaccgcccaggactttgccatcattgcacttgaggatggcacgccccgcatcgtctcgtccttcagcgagaaggtggtcaaccccggggagcagttctcactgatgtgtgcggccaagggcgccccgccccccacggtcacctgggccctcgacgatgagcccatcgtgcgggatggcagccaccgcaccaaccagtacaccatgtcggacggcaccaccatcagccacatgaacgtcacaggcccccagatccgcgacgggggcgtgtaccggtgcacagcgcggaacttggtgggcagtgctgaatatcaggcgcgaataaacgtaagaggcccacccagcatccgggctatgcggaacatcacagcagtcgccgggcgggacacccttatcaactgcagggtcatcggctatccctactactccatcaagtggtacaaggatgccctgctgctgccagacaaccaccgccaggtggtgtttgagaatgggaccctcaagctgactgacgtgcagaagggcatggatgagggggagtacctgtgcagtgtcctcatccagccccagctctccatcagccagagcgttcacgtagccgtcaaagtgccccctctgatccagcccttcgaattcccacccgcctccatcggccagctgctctacattccctgtgtggtgtcctcgggggacatgcccatccgtatcacctggaggaaggacggacaggtgatcatctcaggctcgggcgtgaccatcgagagcaaggaattcatgagctccctgcagatctctagcgtctccctcaagcacaacggcaactatacatgcatcgccagcaacgcagccgccaccgtgagccgggagcgccagctcatcgtgcgtgtgccccctcgatttgtggtgcaacccaacaaccaggatggcatctacggcaaagctggtgtgctcaactgctcggtggacggctaccccccacccaaggtcatgtggaagcatgccaaggggagcgggaacccccagcagtaccaccctgtgcccctcactggccgcatccagatcctgcccaacagctcgctgctgatccgccacgtcctagaagaggacatcggctactacctctgccaggccagcaacggcgtaggcaccgacatcagcaagtccatgttcctcacagtcaagatcccggccatgatcacttcccaccccaacaccaccatcgccatcaagggccatgcgaaggagctaaactgcacggcacggggtgagcggcccatcatcatccgctgggagaagggggacacagtcatcgaccctgaccgcgtcatgcggtatgccatcgccaccaaggacaacggcgacgaggtcgtctccacactgaagctcaagcccgctgaccgtggggactctgtgttcttcagctgccatgccatcaactcgtatggggaggaccggggcttgatccaactcactgtgcaagagccccccgaccccccagagctggagatccgggaggtgaaggcccggagcatgaacctgcgctggacccagcgattcgacgggaacagcatcatcacgggcttcgacattgaatacaagaacaaatcagattcctgggacttcaagcagtccacacgcaacatctcccccaccatcaaccaggccaacattgtggacttgcacccggcatctgtgtacagcatccgcatgtactctttcaacaagattggccgcagtgaaccaagcaaggagctcaccatcagcactgaggaggccgctcccgatgggccccccatggatgttaccttgcagccagtgacctcacagagcatccaggtgacctggaaggcacccaagaaggagctgcagaacggtgtcatccggggctaccagattggctacagagagaacagccccggcagcaacgggcagtacagcatcgtggagatgaaggccacgggggacagcgaggtctacaccctggacaacctcaagaagttcgcccagtatggggtggtggtccaagccttcaatcgggctggcacggggccctcttccagcgagatcaatgccaccactctggaggatgtgcccagccagccccctgagaacgtccgggccctgtccatcacttctgacgtggccgtcatctcctggtcagagcccccgcgcagcaccctcaatggcgtcctcaaaggctatcgggtcatcttctggtccctctatgttgatggggagtggggcgagatgcagaacatcaccaccacgcgggagcgggtggagctgcggggcatggagaagttcaccaactacagcgtccaggtgctggcctacacccaggctggggacggcgtacgcagcagtgtgctctacatccagaccaaggaggacgttccaggtccccctgctggcatcaaagctgtcccttcatcagctagcagtgtggttgtgtcttggctcccccctaccaagcccaacggggtgatccgcaagtacaccatcttctgttccagccccgggtctggccagccggctcccagcgagtacgagacgagtccagagcagctcttctaccggatcgcccacctaaaccgcggtcagcagtatctgctgtgggtggccgccgtcacctctgccggccggggcaacagcagcgagaaggtgaccatcgagcctgctggcaaggccccagcaaagatcatctcctttgggggcaccgtgacaacaccttggatgaaagatgttcggctgccttgcaattcagtgggagatccagcccctgctgtgaagtggaccaaggacagtgaagactcggccattccagtgtccatggatgggcaccggctcatccacaccaatggcacactgctgctgcgtgcagtgaaggctgaggactctggctactacacgtgcacggccaccaacactggtggctttgacaccatcatcgtcaaccttctggtgcaagttcccccggaccagccccgcctcactgtctccaaaacctcagcttcgtccatcaccctgacctggattccaggtgacaatgggggcagctccatccgaggcttcgtgctacagtactcggtggacaacagcgaggagtggaaggatgtgttcatcagctccagcgagcgctccttcaagctggacagcctcaagtgtggcacgtggtacaaggtgaagctggcagccaagaacagcgtgggctctgggcgcatcagcgagatcatcgaggccaagacccacgggcgggagccctccttcagcaaagaccaacacctcttcacccacatcaactccacgcatgctcggcttaacctgcagggctggaacaatgggggctgccctatcacagccatcgttctggagtaccggcccaaggggacctgggcctggcagggcctccgggccaacagctccggggaggtgtttctgacggaactgcgagaggccacgtggtacgagctgcgcatgagggcttgcaacagtgcgggctgcggcaatgaaacagcccagttcgccaccctggactacgatggcagcaccattccacccatcaagtctgctcaaggtgaaggggatgatgtgaagaagctgttcaccatcggctgccctgtcatcctggccacactgggggtggcactgctcttcatcgtacgcaagaagaggaaggagaaacggctgaagcgactccgagatgcaaagagtttggcagaaatgttgataagcaagaacaatagaagctttgacacccctgtgaaagggccaccccagggcccacggctacacattgacatccccagggtccagctgctcatcgaggacaaagaaggcatcaagcaactgggagatgacaaggccaccatccctgtgacagatgctgagttcagccaagctgtcaacccacagagcttctgtactggcgtctccttgcaccacccaaccctcatccagagcacaggacccctcatcgacatgtctgacatccggccaggaaccaatccagtgtccaggaagaatgtgaagtcagcccacagcacccggaaccggtactcaagccagtggaccctgaccaagtgccaggcctccacacctgcccgcaccctcacctccgactggcgcaccgtgggctcccagcatggtgtcacggtcactgagagtgacagctacagtgccagcctgtcccaggacacagacaaaggaaggaacagcatggtgtccactgagagtgcctcttccacctacgaggagctggcccgggcctatgagcatgccaagctggaggagcagctgcagcacgccaagtttgagatcaccgagtgcttcatctctgacagttcctctgaccagatgaccacaggcaccaacgagaacgccgacagcatgacatccatgagcacaccctcagagcctggcatctgccgctttaccgcctcaccacccaagccccaggatgcggaccggggcaaaaacgtggctgtgcccatccctcaccgggccaacaagagtgactactgcaacctgcccctgtatgccaagtcagaggccttctttcgaaaggcagatggacgtgagccctgccccgtggtcccaccccgtgaggcctccatccggaacctggctcgaacctaccacacccaggctcgccacctgaccctggaccctgccagcaagtccttgggccttccccacccaggggcccccgctgccgcctccacagccaccttacctcagaggactctggccatgccagcccccccagccggcacagcccccccagcccccggccccacccctgctgagccacccaccgcccccagcgctgcccctccggcccccagcaccgagcctccacgagccgggggcccacacaccaaaatggggggctccagggactcgcttctcgagatgagcacatcgggggtagggaggtctcagaagcagggggccggggcctactccaaatcctacaccctggtgtagggcccgcaggaagagcagccacgcctggaccgcgccgcgccgcagccccacacgccagctcggctgtttttctgcattatttatattcaactgacagacaaaaaccaaccaacgacaaaacaaaaacccccaatcatgaacgcctgtacatagaactcttttgtacaaatgaaactattttcttcttctccatgaagccagggcacaaagaatttgacagtacaagtcaaatcccccaccccacaaaatatgtgtggagatatatatacatatatagacagacaggaacgcgtccacgagctatatatctatatatttctctcaccctattttgagacagaggcacaaagactcagcaatttttttccctcctcctcaccttccccccagtctaggtggttttgacaaagaccaaaatcccaactcagagacactgcatgcgattttactgttccaagaaaaccaggagttgcttcaatttgcagatgcttatgtgttaatacctttttctatgaaaaaagacccagcgccgtgtgcaataaaggttatgtttct

SEQ ID NO: 8801 - DNA, 6086 bp, Homo sapiens
cctctttatggcatgtggctggtaactttcctcctgctcctggactctttacacaaagtgccctgaagatgttgccttattgggccggccacaccgtggagctgccctgcaccgcctcgggctaccctatccccgccatccgctggctcaaggatggccggcccctcccggctgacagccgctggaccaagcgcatcacagggctgaccatcagcgacttgcggaccgaggacagcggcacctacatttgtgaggtcaccaacaccttcggttcggcagaggccacaggcatcctcatggtcattgatccccttcatgtgaccctgacaccaaagaagctgaagaccggcattggcagcacggtcatcctctcctgtgccctgacgggctccccagagttcaccatccgctggtatcgcaacacggagctggtgctgcctgacgaggccatctccatccgcgggctcagcaacgagacgctgctcatcacctcggcccagaagagccattccggggcctaccagtgcttcgctacccgcaaggcccagaccgcccaggactttgccatcattgcacttgaggatggcacgccccgcatcgtctcgtccttcagcgagaaggtggtcaaccccggggagcagttctcactgatgtgtgcggccaagggcgccccgccccccacggtcacctgggccctcgacgatgagcccatcgtgcgggatggcagccaccgcaccaaccagtacaccatgtcggacggcaccaccatcagccacatgaacgtcacaggcccccagatccgcgacgggggcgtgtaccggtgcacagcgcggaacttggtgggcagtgctgaatatcaggcgcgaataaacgtaagaggcccacccagcatccgggctatgcggaacatcacagcagtcgccgggcgggacacccttatcaactgcagggtcatcggctatccctactactccatcaagtggtacaaggatgccctgctgctgccagacaaccaccgccaggtggtgtttgagaatgggaccctcaagctgactgacgtgcagaagggcatggatgagggggagtacctgtgcagtgtcctcatccagccccagctctccatcagccagagcgttcacgtagccgtcaaagtgccccctctgatccagcccttcgaattcccacccgcctccatcggccagctgctctacattccctgtgtggtgtcctcgggggacatgcccatccgtatcacctggaggaaggacggacaggtgatcatctcaggctcgggcgtgaccatcgagagcaaggaattcatgagctccctgcagatctctagcgtctccctcaagcacaacggcaactatacatgcatcgccagcaacgcagccgccaccgtgagccgggagcgccagctcatcgtgcgtgtgccccctcgatttgtggtgcaacccaacaaccaggatggcatctacggcaaagctggtgtgctcaactgctcggtggacggctaccccccacccaaggtcatgtggaagcatgccaaggggagcgggaacccccagcagtaccaccctgtgcccctcactggccgcatccagatcctgcccaacagctcgctgctgatccgccacgtcctagaagaggacatcggctactacctctgccaggccagcaacggcgtaggcaccgacatcagcaagtccatgttcctcacagtcaagatcccggccatgatcacttcccaccccaacaccaccatcgccatcaagggccatgcgaaggagctaaactgcacggcacggggtgagcggcccatcatcatccgctgggagaagggggacacagtcatcgaccctgaccgcgtcatgcggtatgccatcgccaccaaggacaacggcgacgaggtcgtctccacactgaagctcaagcccgctgaccgtggggactctgtgttcttcagctgccatgccatcaactcgtatggggaggaccggggcttgatccaactcactgtgcaagagccccccgaccccccagagctggagatccgggaggtgaaggcccggagcatgaacctgcgctggacccagcgattcgacgggaacagcatcatcacgggcttcgacattgaatacaagaacaaatcagattcctgggacttcaagcagtccacacgcaacatctcccccaccatcaaccaggccaacattgtggacttgcacccggcatctgtgtacagcatccgcatgtactctttcaacaagattggccgcagtgaaccaagcaaggagctcaccatcagcactgaggaggccgctcccgatgggccccccatggatgttaccttgcagccagtgacctcacagagcatccaggtgacctggaaggcacccaagaaggagctgcagaacggtgtcatccggggctaccagattggctacagagagaacagccccggcagcaacgggcagtacagcatcgtggagatgaaggccacgggggacagcgaggtctacaccctggacaacctcaagaagttcgcccagtatggggtggtggtccaagccttcaatcgggctggcacggggccctcttccagcgagatcaatgccaccactctggaggatgtgcccagccagccccctgagaacgtccgggccctgtccatcacttctgacgtggccgtcatctcctggtcagagcccccgcgcagcaccctcaatggcgtcctcaaaggctatcgggtcatcttctggtccctctatgttgatggggagtggggcgagatgcagaacatcaccaccacgcgggagcgggtggagctgcggggcatggagaagttcaccaactacagcgtccaggtgctggcctacacccaggctggggacggcgtacgcagcagtgtgctctacatccagaccaaggaggacgttccaggtccccctgctggcatcaaagctgtcccttcatcagctagcagtgtggttgtgtcttggctcccccctaccaagcccaacggggtgatccgcaagtacaccatcttctgttccagccccgggtctggccagccggctcccagcgagtacgagacgagtccagagcagctcttctaccggatcgcccacctaaaccgcggtcagcagtatctgctgtgggtggccgccgtcacctctgccggccggggcaacagcagcgagaaggtgaccatcgagcctgctggcaaggccccagcaaagatcatctcctttgggggcaccgtgacaacaccttggatgaaagatgttcggctgccttgcaattcagtgggagatccagcccctgctgtgaagtggaccaaggacagtgaagactcggccattccagtgtccatggatgggcaccggctcatccacaccaatggcacactgctgctgcgtgcagtgaaggctgaggactctggctactacacgtgcacggccaccaacactggtggctttgacaccatcatcgtcaaccttctggtgcaagttcccccggaccagccccgcctcactgtctccaaaacctcagcttcgtccatcaccctgacctggattccaggtgacaatgggggcagctccatccgaggcttcgtgctacagtactcggtggacaacagcgaggagtggaaggatgtgttcatcagctccagcgagcgctccttcaagctggacagcctcaagtgtggcacgtggtacaaggtgaagctggcagccaagaacagcgtgggctctgggcgcatcagcgagatcatcgaggccaagacccacgggcgggagccctccttcagcaaagaccaacacctcttcacccacatcaactccacgcatgctcggcttaacctgcagggctggaacaatgggggctgccctatcacagccatcgttctggagtaccggcccaaggggacctgggcctggcagggcctccgggccaacagctccggggaggtgtttctgacggaactgcgagaggccacgtggtacgagctgcgcatgagggcttgcaacagtgcgggctgcggcaatgaaacagcccagttcgccaccctggactacgatggcagcaccattccacccatcaagtctgctcaaggtgaaggggatgatgtgaagaagctgttcaccatcggctgccctgtcatcctggccacactgggggtggcactgctcttcatcgtacgcaagaagaggaaggagaaacggctgaagcgactccgagatgcaaagagtttggcagaaatgttgataagcaagaacaatagaagctttgacacccctgtgaaagggccaccccagggcccacggctacacattgacatccccagggtccagctgctcatcgaggacaaagaaggcatcaagcaactgggagatgacaaggccaccatccctgtgacagatgctgagttcagccaagctgtcaacccacagagcttctgtactggcgtctccttgcaccacccaaccctcatccagagcacaggacccctcatcgacatgtctgacatccggccaggaaccaatccagtgtccaggaagaatgtgaagtcagcccacagcacccggaaccggtactcaagccagtggaccctgaccaagtgccaggcctccacacctgcccgcaccctcacctccgactggcgcaccgtgggctcccagcatggtgtcacggtcactgagagtgacagctacagtgccagcctgtcccaggacacagacaaaggaaggaacagcatggtgtccactgagagtgcctcttccacctacgaggagctggcccgggcctatgagcatgccaagctggaggagcagctgcagcacgccaagtttgagatcaccgagtgcttcatctctgacagttcctctgaccagatgaccacaggcaccaacgagaacgccgacagcatgacatccatgagcacaccctcagagcctggcatctgccgctttaccgcctcaccacccaagccccaggatgcggaccggggcaaaaacgtggctgtgcccatccctcaccgggccaacaagagtgactactgcaacctgcccctgtatgccaagtcagaggccttctttcgaaaggcagatggacgtgagccctgccccgtggtcccaccccgtgaggcctccatccggaacctggctcgaacctaccacacccaggctcgccacctgaccctggaccctgccagcaagtccttgggccttccccacccaggggcccccgctgccgcctccacagccaccttacctcagaggactctggccatgccagcccccccagccggcacagcccccccagcccccggccccacccctgctgagccacccaccgcccccagcgctgcccctccggcccccagcaccgagcctccacgagccgggggcccacacaccaaaatggggggctccagggactcgcttctcgagatgagcacatcgggggtagggaggtctcagaagcagggggccggggcctactccaaatcctacaccctggtgtagggcccgcaggaagagcagccacgcctggaccgcgccgcgccgcagccccacacgccagctcggctgtttttctgcattatttatattcaactgacagacaaaaaccaaccaacgacaaaacaaaaacccccaatcatgaacgcctgtacatagaactcttttgtacaaatgaaactattttcttcttctccatgaagccagggcacaaagaatttgacagtacaagtcaaatcccccaccccacaaaatatgtgtggagatatatatacatatatagacagacaggaacgcgtccacgagctatatatctatatatttctctcaccctattttgagacagaggcacaaagactcagcaatttttttccctcctcctcaccttccccccagtctaggtggttttgacaaagaccaaaatcccaactcagagacactgcatgcgattttactgttccaagaaaaccaggagttgcttcaatttgcagatgcttatgtgttaatacctttttctatgaaaaaagacccagcgccgtgtgcaataaaggttatgtttct

SEQ ID NO: 8802 - DNA, 3672 bp, Homo sapiens
cacgcaggggccgcacccctgagggtgaccggaaccgctcccgcgggaagggcagggtgcggcgcctggccgcagacagacaagggggcgccggctcttcagaaccccagggagaaagcggtggagggctagagttgaggagactaaggacatttgaggagggcaggcattaccaagttaaaacctcctgaaagacaactccattgggcgaccgtctgcgccgcacagcctgacgggagcgtcatccttcctgcgcaggctgcaaccgacagacaggctcggctccgcctccagccgcggggcacgcggggagagccgttcctccctccctccgctaacccggacagcaaaggagcatttccggcgtaagactgtccctacggaaggggtggggctagcttggccccgtctttcacgcccagagggggcggggtgaaccgtgacagcgcttcggcccgcactaaggccggctcttgtgccggaaggaggaaggcgtgggcattcgcccctcggagctagggagtgtgtgcgacgccgctgcgaggtcacgtgagccactgccggcagagagggaaaggggcggggcccagaacgaagcggggaggcgccccttgtttccctggggtcacgcgcagccggaagtggcggctgctgcggagaattggagatggggaccgccctggacatcaagattaaaagagcgaataaagtttatcacgccggggaagtgctctctggcgtggtggtcatatcgagtaaggattcagtccaacaccagggagtgtctttgaccatggaaggaactgtaaacctccagctcagtgccaaaagtgtgggtgtgtttgaagctttttataattctgttaagcctatccagattatcaacagcaccatagaaatggtgaagccggggaaatttcccagcggcaaaacagaaatcccttttgaatttcctctgcacttgaagggtaacaaagttctgtatgagacgtatcatggcgtgtttgtcaacattcagtatacactgcgctgtgacatgaagcggtctctgttggccaaggacttgacaaagacctgtgaatttatcgttcactccgctcctcagaaggggaagtttactcccagtcccgtggacttcacgattacacctgaaaccttacagaacgtcaaagagagagctttgcttcccaaatttctccttcgaacatctcaactcaacaaactgtgtcatcacgcagccactaacgggagagctggtggtggagagctcggaagccgccatcagaagcgtggagctgcagctggtgcgcgtggagacgtgcgggtgtgcagatatgcccgcgacgccacggagattcagaacattcagatcgccgacggggatgtgtgcaggggcctctctgtccccatctacatggtcttccctaggctgttcacctgccctacactggagaccaccaacttcaaagtggaatttgaggttaacatcgtggtgctgcttcaccctgaccacctcatcacggagaacttcccgctgaagctctgcaggatatagcccggaggagggaagcatagagaacgggagtggccatctggaaatccagctggttatccaaatcctaaggggagctacagccagcggcatatacttgtttttgtgattattctgtatcagaaatgaaacagaccctcaaattaactttccttcctcatttcttgaggcttctgcttccaacaggcacctctaatcagaccttttctttgaaattcaacaagatttcttaatgctatttgccaagaccatttcacagaaaacattgactgtggctcttgccttatctgttcctttttaggtacagtaaaacaattgtgacagcagtttgagcttgctggagagtggcatcatggggacaaaaggaaacctctgacttgctaatggatgtagccagggactccccatagcaaagggtctgtggccagttgacatccaggatggctgcaagcgcacttgatggtcaggaagtttgcagatactcgccaaggcagagcgcaaagtgctagccactggaaatgcatgacttccctccacccctactctattctgtagttttttggttttgtttctgagacggagtctcagtctgtcacccaggctggagtgatctcagctcactgcaacctccacctcccaggttcaagcgactctcctgcctcagcctcccgagtagttgggattacaggtgactgccaccgtgcccggctaatgtttgtatttttagtagagacggggcttcaccatcttggccaggctggtcttgaactcctgacctcgtgacccacccgccttggcctcccaaagtgctgggattacaggtgtgagccaccacacccagcctctgtagttctttttacaacatttttcattataactttaaattttttaagcaactggaaaagtgttccttgctctcttggggggatttggctggtgccgaagtgtttctgaagtctcaagaactgccataaaatctcacgctgccatttccctgaacagatacatacatagagagagacagttttccaaactgtgtcacgcaggctgagtgcactggcaggatcacagctcacggcagcctcaacctccctggctcaagcgatccctcccctcagcctcctgagtagctgagactacaggtgagtgccaccacactcagctaattttcaaattttttgtagacagggtctccctatgttgcccaggctggtcttgaactcctagactcaagtgatcctcctgtcttggcctcccaaagtgctgagattacaggtgtgagccactgtgcccagcagtttcccagaatatatttaaatgcaaagttacatgaggggaaaacatgtatgtttgctcctgttgttactgggtaggttctgaacagcagaaacccatgtgcagggtgggctggtgaaggcccctctccgcaaggtggtagcaggaaaaggtccttgacttgatgaatttggtctgcctctgagccactggaggaagctgttttgagccagggttttttggcctaaagccagcatttcctcagtctccctttgtggttcgaaggatatggactattgcaatacatttcttccttcaaatcctgccactgttttgttggcccacaactaataggacctcaaaataagccatgctgctttgcacacacactagccttcttttgtacttttcattctggatgggcttggccaaaacaggctcaggccaaagacctcccaagctgtatgtacttccagtatcctgaaacagtgtttggtgacataatgccaagggtaaacaagcctgatttaggcactgctttatccaggggcttcacccatgaaattaataaaacttatctgagtcacttgaaacttggttcccagaaaacacatttctggtttataatctccttttatgctcacctgacattaattatctatccttgatgatgtgtttaaactgagtagcagaaaacagaggccacactttctgggaaattttaaaggaagaaaccatttttaatgagatgaaaatatttaacgaatttaaaaagctaatgacaattttgagaaaaggtttgggatgtatattgctatgtaatttaataaactgattttatggat

SEQ ID NO: 8803 - DNA, 3256 bp, Homo sapiens
ggggtgaaccgtgacagcgcttcggcccgcactaaggccggctcttgtgccggaaggaggaaggcgtgggcattcgcccctcggagctagggagtgtgtgcgacgccgctgcgaggtcacgtgagccactgccggcagagagggaaaggggcggggcccagaacgaagcggggaggcgccccttgtttccctggggtcacgcgcagccggaagtggcggctgctgcggagaattggagatggggaccgccctggacatcaagattaaaagagcgaataaagtttatcacgccggggaagtgctctctggcgtggtggtcatatcgagtaaggattcagtccaacaccagggagtgtctttgaccatggaaggaactgtaaacctccagctcagtgccaaaagtgtgggtgtgtttgaagctttttataattctgttaagcctatccagattatcaacagcaccatagaaatggtgaagccggggaaatttcccagcggcaaaacagaaatcccttttgaatttcctctgcacttgaagggtaacaaagttctgtatgagacgtatcatggcgtgtttgtcaacattcagtatacactgcgctgtgacatgaagcggtctctgttggccaaggacttgacaaagacctgtgaatttatcgttcactccgctcctcagaaggggaagtttactcccagtcccgtggacttcacgattacacctgaaaccttacagaacgtcaaagagagagctttgcttcccaaatttctccttcgaggacatctcaactcaacaaactgtgtcatcacgcagccactaacgggagagctggtggtggagagctcggaagccgccatcagaagcgtggagctgcagctggtgcgcgtggagacgtgcgggtgtgcagaaggctatgcccgcgacgccacggagattcagaacattcagatcgccgacggggatgtgtgcaggggcctctctgtccccatctacatggtcttccctaggctgttcacctgccctacactggagaccaccaacttcaaagtggaatttgaggttaacatcgtggtgctgcttcaccctgaccacctcatcacggagaacttcccgctgaagctctgcaggatatagcccggaggagggaagcatagagaacgggagtggccatctggaaatccagctggttatccaaatcctaaggggagctacagccagcggcatatacttgtttttgtgattattctgtatcagaaatgaaacagaccctcaaattaactttccttcctcatttcttgaggcttctgcttccaacaggcacctctaatcagaccttttctttgaaattcaacaagatttcttaatgctatttgccaagaccatttcacagaaaacattgactgtggctcttgccttatctgttcctttttaggtacagtaaaacaattgtgacagcagtttgagcttgctggagagtggcatcatggggacaaaaggaaacctctgacttgctaatggatgtagccagggactccccatagcaaagggtctgtggccagttgacatccaggatggctgcaagcgcacttgatggtcaggaagtttgcagatactcgccaaggcagagcgcaaagtgctagccactggaaatgcatgacttccctccacccctactctattctgtagttttttggttttgtttctgagacggagtctcagtctgtcacccaggctggagtgatctcagctcactgcaacctccacctcccaggttcaagcgactctcctgcctcagcctcccgagtagttgggattacaggtgactgccaccgtgcccggctaatgtttgtatttttagtagagacggggcttcaccatcttggccaggctggtcttgaactcctgacctcgtgacccacccgccttggcctcccaaagtgctgggattacaggtgtgagccaccacacccagcctctgtagttctttttacaacatttttcattataactttaaattttttaagcaactggaaaagtgttccttgctctcttggggggatttggctggtgccgaagtgtttctgaagtctcaagaactgccataaaatctcacgctgccatttccctgaacagatacatacatagagagagacagttttccaaactgtgtcacgcaggctgagtgcactggcaggatcacagctcacggcagcctcaacctccctggctcaagcgatccctcccctcagcctcctgagtagctgagactacaggtgagtgccaccacactcagctaattttcaaattttttgtagacagggtctccctatgttgcccaggctggtcttgaactcctagactcaagtgatcctcctgtcttggcctcccaaagtgctgagattacaggtgtgagccactgtgcccagcagtttcccagaatatatttaaatgcaaagttacatgaggggaaaacatgtatgtttgctcctgttgttactgggtaggttctgaacagcagaaacccatgtgcagggtgggctggtgaaggcccctctccgcaaggtggtagcaggaaaaggtccttgacttgatgaatttggtctgcctctgagccactggaggaagctgttttgagccagggttttttggcctaaagccagcatttcctcagtctccctttgtggttcgaaggatatggactattgcaatacatttcttccttcaaatcctgccactgttttgttggcccacaactaataggacctcaaaataagccatgctgctttgcacacacactagccttcttttgtacttttcattctggatgggcttggccaaaacaggctcaggccaaagacctcccaagctgtatgtacttccagtatcctgaaacagtgtttggtgacataatgccaagggtaaacaagcctgatttaggcactgctttatccaggggcttcacccatgaaattaataaaacttatctgagtcacttgaaacttggttcccagaaaacacatttctggtttataatctccttttatgctcacctgacattaattatctatccttgatgatgtgtttaaactgagtagcagaaaacagaggccacactttctgggaaattttaaaggaagaaaccatttttaatgagatgaaaatatttaacgaatttaaaaagctaatgacaattttgagaaaaggtttgggatgtatattgctatgtaatttaataaactgattttatggatataaata

SEQ ID NO: 8804 - DNA, 821 bp, Homo sapiens
cttgtttccctggggtcacgcgcagccggaagtggcggctgctgcggagaattggagatggggaccgccctggacatcaagattaaaagagcgaataaagtttatcacgccgggcctcagaaggggaagtttactcccagtcccgtggacttcacgattacacctgaaaccttacagaacgtcaaagagagagctttgcttcccaaatttctccttcgaggacatctcaactcaacaaactgtgtcatcacgcagccactaacgggagagctggtggtggagagctcggaagccgccatcagaagcgtggagctgcagctggtgcgcgtggagacgtgcgggtgtgcagaaggctatgcccgcgacgccacggagattcagaacattcagatcgccgacggggatgtgtgcaggggcctctctgtccccatctacatggtcttccctaggctgttcacctgccctacactggagaccaccaacttcaaagtggaatttgaggttaacatcgtggtgctgcttcaccctgaccacctcatcacggagaacttcccgctgaagctctgcaggatatagcccggaggagggaagcatagagaacgggagtggccatctggaaatccagctggttatccaaatcctaaggggagctacagccagcggcatatacttgtttttgtgattattctgtatcagaaatgaaacagaccctcaaattaactttccttcctcatttcttgaggcttctgcttccaacaggcacctctaatcagaccttttctttgaaattcaacaagatttcttaatgctatttgccaaga

SEQ ID NO: 8805 - DNA, 937 bp, Homo sapiens
ttccctggggtcacgcgcagccggaagtggcggctgctgcggagaattggagatggggaccgccctggacatcaagattaaaagagcgaataaagtttatcacgccggggaagtgctctctggcgtggtggtcatatcgagtaaggattcagtccaacaccagggagtgtctttgaccatggaaggaactgtaaacctccagctcagtgccaaaagtgtgggtgtgtttgaagctttttataattctgttaagcctatccagattatcaacagcaccatagaaatggtgaagccggggaaatttcccagcggcaaaacagaaatcccttttgaatttcctctgcacttgaagggtaacaaagttctgtatgagacgtatcatggcgtgtttgtcaacattcagcctcagaaggggaagtttactcccagtcccgtggacttcacgattacacctgaaaccttacagaacgtcaaagagagagctttgcttcccaaatttctccttcgaggacatctcaactcaacaaactgtgtcatcacgcagccactaacgggagagctggtggtggagagctcggaagccgccatcagaagcgtggagctgcagctggtgcgcgtggagacgtgcgggtgtgcagaaggctatgcccgcgacgccacggagattcagaacattcagatcgccgacggggatgtgtgcaggggcctctctgtccccatctacatggtcttccctaggctgttcacctgccctacactggagaccaccaacttcaaagtggaatttgaggttaacatcgtggtgctgcttcaccctgaccacctcatcacggagaacttcccgctgaagctctgcaggatatagcccggaggagggaagcatagagaacgggagtggccatctggaaatccagctggttatccaaatcctaagggg

SEQ ID NO: 8806 - DNA, 980 bp, Homo sapiens
aagtggcggctgctgcggagaattggagatggggaccgccctggacatcaagattaaaagagcgaataaagtttatcacgccggggaagtgctctctggcgtggtggtcatatcgagtaaggattcagtccaacaccagggagtgtctttgaccatggaaggaactgtaaacctccagctcagtgccaaaagtgtgggtgtgtttgaagctttttataattctgttaagcctcagaaggggaagtttactcccagtcccgtggacttcacgattacacctgaaaccttacagaacgtcaaagagagagctttgcttcccaaatttctccttcgaggacatctcaactcaacaaactgtgtcatcacgcagccactaacgggagagctggtggtggagagctcggaagccgccatcagaagcgtggagctgcagctggtgcgcgtggagacgtgcgggtgtgcagaaggctatgcccgcgacgccacggagattcagaacattcagatcgccgacggggatgtgtgcaggggcctctctgtccccatctacatggtcttccctaggctgttcacctgccctacactggagaccaccaacttcaaagtggaatttgaggttaacatcgtggtgctgcttcaccctgaccacctcatcacggagaacttcccgctgaagctctgcaggatatagcccggaggagggaagcatagagaacgggagtggccatctggaaatccagctggttatccaaatcctaaggggagctacagccagcggcatatacttgtttttgtgattattctgtatcagaaatgaaacagaccctcaaattaactttccttcctcatttcttgaggcttctgcttccaacaggcacctctaatcagaccttttctttgaaattcaacaagatttcttaatgctatttgccaagaccatttcacagaaaacattgactgtggctcttgccttatctgtt

SEQ ID NO: 8807 - DNA, 1098 bp, Homo sapiens
cagtcacgggccagcctttcccttaaggatgtctgagagctggtctcctcactcttttcttccgcctattaaactttccgcttcttaactcacccatgtgtgtccatgtcgttaatcatcttgacgagagatgatgaaccccggatatttaccccagacagtgatgccgcttcaccagcattgcactctacttccccgcttcctgatcctgcctcagcttctcctctccacagagaagaaaaaattctgcctaaagtctgcaacatcgtttcctgcctgagtttcagcctgccagcttctcctacggattctggacttgccagccccacaatcataaccagagaggggcagcaattttgggcaaaatgtctgatttggaaataccaactttacctccatgggctccacaagaaatcagatgggagaagggacaagcagataagcgcaagcccatcaacctgaaggcataaaccacatccagccacctccttctgatcagcagcaaagctgacgttttgatctccatctgtctgattcttgtgtctacttctcagtttacaactccagtgggaaagaaagagctttatttacagacccataaaaatcccatcagtgtcgtcccctgctgagaggccatgtgagaccatatggaaaaacaacagccataatggcagcatggcagtggaagggtttgtcttgtgcccaggccttgcggtcatgcaagtttcttgtggatcctgttgggaccagccactcaccaaggctgagtaggtccacaaataatggggactttctaccagactcacagagaactgctgggtttttgggaagggtgtgcgtgtctttggggcatgcaagttggggttatagtggagacccagaggatgagaaaacttctctgcctcagcagaagagtggcagctgagagagaggcaagaaactcgcacccactgtggactggggcagagagattttgaggagaatgaaatccagaaactctgtgtggtattagtttgtatccagagggtgaccctcttctcaaggaaatgggtgtcatcaattttctacactattaaagatataaagttcttggcatta

SEQ ID NO: 8808 - DNA, 2235 bp, Homo sapiens
ctccgacccgggcttttccttcgtaccctgcggccccctccgcacccctcacggagctcctcgggtcctgccccctcccagcgcttgcccgcgccgccccgcccccgtttttaaacctggcgcgcgggtaggtgagcgcgttagcccgagtggatctaggcgcgctcgtaggccggcgccgcagcaaggggcgcgggctccgccggcaccatggagcccgaagcggcggccggagcccggaaggcgcgggggcgcggctgtcactgccccggggacgctccctggaggcctccgccaccgcgcgggccggagagccccgcgccgtggcgaccttggatccagacacctggagatgctgagctgaccagaactggaaggccgcttgaacctagggctgaccaacacacttttggatcaaagggagcctttgggtttcagcatcctgtaagagtctatttacccatgtcaaagcgtcaagaatacctgcggagttccggggagcaagtactggccagtttcccagtgcaagccacgattgacttctacgacgatgagtctactgagtctgcttccgaagctgaagagccagaggaaggacccccacccctccatcttctgccccaggaggtgggaggtcggcaggaaaatggcccagggggaaagggcagagaccagggcatcaaccaagggcagcgatcctcaggagggggtgaccactggggggagggtccgctccctcaaggtgtctcctcaaggggtggcaagtgctcctcatccaaatgaatcagtctctgtctcctgggccctgctctgggacctgcccctcacgttctcttggggacacccgagccaggacactacgcatccctgctgagtgtgcagaggctagaggcttctcgggcagcccctggcctgcacactactcatgacagaaagtcagcttttacttttctttcccctggcaattcgtttttggtgcactcatgcatgcctttgagaaaggattctaggagaaagagaaggtctatgtcaacagagttgttatctcatagagccagttttcaaagctccttctgcattgtcactcactgatcaggtgatgaattcttcctagatagtcgcccactccacctcctacttaacctgagactcattatttagctatttctgcttttgtaaaaataattcagatattaaactccaattttaatctatcatccaagggtagatgtagttgcttagtagcattttggaaaaaaaagaaaaaaaggtttggtttggttttgtgacggagttttgctcttgtctcccaggctggagtgcagtgacacaatctcggctcactgcaacctccacttcttgggttcaagtgattctcctgtctcagcctcccaagtagctgggattacaggcatgagctaccacgcctggctaattttttgtatttttagtagagactcggtttcaccatgttggtcaggctggctttgaactcctgacctcaggtgatccacccgccttggcctcccaaagtgctgggattacaggcgtgagccactgagcccggccaaaaaaaaatgtatttattaaaaaaaaatttttttaacccgccgaataattcccataagagtaacaaaaaggaccagcctgaccaacgtggagaaactctgtctctactaaaaatacaaaattagccaggcgtgatggctcatgcctgtaatcccagctactcgggaggctgaggcaggagaatggctagaacccgggaggcggaggttgccgtgagtcgagatcgcaccattgcattccagcctgggcaacaagagcgaaactccgtctcaaaaaaaaaaaaaaaaaaaaagaaagaaaagagtaacagaaagatagggatttttaggagacaattagataaaaatgtatgtgatgactgtataaggaggcctgtgtgtatgaatttatagggagtagaaccgtctctcttcttagttggtgactgtttggggcctggtattttaatagatgaacactacttttttaattttttatttttttaaccctacccttaacccatgaacactatttttaattaaagtatctgatgtaaaattattttgagtttttaatattttgataaacgtgtattcctgaaactttttgacttacttatcttacatgtggtgtcttcctgtatatagtacattatatcaatttctacttgaaataaatattttgaaa

SEQ ID NO: 8809 - DNA, 552 bp, Homo sapiens
accccaccctaatcttgttatgcaaataggcttcccacttggcaggggccgtcttgtccactcgtttctgtaaacatgggtggcaaaaagagaagatggagctgccatttagaacatgcctaatcccagcttcatcttgctgagcaaaaatgaaggagcctggacccaactttgttactgtgagaaagggtcttcattcattcaagatggcatttgttaagcacctacttctctttctgtcacctaggctggagtgcagtggttcaatcacggatcactgcagcctccacctcccagttcaagaaattctcatgtctcagcctcctgagcagctaggattacagacaaaccttggaaatcaagaaagttctggaatgatgaagctgttcatgccaagaccgaaagtgctggcccagtatgagtccattcagttcatgccgtgacaattttcttggaactcctttttattgttagttctcacttgtttccatatttagtgaatgtacatttaattgcaaagctgtcattaataaaaattcttatagtacctca

SEQ ID NO: 8810 - DNA, 534 bp, Homo sapiens
accccaccctaatcttgttatgcaaataggcttcccacttggcaggggccgtcttgtccactcgtttctgtaaacatgggtggcaaaaagagaagatggagctgccatttagaacatgcctaatcccagcttcatcttgctgagcaaaaatgaaggagcctggacccaactttgttactgtgagaaagggtcttcattcattcaagatggcatttgttaagcacctactgctggagtgcagtggttcaatcacggatcactgcagcctccacctcccagttcaagaaattctcatgtctcagcctcctgagcagctaggattacagacaaaccttggaaatcaagaaagttctggaatgatgaagctgttcatgccaagaccgaaagtgctggcccagtatgagtccattcagttcatgccgtgacaattttcttggaactcctttttattgttagttctcacttgtttccatatttagtgaatgtacatttaattgcaaagctgtcattaataaaaattcttatagtacctca

SEQ ID NO: 8811 - DNA, 1647 bp, Homo sapiens
aaaccttccctggcatctggagggaccaccgttgccgcgtcttcggcttccacgatctgcgttcgggctacgcggccacggcggcagccactgcgactcccactgtgcctggctctgtccatattagttcccaggcggccgtcgccgttccagcagcggcagcggcagcggcagcggcggacatgttgtgaggcggcggcgcgggtgtctgaaggatggtttggccgaggcggcggcaacggctgctggcggcggcgacagcgcccgcccctctgaggagacacgaaggtggttccccagccgctcaaatttccggaccaccgcgctttcccctcctcagcctgggctgtgctctctctagaatcctcgggcccccactttcttcccaaactcatcctaaatctctcacacacgcgagtgttcccagccctcaagccagctgctcctccgttcattttctgcaccctcttcgcaaagcaccccccgggatcactctccgagggcgactttttgagaaatctcggtggagtagtggaccagagctggggagtttttaaaagccggggcgcgagaaacaggaaggtactatggcttcctcgtctggcaacgatgatgatctcactatccccagagctgctatcaataaaatgatcaaagagactcttcctaatgtccgggtggccaacgatgctcgagagctggtggtgaactgctgcactgaattcattcaccttatatcttctgaagccaatgagatttgtaacaaatcggaaaagaagaccatctcaccagagcatgtcatacaagcactagaaagtttgggatttggctcttacatcagtgaagtaaaagaagtcttgcaagagtgtaaaacagtagcattaaaaagaagaaaggccagttctcgtttggaaaaccttggcattcctgaagaagagttattgagacagcaacaagaattatttgcaaaagctagacagcaacaagcagaattggcccaacaggaatggcttcaaatgcagcaagctgcccaacaagcccagcttgctgctgcctcagccagtgcatctaatcaggcgggatcttctcaggatgaagaagatgatgatgatatctgaaattcaccagctgagtttctatttcttctataaatgtttttccctgcacaacaaaaacagtgaaagaaatgcttatctgtaattttgtatgcatcttggtggacttgtcattggtattctagggatgtctgctattaagtttcatctattgtgtgctatacatgtaaaaactgtctctttgaactattgaaaatttaaggttcagtataatatcaattttgaatttttaatggtgtttatgaaattttagatagcagcgagtccttcgtttgatcaataaacagtgttacagataacttcaagtttataaaaatacagtgaaatttctacaaagctctaaatctgcatttgcatttcctctgcccttttaactaaactaaaacttgtgaattttaaattattaaggggggggtgctgtgtgaatcagtagacattggattgggttggtgaaagagttcagttctgtagtatctgaatttgtcttttaaaatgagtacatatataggcaataaatatatatgctcagatc

SEQ ID NO: 8812 - DNA, 3242 bp, Homo sapiens
gaacgaggcttccggtggcgcaaagggtgtcgggagcggcttcctgcaaaccttccctggcatctggagggaccaccgttgccgcgtcttcggcttccacgatctgcgttcgggctacgcggccacggcggcagccactgcgactcccactgtgcctggctctgtccatattagttcccaggcggccgtcgccgttccagcagcggcagcggcagcggcagcggcggacatgttgtgaggcggcggcgcgggtgtctgaaggatggtttggccgaggcggcggcaacggctgctggcggcggcggcagcggcagcggggcctcgggctctatagagccgagcccgctgggtacccgcccggtaccgcggcgaggccagtgcccctggatcttgcctctgctccgacgccgttggggaccagttaggcgacagcgcccgcccctctgaggagacacgaaggtggttccccagccgctcaaatttccggaccaccgcgctttcccctcctcagcctgggctgtgctctctctagaatcctcgggcccccactttcttcccaaactcatcctaaatctctcacacacgcgagtgttcccagccctcaagccagctgctcctccgttcattttctgcaccctcttcgcaaagcaccccccgggatcactctccgagggcgactttttgagaaatctcggtggagtagtggaccagagctggggagtttttaaaagccggggcgcgagaaacaggaaggtactatggcttcctcgtctggcaacgatgatgatctcactatccccagagctgctatcaataaaatgatcaaagagactcttcctaatgtccgggtggccaacgatgctcgagagctggtggtgaactgctgcactgaattcattcaccttatatcttctgaagccaatgagatttgtaacaaatcggaaaagaagaccatctcaccagagcatgtcatacaagcactagaaagtttgggatttggctcttacatcagtgaagtaaaagaagtcttgcaagagtgtaaaacagtagcattaaaaagaagaaaggccagttctcgtttggaaaaccttggcattcctgaagaagagttattgagacagcaacaagaattatttgcaaaagctagacagcaacaagcagaattggcccaacaggaatggcttcaaatgcagcaagctgcccaacaagcccagcttgctgctgcctcagccagtgcatctaatcaggcgggatcttctcaggatgaagaagatgatgatgatatctgaaattcaccagctgagtttctatttcttctataaatgtttttccctgcacaacaaaaacagtgaaagaaatgcttatctgtaattttgtatgcatcttggtggacttgtcattggtattctagggatgtctgctattaagtttcatctattgtgtgctatacatgtaaaaactgtctctttgaactattgaaaatttaaggttcagtataatatcaattttgaatttttaatggtgtttatgaaattttagatagcagcgagtccttcgtttgatcaataaacagtgttacagataacttcaagtttataaaaatacagtgaaatttctacaaagctctaaatctgcatttgcatttcctctgcccttttaactaaactaaaacttgtgaattttaaattattaaggggggggtgctgtgtgaatcagtagacattggattgggttggtgaaagagttcagttctgtagtatctgaatttgtcttttaaaatgagtacatatataggcaataaatatatatgctcagatcaatatacttgtttagaaaaacttcaagacattcaaaaactaggaaggagtatgtttaatagtatttgtataaatttggtggttatgtttttttattttgtttctgttttgtgtagaggtaaaaactatagttttattacagcataattcattttgagctccactatgacatttcaaagactgcccagtttggaagtctgtcatgatttttactctttcactccaattcagtaattgttgatagtattacttacctagtccatccatactcatattattcaaatatataggtggtacttttgaaacaattacattggttctcttggtttaactgaggtttatgaatattcaaacctttgctgggggaaagaaatgaaagttaatgagcatgcttgctatgagagagggatttttaatttaacttgtagttatagtttacttattgtttttagaattacttttacattttcccaactagatggcctagagtccaacattaccttttgagatgacattattgtctccataattgagtgatagctttaaaaaaaagattagttttgcttaagaagttatgttacaactgatcagccctatatgaattaactgatcagccctatatgaaacataagttgtgttataacttatcagccgtatatggaacataaatagtttctacctgcttgttagagaagctttaatttggttctaataaatacagtatggtagtgtttataggaatccaggatgttgaagaaatggcataatgtctatattttggaaacagaaaggaaaagtcacttaagatagtattaagtaattaaattcctatgtcagttgccaaatcttttaaacttatgtattcaccaagcccaaaaatagattgtggctcccaggattccaattttaattggagagctaagtaagtaaagttttataactgttaggtttcttaatgatcatattttgcagttttagtaaaagggaaatattgttatacatttattaaatatacttcccccatgaagtgaaaaggttaattttgctgaatgttttaagttgaagttacttcatggatgtcatacccatgaagtgcatttggatgagatagaagaaattgttttttaaaaagtttaagtaccaaaggtagtctagtctagaacgataagttaatacgtgttggcttttctaatttgtactgtaacatccttatactttctattttaagtatatctgtttcttaagtaaacaacttagatattttccacacctttttttttttttctgatgcagagttcaggttaatattttactgcatctgataatgtattatacgtttgaagcctagtgacttttcattttgacattcttgtgatttcatatgctgtattcttcaagcaataaaattgtgatgtgttttataaa

SEQ ID NO: 8813 - DNA, 2472 bp, Homo sapiens
agaaacagtagttaggatggctgaaggggatactcaccggctgaaggccgactgtgattccccctacccccacaaggcgattttgaccccctgagggctgctctagaggactcaggccccgaagctgtcccagggaggtccccgctgcatcccaccacccaagctgtgcctcatggagtcgatgtttagcagccctgccgaggcggcgctgcagcgagagaccggggtgccaggactgcttactcctcttccggacctggacggagtgtacgagctggagcgagtcgctggatttgtccgcgacctggggtgtgaacgagttgccttgcagttccctgaccagctattgggagatgctgtggctgtggctgcacgactggaggagacgacagggtcaaagatgttcattctgggtgacacagcctacggcagctgctgcgtggatgtgctgggtgctgagcaagctggagctcaggctctcatacattttggccctgcctgcttaagccctccagcccgcccactgcccgttgccttcgtgcttcgtcaacgttctgtggccttggagctctgtgtcaaggcctttgaggcccagaacccagaccccaaagcgcctgtggtgctgctgagtgagccggcctgtgcccatgccctggaggctttggctactctcctgcgcccacggtacctggacctgctagtctccagcccagcttttccccaaccagtgggttccctgagtccagagcctatgcccctagagcgttttgggcgccgcttcccccttgccccagggaggcgtctagaagagtatggtgccttctatgtagggggctctaaggccagccctgacccagaccttgacccagacctgagtcggctgctcttggggtgggcaccaggtcaacccttctcctcctgctgtccagatacagggaagactcaggatgagggtgcccgggctggacggctaagggcacgaagacgatatctggtagagagggccagagatgcccgcgtggtagggctgctggcaggcacactgggtgtagcccaacaccgtgaggcactggcccacttgcggaacctgactcaggctgctggcaagcgtagctatgtgttggccctggggcggcccacccctgccaagcttgccaacttccctgaggtggatgtctttgtgctattagcctgtcctctgggtgctctagccccccagctttctggtagcttcttccagcctatactggcaccatgtgagctggaagctgcctgcaaccctgcctggccacctccaggcctggctccccacctcacacattatgcggacttattgcctggctctcccttccacgtggctctcccaccacctgagtcagagctgtgggaaaccccagacgtgtcactcattactggagatctccgacccccacctgcctggaagtcatcaaatgatcatggaagcttggctctgaccccacggccccagctggagctggctgagagcagtcctgcagcctcattccttagttcccggagctggcaagggctggagccccgcctgggtcagacgccagtgacagaagctgtgagtggaagacgagggattgccatcgcctatgaggatgagggaagcggctgataccatgtggggctggagacatagatggacttatgaatggctgctaggacctttagtgctccctgcaccaacctcccatccccctgccaagatccttgaaggaccctggaaggagggagagcaggcagcccttcacaggataggatccgtctctgtcctgtcctggcactggcacaagctcagcacatgcccagtaatgcgtgttgtttggctgatggaataaagggcttagggacttccctgaggcctctggacccatctgtcttcctgagggcagcccaggacctttggccaatcccagttcccaggctgcagttgagggtctgtccttgtcaaaaggcaggtgctagacagtctagaccagggtttctcaaactcgtacttgacatttggggccagataattctttgttgtggggctgtctggtgtatggtagggtgctcagcagcatccctggcctctgcccactagacatcagaagcactcccccagttgtgacaaccaaaaatatctccagaccttggcaaatgttatctgtgggggaaaattgccctcaattgagaaccactggtctagctagacctgcactgtccagtacagtagccactaaatacatgtggctaaacttaaatttaagttaattaagattaaaagctcagtttctcagtcacattagtcattcaagtgttcagacagccacatgaggggacagtgcagctacaggatatgccatcatggcagaaagttctattggttggacagcgttggtctatactgactcttatttctcagggagatcacagcaacctaaataaaccagataccttttc

SEQ ID NO: 8814 - DNA, 1738 bp, Homo sapiens
tgaaggggatactcaccggctgaaggccgactgtgattccccctacccccacaaggcgattttgaccccctgagggctgctctagaggactcaggccccgaagctgtcccagggaggtccccgctgcatcccaccacccaagctgtgcctcatggagtcgatgtttagcagccctgccgaggcggcgctgcagcgagagaccggggtgccaggactgcttactcctcttccggacctggacggagtgtacgagctggagcgagtcgctggatttgtccgcgacctggggtgtgaacgagttgccttgcagttccctgaccagctattgggagatgctgtggctgtggctgcacgactggaggagacgacagggtcaaagatgttcattctgggtgacacagcctacggcagctgctgcgtggatgtgctgggtgctgagcaagctggagctcaggctctcatacattttggccctgcctgcttaagccctccagcccgcccactgcccgttgccttcgtgcttcgtcaacgttctgtggccttggagctctgtgtcaaggcctttgaggcccagaacccagaccccaaagcgcctgtggtgctgctgagtgagccggcctgtgcccatgccctgggctctcccttccacgtggctctcccaccacctgagtcagagctgtgggaaaccccagacgtgtcactcattactggagatctccgacccccacctgcctggaagtcatcaaatgatcatggaagcttggctctgaccccacggccccagctggagctggctgagagcagtcctgcagcctcattccttagttcccggagctggcaagggctggagccccgcctgggtcagacgccagtgacagaagctgtgagtggaagacgagggattgccatcgcctatgaggatgagggaagcggctgataccatgtggggctggagacatagatggacttatgaatggctgctaggacctttagtgctccctgcaccaacctcccatccccctgccaagatccttgaaggaccctggaaggagggagagcaggcagcccttcacaggataggatccgtctctgtcctgtcctggcactggcacaagctcagcacatgcccagtaatgcgtgttgtttggctgatggaataaagggcttagggacttccctgaggcctctggacccatctgtcttcctgagggcagcccaggacctttggccaatcccagttcccaggctgcagttgagggtctgtccttgtcaaaaggcaggtgctagacagtctagaccagggtttctcaaactcgtacttgacatttggggccagataattctttgttgtggggctgtctggtgtatggtagggtgctcagcagcatccctggcctctgcccactagacatcagaagcactcccccagttgtgacaaccaaaaatatctccagaccttggcaaatgttatctgtgggggaaaattgccctcaattgagaaccactggtctagctagacctgcactgtccagtacagtagccactaaatacatgtggctaaacttaaatttaagttaattaagattaaaagctcagtttctcagtcacattagtcattcaagtgttcagacagccacatgaggggacagtgcagctacaggatatgccatcatggcagaaagttctattggttggacagcgttggtctatactgactcttatttctcagggagatcac

SEQ ID NO: 8815 - DNA, 1596 bp, Homo sapiens
acagtagttaggatggctgaaggggatactcaccggctgaaggccgactgtgattccccctacccccacaaggcgattttgaccccctgagggctgctctagaggactcaggccccgaagctgtcccagggaggtccccgctgcatcccaccacccaagctgtgcctcatggagtcgatgtttagcagccctgccgaggcggcgctgcagcgagagaccggggtgccaggactgcttactcctcttccggacctggacggagtgtacgagctggagcgagtcgctggatttgtccgcgacctggggtgtgaacgagttgccttgcagttccctgaccagctattgggagatgctgtggctgtggctgcacgactggaggagacgacagggtcaaagatgttcattctgggtgacacagcctacggcagaggctttggctactctcctgcgcccacggtacctggacctgctagtctccagcccagcttttccccaaccagtgggttccctgagtccagagcctatgcccctagagcgttttgggcgccgcttcccccttgccccagggaggcgtctagaagagtatggtgccttctatgtagggggctctaaggccagccctgacccagaccttgacccagacctgagtcggctgctcttggggtgggcaccaggtcaacccttctcctcctgctgtccagatacagggaagactcaggatgagggtgcccgggctggacggctaagggcacgaagacgatatctggtagagagggccagagatgcccgcgtggtagggctgctggcaggcacactgggtgtagcccaacaccgtgaggcactggcccacttgcggaacctgactcaggctgctggcaagcgtagctatgtgttggccctggggcggcccacccctgccaagcttgccaacttccctgaggtggatgtctttgtgctattagcctgtcctctgggtgctctagccccccagctttctggtagcttcttccagcctatactggcaccatgtgagctggaagctgcctgcaaccctgcctggccacctccaggcctggctccccacctcacacattatgcggacttattgcctggctctcccttccacgtggctctcccaccacctgagtcagagctgtgggaaaccccagacgtgtcactcattactggagatctccgacccccacctgcctggaagtcatcaaatgatcatggaagcttggctctgaccccacggccccagctggagctggctgagagcagtcctgcagcctcattccttagttcccggagctggcaagggctggagccccgcctgggtcagacgccagtgacagaagctgtgagtggaagacgagggattgccatcgcctatgaggatgagggaagcggctgataccatgtggggctggagacatagatggacttatgaatggctgctaggacctttagtgctccctgcaccaacctcccatccccctgccaagatccttgaaggaccctggaaggagggagagcaggcagcccttcacaggataggatccgtctctgtcctgtcctggcactggcacaagctca

SEQ ID NO: 8816 - DNA, 3052 bp, Homo sapiens
gatgccgagcccaggccggttccggcgaagttaaaccctcggagctggcctcggactgctggggcgttaccccttcggccacccccgctgaccatggcagtgtttcatgacgaggtggaaatcgaggacttccaatatgacgaggactcggagacgtatttctatccctgcccatgtggagataacttctccatcaccaaggatcagtttgtgtgtggagaaacagtcccagccccttcagccaacaaagaattagttaaatgctgaagaagccttcaggaatccaaatcctgaacatttggaatgagcccagatagaaatatcgaatgcaaagctactggcttcacagagacaaccatttatgatttgctgttctgtaagagtgtggattctttctatcaactgctgatatcatcttcaggaagcaagtccataacatgacatatctggattttgtgcttagaaccttaaattggaagcattcttaattatgcatctaaatttaaaagaagataatttcaaaacagtgctttctttcccttggtttcatcattttcatatcttaaaccaaattacttcggtatctgacaacagcatcatctacctcagtcattaggatttcttaataaaaaagagattgtatttttgacttggttattaagattattaaaattagcccttcctttgaaatatgacatcagctttgctgttctaaatttaaaattagttgcttcatcagtaccacacttccagtttctataccaagccagtctcctcagttttcccattagaatggacatgttctgttcagcgtgtcatttctgtaatgcttcatgcagagagtttggtcatagtattaaagagaaaatacagtgaggtcacaatgtctccagagctaaaagttagtgaacaagaaagaaagtccaaaatgaagtgatgaaagaatgaggacttttcttatattctgcatattccttggaagtcaggacaagatgaaaagaaaaacatccaaaagaagtgaaattggtgacagaatgagaggagcaaagcataccagtgtagtaagtggaatgtttgaatgactttgccaggtcagagcaagtaatatttctgtatctgagtttttgtttgtgttttgataaggctaatgaaattgcattccaggtaggggttaacgtcaaatttccatggctggtagctgtgcttttggcatatcacagtgttgtgtcactactacaaggtaaagcatctacagcggagaatgagcttgaaaatgagagacctattgtgaataaatatgcccatgagagcatatttaataagcctctataacatgcagccaaaccagacattcactcctgcagagaaatgttgccctggagaaaaagaaatatataaagataggctatcacccttcttttgctgcagtactaagcatagcaagaaattagaatcatttacattggaaatttgaaaattccctttatatacacaactttactgtgtataaataaaaaatatttattaatgcagtgatgtccgtcaggttgttttaggaatggcttctgcaattagaaaaatagcttgctagaatgtaaatgttctgttactggtaaatgtactgcacacattcattggacgttaaaacaagtgagtagccttttttacctgccagcagcatggctgtgtgcagccactaggctgagacaataaattaccaaaaattataatgtaccgagctgaaaatgctcagtacattatgtggcatattctggatgtgatgagaaatctcattgccatttgggacactgacatcccagaagtaatccacaactgctttgcaaaagcaaagtgactgctcagatgaacagagcagagtactcactcactatggtggcatcagctgcaaagcaaaatgaactgtcccatgatcatgttgatggttttctagatactgccaacatgttagctctttctgatgctgatgagtttcaaacacgaacagacacccttgatgtgggtttgctaagaacatagaagaacaggaagaaaagttgccaggttcacacatcccaggaaaaaagaagcataaaaagcattagcagtcagtgactgatgataatgctgcaataatgggaatggttttgtttctaaaccaaattatttctaaatcaaatcatttattgctttgtttctaaagcaattgagtcactaagtttgtgaactgtaggagaacacatcaagattgaatcctgtgttaagcagaaggtaaaaccagagccaggcgcagtggctcgtgcctgtaatcccagctactcaggaagctaaggcaggaggatcatgtgaggccaggagttcaagactagcctgggcaacatagaaagaccctgtctctaaaaaatcttcttttaattagcaaggtgtggggccttgagcaaattgcttgggcccaggagtttgaggctgtggtgagctgtgatcacaccactgcgttccagcctgtgtgacagggcaagacctcatgcctaaaaaataaagagaaagcagagtaaaactggactctgagatacgactaaagttctgtgtgatacgtgtgccttatttagctcaagacattcctggagcacctataaaaactgacttgtaatccaggctatgtctctttttagcttcgtaatctttggcaaggccattggattcttcagctgtacaattaggagactcgatcaggtgattgcctttctcagctgtcagttctctaatttcaggcttggtagcttgtaggaactgaaattgcaattaaaacctttataaactcaaactaaatcatgaattacagaaaaagtccattcttccaaaacttgatgttaccacacttacaagtttaaaatatgaagtcgactgtttaaaggattctgcatatattctagtgtgcacattcagaaacatttttcttggaaaaagtacccaacattttttataactgcacatattaatttattgccagaataaattgcattgcatgctaaataaagtcagataattcaaatcc

SEQ ID NO: 8817 - DNA, 3131 bp, Homo sapiens
gatgatgccgagcccaggccggttccggcgaagttaaaccctcggagctggcctcggactgctggggcgttaccccttcggccacccccgctgaccatggcagtgtttcatgacgaggtggaaatcgaggacttccaatatgacgaggactcggagacgtatttctatccctgcccatgtggagataacttctccatcaccaaggaagatttggagaatggggaagacgtggcaacgtgtcctagctgctctctcattataaaagtgatttatgacaaagatcagtttgtgtgtggagaaacagtcccagccccttcagccaacaaagaattagttaaatgctgaagaagccttcaggaatccaaatcctgaacatttggaatgagcccagatagaaatatcgaatgcaaagctactggcttcacagagacaaccatttatgatttgctgttctgtaagagtgtggattctttctatcaactgctgatatcatcttcaggaagcaagtccataacatgacatatctggattttgtgcttagaaccttaaattggaagcattcttaattatgcatctaaatttaaaagaagataatttcaaaacagtgctttctttcccttggtttcatcattttcatatcttaaaccaaattacttcggtatctgacaacagcatcatctacctcagtcattaggatttcttaataaaaaagagattgtatttttgacttggttattaagattattaaaattagcccttcctttgaaatatgacatcagctttgctgttctaaatttaaaattagttgcttcatcagtaccacacttccagtttctataccaagccagtctcctcagttttcccattagaatggacatgttctgttcagcgtgtcatttctgtaatgcttcatgcagagagtttggtcatagtattaaagagaaaatacagtgaggtcacaatgtctccagagctaaaagttagtgaacaagaaagaaagtccaaaatgaagtgatgaaagaatgaggacttttcttatattctgcatattccttggaagtcaggacaagatgaaaagaaaaacatccaaaagaagtgaaattggtgacagaatgagaggagcaaagcataccagtgtagtaagtggaatgtttgaatgactttgccaggtcagagcaagtaatatttctgtatctgagtttttgtttgtgttttgataaggctaatgaaattgcattccaggtaggggttaacgtcaaatttccatggctggtagctgtgcttttggcatatcacagtgttgtgtcactactacaaggtaaagcatctacagcggagaatgagcttgaaaatgagagacctattgtgaataaatatgcccatgagagcatatttaataagcctctataacatgcagccaaaccagacattcactcctgcagagaaatgttgccctggagaaaaagaaatatataaagataggctatcacccttcttttgctgcagtactaagcatagcaagaaattagaatcatttacattggaaatttgaaaattccctttatatacacaactttactgtgtataaataaaaaatatttattaatgcagtgatgtccgtcaggttgttttaggaatggcttctgcaattagaaaaatagcttgctagaatgtaaatgttctgttactggtaaatgtactgcacacattcattggacgttaaaacaagtgagtagccttttttacctgccagcagcatggctgtgtgcagccactaggctgagacaataaattaccaaaaattataatgtaccgagctgaaaatgctcagtacattatgtggcatattctggatgtgatgagaaatctcattgccatttgggacactgacatcccagaagtaatccacaactgctttgcaaaagcaaagtgactgctcagatgaacagagcagagtactcactcactatggtggcatcagctgcaaagcaaaatgaactgtcccatgatcatgttgatggttttctagatactgccaacatgttagctctttctgatgctgatgagtttcaaacacgaacagacacccttgatgtgggtttgctaagaacatagaagaacaggaagaaaagttgccaggttcacacatcccaggaaaaaagaagcataaaaagcattagcagtcagtgactgatgataatgctgcaataatgggaatggttttgtttctaaaccaaattatttctaaatcaaatcatttattgctttgtttctaaagcaattgagtcactaagtttgtgaactgtaggagaacacatcaagattgaatcctgtgttaagcagaaggtaaaaccagagccaggcgcagtggctcgtgcctgtaatcccagctactcaggaagctaaggcaggaggatcatgtgaggccaggagttcaagactagcctgggcaacatagaaagaccctgtctctaaaaaatcttcttttaattagcaaggtgtggggccttgagcaaattgcttgggcccaggagtttgaggctgtggtgagctgtgatcacaccactgcgttccagcctgtgtgacagggcaagacctcatgcctaaaaaataaagagaaagcagagtaaaactggactctgagatacgactaaagttctgtgtgatacgtgtgccttatttagctcaagacattcctggagcacctataaaaactgacttgtaatccaggctatgtctctttttagcttcgtaatctttggcaaggccattggattcttcagctgtacaattaggagactcgatcaggtgattgcctttctcagctgtcagttctctaatttcaggcttggtagcttgtaggaactgaaattgcaattaaaacctttataaactcaaactaaatcatgaattacagaaaaagtccattcttccaaaacttgatgttaccacacttacaagtttaaaatatgaagtcgactgtttaaaggattctgcatatattctagtgtgcacattcagaaacatttttcttggaaaaagtacccaacattttttataactgcacatattaatttattgccagaataaattgcattgcatgctaaataaagtcagataattcaaatcca

SEQ ID NO: 8818 - DNA, 1143 bp, Homo sapiens
cgcttttgcagttgcttctgcggaaaggtggtagttaagaatttgtaaaggccagagaactacctacgattctctcagcggtctctcttctcctcaagtttgaaatgctttatctcatcgggttgggcctgggagatgccaaggacatcacagtcaagggcctggaagttgttagacgctgcagtcgagtgtatctggaagcctacacctcagtcctaactgtagggaaggaagccttggaagagttttatggaagaaaattggttgttgctgatagagaagaagtggaacaagaagcagataatattttaaaggatgctgatatcagtgatgttgcattccttgtggttggtgatccatttggggccacaacacacagtgatcttgttctaagagcaacaaagctgggaattccttatagagttattcacaatgcctccataatgaatgctgtaggctgctgtggtttacagttatataagtttggagagacagtttctattgttttttggacagacacttggagaccagaaagcttctttgacaaagtgaagaagaacagacaaaatggcatgcacacattatgtttactagacatcaaagtaaaggagcagtctttggaaaatctaatcaagggaaggaagatctatgaacctccacggtatatgagtgtaaaccaagcagcccagcagcttctggagattgttcaaaatcaaagaatacgaggagaagaaccagttaccgaggagacactttgtgttggcttagccagggttggagccgacgaccagaaaattgcagcaggcactttaaggcaaatgtgcactgtggacttgggagaaccattgcattccttgatcatcacaggaggcagcatacatccaatggagatggagatgctaagtctgttttccataccagaaaatagctcagaatctcaaagcatcaatggactttgaacatagatatttaccattgtctgatgtaaatttcagccatatatggattgatatggtttggatgtatccccacccaagtctcatcttgaattttaatcctcataattcccaggtgttgtggtaggtaattgaatcatgggggcagtttccctcatgctattctcatgatagtgagctttcatga

SEQ ID NO: 8819 - DNA, 1316 bp, Homo sapiens
cggagccggcgcttttgcagttgcttctgcggaaaggtggtagttaagaatttgtaaaggccagagaactacctacgattctctcagcggtctctcttctcctcaagtttgaaatgctttatctcatcgggttgggcctgggagatgccaaggacatcacagtcaagggcctggaagttgttagacgctgcagtcgagtgtatctggaagcctacacctcagtcctaactgtagggaaggaagccttggaagagttttatggaagaaaattggttgttgctgatagagaagaagtggaacaagaagcagataatattttaaaggatgctgatatcagtgatgttgcattccttgtggttggtgatccatttggggccacaacacacagtgatcttgttctaagagcaacaaagctgggaattccttatagagttattcacaatgcctccataatgaatgctgtaggctgctgtggtttacagttatataagtttggagagacagtttctattgttttttggacagacacttggagaccagaaagcttctttgacaaagtgaagaagaacagacaaaatggcatgcacacattatgtttactagacatcaaagtaaaggagcagtctttggaaaatctaatcaagggaaggaagatctatgaacctccacggtatatgagtgtaaaccaagcagcccagcagcttctggagattgttcaaaatcaaagaatacgaggagaagaaccagcagttaccgaggagacactttgtgttggcttagccagggttggagccgacgaccagaaaattgcagcaggcactttaaggcaaatgtgcactgtggacttgggagaaccattgcattccttgatcatcacaggaggcagcatacatccaatggagatggagatgctaagtctgttttccataccagaaaatagctcagaatctcaaagcatcaatggactttgaacatagatatttaccattgtctgatgtaaatttcagccatatatggattgatatggtttggatgtatccccacccaagtctcatcttgaattttaatcctcataattcccaggtgttgtggtaggtaattgaatcatgggggcagtttccctcatgctattctcatgatagtgagctttcatgagatctgatggttttataagtgcctggcatttcccctactggctctcattctcactcttgccgccctgtgaagaggtgccttccaccgtgattgttaagtttcctgaggccttcccagccatgtggaactgtgagtcgaaaattaaacctcttttataatta

SEQ ID NO: 8820 - DNA, 1162 bp, Homo sapiens
cggagccggcgcttttgcagttgcttctgcggaaaggtggtagttaagaatttgtaaaggccagagaactacctacgattctctcagcggtctctcttctcctcaagtttgaaatgctttatctcatcgggttgggcctgggagatgccaaggacatcacagtcaagggcctggaagttgttagacgctgcagtcgagtgtatctggaagcctacacctcagtcctaactgtagggaaggaagccttggaagagttttatggaagaaaattggttgttgctgatagagaagaagtggaacaagaagcagataatattttaaaggatgctgatatcagtgatgttgcattccttgtggttggtgatccgacagacacttggagaccagaaagcttctttgacaaagtgaagaagaacagacaaaatggcatgcacacattatgtttactagacatcaaagtaaaggagcagtctttggaaaatctaatcaagggaaggaagatctatgaacctccacggtatatgagtgtaaaccaagcagcccagcagcttctggagattgttcaaaatcaaagaatacgaggagaagaaccagcagttaccgaggagacactttgtgttggcttagccagggttggagccgacgaccagaaaattgcagcaggcactttaaggcaaatgtgcactgtggacttgggagaaccattgcattccttgatcatcacaggaggcagcatacatccaatggagatggagatgctaagtctgttttccataccagaaaatagctcagaatctcaaagcatcaatggactttgaacatagatatttaccattgtctgatgtaaatttcagccatatatggattgatatggtttggatgtatccccacccaagtctcatcttgaattttaatcctcataattcccaggtgttgtggtaggtaattgaatcatgggggcagtttccctcatgctattctcatgatagtgagctttcatgagatctgatggttttataagtgcctggcatttcccctactggctctcattctcactcttgccgccctgtgaagaggtgccttccaccgtgattgttaagtttcctgaggccttcccagccatgtggaactgtgagtcgaaaattaaacctcttttataatt

SEQ ID NO: 8821 - DNA, 609 bp, Homo sapiens
gacatcaaagtaaaggagcagtctttggaaaatctaatcaacagttaccgaggagacactttgtgttggcttagccagggttggagccgacgaccagaaaattgcagcaggcactttaaggcaaatgtgcactgtggacttgggagaaccattgcattccttgatcatcacaggaggcagcatacatccaatggagatggagatgctaagtctgttttccataccagaaaatagctcagaatctcaaagcatcaatggactttgaacatagatatttaccattgtctgatgtaaatttcagccatatatggattgatatggtttggatgtatccccacccaagtctcatcttgaattttaatcctcataattcccaggtgttgtggtaggtaattgaatcatgggggcagtttccctcatgctattctcatgatagtgagctttcatgagatctgatggttttataagtgcctggcatttcccctactggctctcattctcactcttgccgccctgtgaagaggtgccttccaccgtgattgttaagtttcctgaggccttcccagccatgtggaactgtgagtcgaaaattaaacctcttttataatt

SEQ ID NO: 8822 - DNA, 1312 bp, Homo sapiens
cggagccggcgcttttgcagttgcttctgcggaaaggtggtagttaagaatttgtaaaggccagagaactacctacgattctctcagcggtctctcttctcctcaagtttgaaatgctttatctcatcgggttgggcctgggagatgccaaggacatcacagtcaagggcctggaagttgttagacgctgcagtcgagtgtatctggaagcctacacctcagtcctaactgtagggaaggaagccttggaagagttttatggaagaaaattggttgttgctgatagagaagaagtggaacaagaagcagataatattttaaaggatgctgatatcagtgatgttgcattccttgtggttggtgatccatttggggccacaacacacagtgatcttgttctaagagcaacaaagctgggaattccttatagagttattcacaatgcctccataatgaatgctgtaggctgctgtggtttacagtatataagtttggagagacagtttctattgttttttggacagacacttggaccagaaagcttctttgacaaagtgaagaagaacagacaaaatggcatgcacacattatgtttactagacatcaaagtaaaggagcagtctttggaaaatctaatcaagggaaggaagatctatgaacctccacggtatatgagtgtaaaccaagcagcccagcagcttctggagattgttcaaaatcaaagaatacgaggagaagaaccagcagttaccgaggagacactttgtgttggcttagccagggttggagccgacgaccagaaaattgcagcaggcactttaaggcaaatgtgcactgtggacttgggagaaccattgcattccttgatcatcacaggaggcagcatacatccaatggagatggagatgctaagtctgttttccataccagaaaatagctcagaatctcaaagcatcaatggactttgaacatagatatttaccattgtctgatgtaaatttcagccatatatggattgatatggtttggatgtatccccacccaagtctcatcttgaattttaatcctcataattcccaggtgttgtggtaggtaattgaatcatgggggcagtttccctcatgctattctcatgatagtgagctttcatgagatctgatggttttataagtgcctggcatttcccctactggctctcattctcactcttgccgccctgtgaagaggtgccttccaccgtgattgttaagtttcctgaggccttcccagccatgtggaactgtgagtcgaaaattaaacctcttttataatt

SEQ ID NO: 8823 - DNA, 1034 bp, Homo sapiens
ccggcgcttttgcagttgcttctgcggaaaggtggtagttaagaatttgtaaaggccagagaactacctacgattctctcagcgggtaattggctgctcctagtctctcttctcctcaagtttgaaatgctttatctcatcgggttgggcctgggagatgccaaggacatcacagtcaagggcctggaagttgttagacgctgcagtcgagtgtatctggaagcctacacctcagtcctaactgtagggaaggaagccttggaagagttttatggaagaaaattggttgttgctgatagagaagaagtggaacaagaagcagataatattttaaaggatgctgatatcagtgatgttgcattccttgtggttggtgatccatttggggccacaacacacagtgatcttgttctaagagcaacaaagctgggaattccttatagagttattcacaatgcctccataatgaatgctgtaggctgctgtggtttacagttatataagtttggagagacagtttctattgttttttggacagacacttggagaccagaaagcttctttgacaaagtgaagaagaacagacaaaatggcatgcacacattatgtttactagacatcaaagtaaaggagcagtctttggaaaatctaatcaagggaaggaagatctatgaacctccacggtatatgagtgtaaaccaagcagcccagcagcttctggagattgttcaaaatcaaagaatacgaggagaagaaccagcagttaccgaggagacactttgtgttggcttagccagggttggagccgacgaccagaaaattgcagcaggcactttaaggcaaatgtgcactgtggacttgggagaaccattgcattccttgatcatcacaggaggcagcatacatccaatggagatggagatgctaagtctgttttccataccagaaaatagctcagaatctcaaagcatcaatggactttgaacatagatatttaccattgtctgatgtaaatttcagccatatatggattg

SEQ ID NO: 8824 - DNA, 4870 bp, Homo sapiens
ccctaagtggccgctccgggcgccttctccctgccccgccgcgtctcgcctgcgcgggctccaagcgcagccttaacaggctccgaaacttgaatcagcgccccgatcccgagagggctcttccttcggccccatcactcccacaatggaagggcggccgcctccggaaggccgtccgcccccgcgtcctcgcaccggccgagccccgcgcgggcgccgaagagctgtttttgcagcagtgttgcactggagccatataacacacctctttgaaaatgaccgtcatttttctcacctctcaacattggaaagggagatggcttttcgcactgaaatgggactatattattcctatttcaagactattgtggaagcaccctcatttttgaatggagtatggatgattatgaatgataaactgactgaatacccccttgtcattaatacattaaaaagattcaatctttaccctgaggtaattttggccagttggtaccggatttataccaaaataatggacttgattggtattcaaaccaagatatgttggacggttaccagaggagaaggactcagtcctattgaaagctgtgaaggattgggagatcctgcttgcttttatgttgctgtaatttttattttaaatggactaatgatggcattattcttcatatatggcacatatttaagtggcagccgattaggaggcctggttacagtgttgtgcttctttttcaatcatggagagtgtacccgtgtaatgtggacaccacctctccgtgaaagcttctcatatccatttcttgttcttcagatgttgctagtgactcatattctcagggctacaaaactttatagaggaagcttgattgcactctgcatttccaatgtatttttcatgcttccttggcagtttgctcagtttgtacttcttactcagattgcatcattatttgcagtatatgttgtcgggtacattgatatatgtaaattacggaagatcatttatatacacatgatttctcttgcactttgttttgttttgatgtttgggaactcaatgttattaacttcttattatgcttcttctttggtaattatttggggtattctggcaatgaaaccacatttcctgaaaataaatgtatctgaacttagtttatgggttattcaaggatgtttttggttatttggaactgtcatacttaaatacttgacatctaaaatttttggtattgcagatgacgctcatattggcaacttactaacatcaaaattctttagttataaggattttgatactttattgtatacctgtgcagcggagtttgactttatggaaaaagagactccactgagatacacaaagacattattgcttccagttgttcttgtagtgtttgttgctattgttagaaagattattagtgatatgtggggtgtcttagctaaacaacagacacatgtaagaaaacaccagtttgatcatggagagctggtttaccatgcattgcaattgttagcatatacagcccttggtattttaattatgagactaaaactcttcttgacaccacacatgtgtgttatggcatcactgatctgctcaagacagctatttggatggctcttttgcaaagtacatcctggtgctattgtgtttgctatattagcagcaatgtcaatacaaggttcagcaaatctgcaaacccagtggaatattgtaggggagttcagcaatttgccccaagaagaacttatagaatggatcaaatatagtactaaaccagatgcagtgtttgcgggtgccatgcccacgatggcaagtgttaagctctctgcacttcggcccattgtgaatcatccacattatgaagacgcaggcttgagagccagaacaaaaatagtatactcaatgtatagtcggaaagcagccgaagaagtgaagcgagaactgataaagttaaaagtgaactattacattctagaagagtcatggtgtgtaagaagatccaagcctggttgcagtatgcctgaaatttgggatgtagaagatcctgccaatgctgggaaaactcccttatgtaacctcttggtgaaggattccaaacctcacttcaccactgtattccagaacagtgtttacaaagtcctagaagttgtaaaagaatgactgctacatgacctgctgcctacggagaactacatctgtaatggttttaatgttttgctaagtcatgtgttgttcatatcccaaaaacttttataggtaactgttttcaaatagaaaacgttttatttggtcaatttgaatgtcattctaattataaaaatgacttacacctttatcaattggttactatttcaatgcaccctttaaaatttgctatgcaaatgagtatatgcttgtacttgactttaatatttgtgctaaagtgagcaaagctacctgtataaagaaaacacagtgggttgtgacaaggatgacatgaaaatacaggacaattctgacaatgtaggggctgattttatagtgtaagaactattaatgccccttgcttcttttttctgcctcttgctcttgtcttttggacatttcagtgattgtaagttcttcggtcatgtcagcccctgtcatcaacttgagttacagtagatggggcagacatggagtgtttgctatatagaactatctgtttgttttacttccttgtgcgctttttgttctctgttctcttgttaatgaagcttttcctgcccattattaatccaaactcttggaccttgtggttaggaaattcccttaacttccagccatatggcattatcgtgtctctttctctctctctcttgctctctctcttctcctcttccccatattttctgtcaaataagtactgtttactcatttagttgcttatcaagtacttattcttggttttaaaaaaaattaatggtaactgtatttttctcatttttagcattattcaaatgtttatattttaatacctttaaaccactttaaagttttttcatgtttaattatagttttaagaaaaactattttgaacaaccccaaatatagtgcatctagaaactaatgtatatttgattagacatcatttatagtggaacagtagactgtagtacatggtaatttttcttttactattaagatacaataaaacatgactaattttgctgtcaaaaatgtaaagaataatgataaatggagtttttatattttacttttaagattgcctgtctttaataagacaaagccttaagccttatgttataattttggttctaaaaaccatcatttcagtataaggaataagtatatttcgtcctcctctttagtttttttcttcctatttatttttattttgaaaaatttctacaccttctttgaattccttgtatgaatttttgtttcttagaagttaatttgtgtgaaatgagattcttcaaaacgatgaaacctcatagctctgagaaaaggttttagggttttaaattctaagcaaagcgtgactatggctgacagactacacatttaattatacagcttctctttcttaaccacaggcagattaacctcattgtggattgtccttcagaccttagtcctcaggcatggtttctggtgcccactcctggaagccgctgttccctttctaccttcttaccagagcccaagggcaggcctggtcccggggaagcagcagcttgctgacataagtcagctgcaaaggctgaggagtgtgccctcagagaagcaccgccccccagtcttgtgccagcgcctagagccgcagctcccagggatgctccttccctggaggcagcccaggagagggactctggcagcgttcttcagatttgtggccactgtttctcatttgctggttgactgtttttatttcttaggcttttgctagttttagaaaatagggaagcagcccttgatttgtggattaaaagcaacatttgagcgatgatgcacaacagtccaggaaaatgggcggtggacacttgaggctgaggatgggagttgacatgagcagggagagggaggtgcgcgctgcttatctgtgattgttgctcacctgagtgtggctgattgtgtacatccagcagttacaatttttaaaaattatacttttacatttattttatatttttctcacccccagtaatttccttccaaagaagttcacatgtaataagtagaaattctgtataggaaaaaagcattaaaaatactattataactgcttcatttgctgggaaccattaaaagtaatataaattagctttttccagaaggatccttttgtagcagtgtttatgaatgtaacccccagcaaaatatggctatatattaggggagccagtttggagcagaggcctgaaggtccctgctatgcagccgtggccacagctcgcagcccaagcactgtggagcatccacacctttgatggcaatgcagattggtagcaggttccataggcgtacaaaacagtattaaagctcagtgttttgcatattgttagcatttacaaatatttttgctttagtatgaggaaagtaaggatgggcaaagaagcgatcaaaatagctattgctacaacattttcgaaaacaaagttggggctgtatttctttaaaaagataagcctctaaaaatgcttggcaaaaaaaatatagtgttaaaataggccagtgatattaatgagaaaatgaaagtatgtatcaggaataaagtgatattgcataggagtattgtatttttatgaattttatgccagttgtttacatgtactatatatgttaaattaaaaaaaatcatgagtaatgagggaa

SEQ ID NO: 8825 - DNA, 652 bp, Homo sapiens
ggaatgtttcaaaaggatatgatgaactgaggcttatcgagtcagggagcagaaagctgaaataagaccgctaagctctaaacaaatccgttaaagcttcacagggcagagccagaacaaaaatagtatactcaatgtatagtcggaaagcagccgaagaagtgaagcgagaactgataaagttaaaagtgaactattacattctagaagagtcatggtgtgtaagaagatccaagcctggttgcagtatgcctgaaatttgggatgtagaagatcctgccaatgctgggaaaactcccttatgtaacctcttggtgaaggattccaaacctcacttcaccactgtattccagaacagtgtttacaaagtcctagaagttgtaaaagaatgactgctacatgacctgctgcctacggagaactacatctatgactagacattcactttgcaaataattgttgtgactctatgtttgctccagacacagagcttttattgtcacccaaagatgcctatgggaaccaaaagaatcaagctgaaccaagatttctgccagaatcaatttcctcaagccagaaggctttatcattcagtctgtgcaacggatttttttttaaataaaaacagacttctttgttgatttctcccttt

SEQ ID NO: 8826 - DNA, 4060 bp, Homo sapiens
gcgaatggcttccaacgcatgcgccccaccccacatttcacagtcgccatgacgaccgggaggtccgcaacggctgcggggacaagtccgttgaggctgccaggcgagtcaggtctctctggacctcgcctgactcggctgggctgtgcctgaaattgacccagctccaccatactccttgattatgagaaaacaaggagtaagctcaaagcggctgcaatcttccggccgcagccagtctaaggggcggcgcggggcctccctcgcccgggagccggaggtagaggaggagatggaaaagtcggccctaggcggcgggaaactgccaaggggctcctggaggtcctccccggggaggatccaaagtctgaaagagcgaaaaggcttggagctagaggtggtggccaagacctttcttctcggccccttccagttcgtccgtaattccctggcgcagctccgggaaaaggtgcaggaactgcaggcgcggcggttctccagcagaaccactctcggcatcgctgtctttgtggcaattttacattggttacatttagtaacactttttgaaaatgatcgtcatttctctcacctctcatctttggaacgggagatgacttttcgcactgaaatgggactttattattcatacttcaagaccattattgaagcaccttcgtttttggaaggactgtggatgattatgaatgacaggcttactgaatatcctcttataattaatgcaataaaacgcttccatctttatccagaggtaatcatagcctcctggtattgcacattcatgggaataatgaatttatttggactagaaactaagacctgctggaatgtcaccagaatagaacctcttaatgaagttcaaagctgtgaaggattgggagatcctgcttgcttttatgttggtgtaatctttattttaaatggactaatgatgggattgttcttcatgtatggagcatacctgagtgggactcaactgggaggtcttattacagtactgtgcttctttttcaaccatggagaggccacccgtgtgatgtggacaccacctctccgtgaaagtttttcctatcctttccttgtacttcagatgtgtattttaactttgattctcaggacctcaagcaatgatagaaggcccttcattgcactctgtctttccaatgttgcttttatgcttccctggcaatttgctcagtttatactttttacacagatagcatcattatttcccatgtatgttgtgggatacattgaaccaagcaaatttcagaagatcatttatatgaacatgatttcagttacccttagtttcattttgatgtttggaaattcaatgtacttatcttcttattattcttcatctttgttaatgacgtgggcaataattctaaagagaaatgaaattcaaaaactgggagtatctaaactcaacttttggctaattcaaggtagtgcctggtggtgtggaacaatcattttgaaatttctgacatctaaaatcttaggcgtttcagaccacattcgcctgagtgatcttatagcagccagaatcttaaggtatacagattttgatactttaatatatacctgtgctcccgaatttgacttcatggaaaaagcgactccgctgagatacacaaagacattattgcttccagttgttatggtgattacatgttttatctttaaaaagactgttcgtgatatttcatatgttttagctacaaacatttatctaagaaaacagctccttgaacacagtgagctggcttttcacacattgcagttgttagtgtttactgcccttgccattttaattatgaggctaaagatgtttttgacaccgcacatgtgtgttatggcttccttgatatgctctcgacagctctttggctggctttttcgcagagttcgttttgagaaggttatctttggcattttaacagtgatgtcaatacaaggttatgcaaacctccgtaatcaatggagcataataggagaatttaataatttgcctcaggaagaacttttacagtggatcaaatacagtaccacatcagatgctgtctttgcaggtgccatgcctacaatggcaagcatcaagctgtctacacttcatcccattgtgaatcatccacattacgaagatgcagacttgagggctcggacaaaaatagtttattctacatatagtcgaaaatctgccaaagaagtaagagataaattgttggagttacatgtgaattattatgttttagaagaggcatggtgtgttgtgagaactaagcctggttgcagtatgcttgaaatctgggatgtggaagacccttccaatgcagctaaccctcccttatgtagcgtcctgctcgaagacgccaggccttacttcaccacagtatttcagaatagtgtgtacagagtattaaaggttaactgagaaggatactacccattttactatggcacaatgccgtgtgtcaaaaacaatcaccctttggcttattcacattaataaaaatcacaagctttaataacagacacttaaaaataagataaaaatggattggaaatttttctgattactaaaaggtaaattacttttctgttcattgaatgtcagccttattaagcttgtcatataagttattaaatcattcatgtcatactgcataaacaaatgttcatttcagaattttaaagagaaatgtatataaaagaacaatgaattttaataaatcaggggtatgtaagtcctttttcatccaactaggtgaattgcttcagattttctctagtaccagagggtacctcctcaaactctttgaaccacttaaggcagaagaatgcaagctctgaaatgacatccttaaaatgctgatactggtcacagcctctttacctctgtgaggaaattgtaacagtgtgtcttttaaggtgtttttattttaccagcccttaagaaagatctctaataccttttaatacttttttttaataatttcaagttgaagtgtttttaaaaacactttgttttgtaatgttttgaatctcttgagatgtgtttaccccactagatacatatttgccactggttagttctccatctaagctcaagaggttattcatctctctttagattccagtggcttttcttttaacatccaggtaaaacagaaactgctatggtatacaaccaagttttggggttaaacataatcagaaaagaaaatccagttaaatttatgaagtgagattttcagatcctagatcttgaataaaggaaaggtcttttcatcttgatggccccaaagcttgttggtcatggtctttatttctggccactatcttcttaaataatatatttttaagccctcatttatttttggttttgggtgaggaaagtcatgttttctaagtcctctcccctaataaaacctacccaacaatagtgctttgaaaagtggtagttatcttgaagatactcttgccaaatgcaaagataaacattctttttgtctgctttataaatatgaaatatgccagatctatagtattttaatgtgcatctactttaaatgagtcatcttggggtttttataattcccttatgttcttgcccctctacacttgaaataacaaaatgccttaattttatggattagttctcttatagtagacaggcagctatatgcagcaaaaccaataaagttatttttcaactttcatagttgtaaaatatcttataacagaatacaaaacagctaagaaaacatgccacattttattttagcattttcaaataatttgtttttggtgtaagcacaggataaaaaaggagagcgtcaaagaaaagagacataacacctaacattcataaaaattaacaaagtatattttggatgatgtttttacaggaaatattttaaataagttggtagaacttttaaaatggtactgtattagctaataaaatattcagtacaaatatatgtttggatttatgcattaaaaaactaataaaattatttccaacttt

SEQ ID NO: 8827 - DNA, 1339 bp, Homo sapiens
tacactgtatatataggttgaatagaaggtcatcctattcatttattaatgagaggtacaatctctagggatctgtaaaatctattttgtcttaaccaaagaacaaatttttgacatatcttgaataggatgactataaattatgacttttaaattgttgtaatttttgtactattatctgatatttttatttttatgtattttcgtaagtagtttagagatagtcacattttaaaaatctaagatcaagcaaatgaagcttatttttatgtattcatagtataaaagaccttcagtaaataggtaatatttttgttttattctagaaaacagctccttgaacacagtgagctggcttttcacacattgcagttgttagtgtttactgcccttgccattttaattatgaggctaaagatgtttttgacaccgcacatgtgtgttatggcttccttgatatgctctcgacagctctttggctggctttttcgcagagttcgttttgagaaggttatctttggcattttaacagtgatgtcaatacaaggttatgcaaacctccgtaatcaatggagcataataggagaatttaataatttgcctcaggaagaacttttacagtggatcaaatacagtaccacatcagatgctgtctttgcaggtgccatgcctacaatggcaagcatcaagctgtctacacttcatcccattgtgaatcatccacattacgaagatgcagacttgagggctcggacaaaaatagtttattctacatatagtcgaaaatctgccaaagaagtaagagataaattgttggagttacatgtgaattattatgttttagaagaggcatggtgtgttgtgagaactaagcctggttgcagtatgcttgaaatctgggatgtggaagacccttccaatgcagctaaccctcccttatgtagcgtcctgctcgaagacgccaggccttacttcaccacagtatttcagaatagtgtgtacagagtattaaaggttaactgagaaggatactacccattttactatggcacaatgccgtgtgtcaaaaacaatcaccctttggcttattcacattaataaaaatcacaagctttaataacagacacttaaaaataagataaaaatggattggaaatttttctgattactaaaaggtaaattacttttctgttcattgaatgtcagccttattaagcttgtcatataagttattaaatcattcatgtcatactgcataaacaaatgttcatttcagaattttaaagagaaatgtatataaaagaacaatgaattttaataaatcaggggtatgtaagtc

SEQ ID NO: 8828 - DNA, 505 bp, Homo sapiens
cccaatgaagcgcgtgaagggcaagcggtgatgggttctgcgccagtggggctgggagcccgtccggggctgtacatggggctgcgcgcaagtcgccatgacgaccgggaggtccgcaacggctgcggggacaagtccgttgaggctgccaggcgagtcaggtctctctggacctcgcctgactcggctgggctgtgcctgaaattgacccagctccaccatactccttgattatgagaaaacaaggagtaagctcaaagcggctgcaatcttccggccgcagccagtctaaggggcggcgcggggcctccctcgcccgggagccggaggtagaggaggagatggaaaagtcggccctaggcggcgggaaactgccaaggggctcctggaggtcctccccggggaggatccaaagtctgaaagagcgaaaaggcttggagctagaggtggtggccaagacctttcttctcggccccttccagttcgtccgtaattccctggcgca

SEQ ID NO: 8829 - DNA, 1824 bp, Homo sapiens
gttgacgccccccagcccctcatttccacaaagctccgcggcggttctgccctccttgtacccgcggcgcgctgcggcccgtggcgcggccccgttcccgcctagccccgtcggcctccttcccctcccggagccgcgcgtgaggacggctgaggccgcaggagtgatttggagaacaatgcatgtaagtctgacatcatgatgtccatccggcaaagaagagaaataagagccacagaagtttctgaagactttccagcccaagaagaaaatgtgaagttggaaaataaattgccatctggttgtaccagtagaagattatggaagattttgtcattgacaattggtggaaccattgccctttgcattggacttcttacatctgtctaccttgccacgttacatgaaaatgatttatggttttctaatattaaggaagtggagcgagaaatctcattcagaacagagtgtggcctgtattactcctactacaagcagatgctgcaggctccaaccctcgtgcaaggttttcatggcctaatatatgataataaaactgaatctatgaagacaattaacctccttcagcgaatgaatatttaccaagaggtttttctcagtattttatatagagttctacccatacagaaatatttagagccagtttatttttatatttacaccttatttgggctccaggcgatctatgtcacagctctctacataaccagctggctactcagtggtacatggctgtcaggactgttggcagctttctggtatgtcacaaatagaatagataccacaagagttgagtttaccatcccactgagggagaactgggcgctgccattctttgcaattcagatagcagcaattacatatttcctgagaccaaacttacagcctctttctgaaaggctgacacttcttgccattttcatatcaacttttctctttagtctgacatggcaatttaatcaatttatgatgctgatgcaagcattagtgctgttcacactggactccctggacatgctgccagcagtgaaggcgacatggctgtatggaatacagataacaagtttactcctggtctgcattcttcagttttttaattccatgattcttggatcactgcttatcagttttaacctttcagtattcattgcaagaaaacttcagaaaaatctgaaaactggaagcttccttaataggcttgggaaacttttgttacatttatttatggttttatgtttgacactttttctcaacaacataattaagaaaattcttaacctgaagtcagatgaacacatatttaaatttctgaaggcaaaatttgggcttggagcaacaagggattttgatgcaaatctctatctgtgtgaagaagcttttggcctcctgccttttaatacatttggaaggctttcagatactctgcttttttatgcttacatattcgttctgtccatcacagtgattgtagcattcgttgttgcctttcataatctcagtgattctacaaatcaacaatccgtgggtaaaatggaaaaaggcacagttgacctgaaaccagaaactgcctacaacttaatacataccattctgtttggattcttggcattgagtacaatgagaatgaagtacctctggacgtcacacatgtgtgtgttcgcatcattcggcctatgtagccctgaaatatgggagttacttctgaagtcagtccatctttataacccaaagaggatatgtataatgcgatattcagtaccgatattaatactgctgtatctatgctataagaatcagaaatct

SEQ ID NO: 8830 - DNA, 6024 bp, Homo sapiens
ggaaggaccaagtttgcggagcggcttctgctcgtcggccgtgcggcgaggcagggcctgggctgcgaccccggcggccgctcgcggtcttgggagagctggggcgcgtgcctgaacttcccggctgcccctgtccttggagacctacctgatggggacgccaggtgtgcaggggcgtggcgcgtaggagtgatttggagaacaatgcatgtaagtctgacatcatgatgtccatccggcaaagaagagaaataagagccacagaagtttctgaagactttccagcccaagaagaaaatgtgaagttggaaaataaattgccatctggttgtaccagtagaagattatggaagattttgtcattgacaattggtggaaccattgccctttgcattggacttcttacatctgtctaccttgccacgttacatgaaaatgatttatggttttctaatattaaggaagtggagcgagaaatctcattcagaacagagtgtggcctgtattactcctactacaagcagatgctgcaggctccaaccctcgtgcaaggttttcatggcctaatatatgataataaaactgaatctatgaagacaattaacctccttcagcgaatgaatatttaccaagaggtttttctcagtattttatatagagttctacccatacagaaatatttagagccagtttatttttatatttacaccttatttgggctccaggcgatctatgtcacagctctctacataaccagctggctactcagtggtacatggctgtcaggactgttggcagctttctggtatgtcacaaatagaatagataccacaagagttgagtttaccatcccactgagggagaactgggcgctgccattctttgcaattcagatagcagcaattacatatttcctgagaccaaacttacagcctctttctgaaaggctgacacttcttgccattttcatatcaacttttctctttagtctgacatggcaatttaatcaatttatgatgctgatgcaagcattagtgctgttcacactggactccctggacatgctgccagcagtgaaggcgacatggctgtatggaatacagataacaagtttactcctggtctgcattcttcagttttttaattccatgattcttggatcactgcttatcagttttaacctttcagtattcattgcaagaaaacttcagaaaaatctgaaaactggaagcttccttaataggcttgggaaacttttgttacatttatttatggttttatgtttgacactttttctcaacaacataattaagaaaattcttaacctgaagtcagatgaacacatatttaaatttctgaaggcaaaatttgggcttggagcaacaagggattttgatgcaaatctctatctgtgtgaagaagcttttggcctcctgccttttaatacatttggaaggctttcagatactctgcttttttatgcttacatattcgttctgtccatcacagtgattgtagcattcgttgttgcctttcataatctcagtgattctacaaatcaacaatccgtgggtaaaatggaaaaaggcacagttgacctgaaaccagaaactgcctacaacttaatacataccattctgtttggattcttggcattgagtacaatgagaatgaagtacctctggacgtcacacatgtgtgtgttcgcatcattcggcctatgtagccctgaaatatgggagttacttctgaagtcagtccatctttataacccaaagaggatatgtataatgcgatattcagtaccgatattaatactgctgtatctatgctataagttctggccaggaatgatggatgaactctccgagttgagagaattctatgatccagatacagtggagctgatgaactggattaactctaacactccaagaaaggctgtgtttgcgggaagcatgcagttgctggccggagtcaagctgtgcacgggaaggaccctaaccaaccacccgcactatgaagacagcagcctgagagagcggaccagagcggtttatcagatatatgccaagagggcaccagaggaagtgcatgccctcctaaggtccttcggcactgactacgtaatcctggaagacagcatctgctacgagcggaggcaccgccggggctgccgactccgggacctgctggacattgccaacggccacatgatggatggcccaggagagaatgatcctgatttgaaacctgcagaccaccctcgcttctgtgaagagatcaaaagaaacctgcctccctacgtggcctacttcaccagagtgttccagaacaaaaccttccacgtttacaagctgtccagaaacaagtagcgcagatttctgcccagtgtctatttttgatacggagaaactgcatcatgatgaaactcaatagatgacgtttcctatgtaagtaggtagcccaaaccttcaagctgtgatatgagtaagttctacagatgtttacacaagtgttgccatctttgaaagcatcttctacaagcagaagtctttttcgttgtgtgtctatctttctcattaatgttctttagcctaaatgttaacaactttctaagagtgacctagaattatgttgttggagagaatgatgtgtgttccatggatacctggataggcacataacatgttggaagatgagcacctgctcaggatttgaaatacgtttaattttcaggtgacttaagacagctatgattgaatcaactagagatgatgatcgacttatttaatatgatttcactggtgaagaccaattggtagctttttaaaaagcactttagtgtcctgttttaccttaaaatgttataatattttccagttgtcatgctgtcaacattaacaaaaaaaatcatgttaaggctttgtatcaaacattttgttacactctgtctgaaatgtaatgtggagtacttcagcagtatgtgtcatgtattgtgtgtgtctgtgtgtgtgcatgtgcacacatgtgttttaatgctgggcacagaaaagtgttacaagttccatatcgtaagtccttaaaggggcagaaatatatgtagccaagtagaatttattacattttagtgttattattttaaaacttactgatactctttaacctctcctgcagtaatagttttgctttatttcttactcatttcaatttattgggtttgcaaaattttgtaaactttttgtgtttttagcctttgtattttttacagcctagaatcttgcaaagtctgaatattttttaaatgttctatcttaactagttcactaatacagtatttttagcagacagcattttcagacagcattttcataccaagtttgacttgtggtctccaatcttactgggaaggccctggtagtgtaattcttttccttattaaaaggtaaccaagtgcctctaagtcatgcttatttgtaaacaacaaagaagagtatatgtacctgctcaaaatttttttgataatcgcttatataattaatttctaatgatgaggacatgtaaaagttgccagtaagaacatagtatgcatttaattaaatcaagatggctaatggaattaactttctcccctgttcttgccaggtggaaatgatttaagcatttctccttgcagttgtattgaagtaaattaccataggcatcaagatggctgcatcacattttcaaatgattttatattcagttgctacttataaagcagcattcaaaaagtcttttacactgtcatgttggacacaagcagactcagcttttatcaaaacttgtttaaataaaaaattgacagtagctgggttattaaattatgcaactgaaactcctgaattatatcttttctgtatcccttaataagattggagaccactgccgtttaggataatacaataataaaacgttttaatcagtactaaaactttaattaagccaataatgatgcatgcctgttgtagctgacagcatgggtcagtacatccttcagcgagtgccttactctaattgaaaccaagcacacgtaaggtacaatatgttagactctgtgattttgttttcaaaatcctctgttatggctatatttaaatttattttaaatattcctgtatgtattcatctaagcatttgggcatttggagtcttaatatacaagaaacacgtacttaaatttttatgcttatcaccgcaatgatggcaaacagtgattttttttttcatagtttaggtgtcattgttgccagcacctttagtgctcagtcttcagtgaaaaatataaagtgccaaaaaaatcttgcaagacagaatccatacttaacactctttccaagacactgtgaccatgtacagtagctatttcctgatgaccaaatctctcaacgaatcatgttattaataaatatttttagcactcatcagtattctccaatgtgaccttctcattggagtacacagaaggaaagcaaagaagagcatctgacttctagctctggcttacagcctctctaccaggccgaagcaagagacccgcggcagcagctccccgccactcagacctgggtggtgataacctcaaagaatggctctgttttctattgacagaaaacccacttgattttgcttctgagttagcagtcagaagaccctctaagtacaatagaagtgctcttaacggactctgcctgtgtgactcccaggccccggagtctccatctctctcgtaagccacctgccacagcacagctggaggctgttctctggtgttctcagcgctccggctccctccctggagttgtgcacccgtcccaaactcctccatgcaagttctgcttcctcttataagtacacaactcagttaagtattcacatacacacagaaaatacgggtgtgaaaagaaagaattttctgtaaaaattaagttgaatactttggtaaaaagtgataaaggctgagttgccaataaaagttgcttttaaattaggtgtggctgggaatattataagatattggggaaaatatacaaatcaagaaaatttctgagcttagattgcttcatagatttatttaagtactcatcccacctttaaaacctctaaactgagaagaagggacccaaatcatgttattggtgtgatttatgtgagaagtagaactgtagtcattggacccttaggcaaaggaaaatccgtgtctttatatcagaagatcggcaaacgaatgtatattacacagtttaggttatgattccctactttaacctacttactttattaaatgaccaactactgatactgatcacaatagttattagagattctaatttagttggaaggttctaatcactttcattacaggcatttgaaaaatagggattcatttcgaatatattagccaggagcatagttagatgttacccaggccatttatcatcctgttaatgatgattttcccgacccttgtgagatcagcgtgacaggagtgtgtgtgtgtgtgtgtgtttctgtgggtgtgtggttttggttgggtgctgccaggtggcaaaggcatatgtaaatacatctgatctgcatctttatttcacagttaactaaaagtaaaaatgtctattctgattccatattgattttgtctaagatgtaaaaatttgagttcatctttggccaaaacctacctgaattaacatacaaaatatttgatttttaaaatttaattcaaatctcaaaatcaattaagtattctcagatcctatatcttggttaatatgctcccagatactttaaacatggcaaccttttggcctaagagaatgtttgttcatggaaaaaagcttttgagatgagagggtgtcttactttcttgtggcaattgattttctgttttaacaccctttgggtaaaatcttgcaaagagcttttataatttgttttactgaattgtatggagattgtataccaagtaaagctcttttaaattac

SEQ ID NO: 8831 - DNA, 528 bp, Homo sapiens
gcggccgctcgcggtcttgggagagctggggcgcgtgcctgaacttcccggctgcccctgtccttggagacctacctgatggggacgccaggtgtgcaggggcgtggcgcgtaggagtgatttggagaacaatgcatgtaagtctgacatcatgatgtccatccggcaaagaagagaaataagagccacagaagtttctgaagactttccagcccaagaagaaaatgtgaagttggaaaataaattgccatctggttgtaccagtagaagattatggaagattttgtcattgacaattggtggaaccttgccctttgcattggacttcttacatctgtctaccttgccacgttacatgaaaatgatttatggttttctaatattaaggaagtggagcgagaaatctcattcagaacagagtgtggcctgtattactcctactacaagcagatgctgcaggctccaaccctcgtgcaaggttttcatggcctaatatatgataataaaactgaatctatgaagacaatt

SEQ ID NO: 8832 - DNA, 5998 bp, Homo sapiens
gttgacgccccccagcccctcatttccacaaagctccgcggcggttctgccctccttgtacccgcggcgcgctgcggcccgtggcgcggccccgttcccgcctagccccgtcggcctccttcccctcccggagccgcgcgtgaggacggctgaggccgcaggagtgatttggagaacaatgcatgtaagtctgacatcatgatgtccatccggcaaagaagagaaataagagccacagaagtttctgaagactttccagcccaagaagaaaatgtgaagttggaaaataaattgccatctggttgtaccagtagaagattatggaagattttgtcattgacaattggtggaaccattgccctttgcattggacttcttacatctgtctaccttgccacgttacatgaaaatgatttatggttttctaatattaaggaagtggagcgagaaatctcattcagaacagagtgtggcctgtattactcctactacaagcagatgctgcaggctccaaccctcgtgcaaggttttcatggcctaatatatgataataaaactgaatctatgaagacaattaacctccttcagcgaatgaatatttaccaagaggtttttctcagtattttatatagagttctacccatacagaaatatttagagccagtttatttttatatttacaccttatttgggctccaggcgatctatgtcacagctctctacataaccagctggctactcagtggtacatggctgtcaggactgttggcagctttctggtatgtcacaaatagaatagataccacaagagttgagtttaccatcccactgagggagaactgggcgctgccattctttgcaattcagatagcagcaattacatatttcctgagaccaaacttacagcctctttctgaaaggctgacacttcttgccattttcatatcaacttttctctttagtctgacatggcaatttaatcaatttatgatgctgatgcaagcattagtgctgttcacactggactccctggacatgctgccagcagtgaaggcgacatggctgtatggaatacagataacaagtttactcctggtctgcattcttcagttttttaattccatgattcttggatcactgcttatcagttttaacctttcagtattcattgcaagaaaacttcagaaaaatctgaaaactggaagcttccttaataggcttgggaaacttttgttacatttatttatggttttatgtttgacactttttctcaacaacataattaagaaaattcttaacctgaagtcagatgaacacatatttaaatttctgaaggcaaaatttgggcttggagcaacaagggattttgatgcaaatctctatctgtgtgaagaagcttttggcctcctgccttttaatacatttggaaggctttcagatactctgcttttttatgcttacatattcgttctgtccatcacagtgattgtagcattcgttgttgcctttcataatctcagtgattctacaaatcaacaatccgtgggtaaaatggaaaaaggcacagttgacctgaaaccagaaactgcctacaacttaatacataccattctgtttggattcttggcattgagtacaatgagaatgaagtacctctggacgtcacacatgtgtgtgttcgcatcattcggcctatgtagccctgaaatatgggagttacttctgaagtcagtccatctttataacccaaagaggatatgtataatgcgatattcagtaccgatattaatactgctgtatctatgctataagttctggccaggaatgatggatgaactctccgagttgagagaattctatgatccagatacagtggagctgatgaactggattaactctaacactccaagaaaggctgtgtttgcgggaagcatgcagttgctggccggagtcaagctgtgcacgggaaggaccctaaccaaccacccgcactatgaagacagcagcctgagagagcggaccagagcggtttatcagatatatgccaagagggcaccagaggaagtgcatgccctcctaaggtccttcggcactgactacgtaatcctggaagacagcatctgctacgagcggaggcaccgccggggctgccgactccgggacctgctggacattgccaacggccacatgatggatggcccaggagagaatgatcctgatttgaaacctgcagaccaccctcgcttctgtgaagagatcaaaagaaacctgcctccctacgtggcctacttcaccagagtgttccagaacaaaaccttccacgtttacaagctgtccagaaacaagtagcgcagatttctgcccagtgtctatttttgatacggagaaactgcatcatgatgaaactcaatagatgacgtttcctatgtaagtaggtagcccaaaccttcaagctgtgatatgagtaagttctacagatgtttacacaagtgttgccatctttgaaagcatcttctacaagcagaagtctttttcgttgtgtgtctatctttctcattaatgttctttagcctaaatgttaacaactttctaagagtgacctagaattatgttgttggagagaatgatgtgtgttccatggatacctggataggcacataacatgttggaagatgagcacctgctcaggatttgaaatacgtttaattttcaggtgacttaagacagctatgattgaatcaactagagatgatgatcgacttatttaatatgatttcactggtgaagaccaattggtagctttttaaaaagcactttagtgtcctgttttaccttaaaatgttataatattttccagttgtcatgctgtcaacattaacaaaaaaaatcatgttaaggctttgtatcaaacattttgttacactctgtctgaaatgtaatgtggagtacttcagcagtatgtgtcatgtattgtgtgtgtctgtgtgtgtgcatgtgcacacatgtgttttaatgctgggcacagaaaagtgttacaagttccatatcgtaagtccttaaaggggcagaaatatatgtagccaagtagaatttattacattttagtgttattattttaaaacttactgatactctttaacctctcctgcagtaatagttttgctttatttcttactcatttcaatttattgggtttgcaaaattttgtaaactttttgtgtttttagcctttgtattttttacagcctagaatcttgcaaagtctgaatattttttaaatgttctatcttaactagttcactaatacagtatttttagcagacagcattttcagacagcattttcataccaagtttgacttgtggtctccaatcttactgggaaggccctggtagtgtaattcttttccttattaaaaggtaaccaagtgcctctaagtcatgcttatttgtaaacaacaaagaagagtatatgtacctgctcaaaatttttttgataatcgcttatataattaatttctaatgatgaggacatgtaaaagttgccagtaagaacatagtatgcatttaattaaatcaagatggctaatggaattaactttctcccctgttcttgccaggtggaaatgatttaagcatttctccttgcagttgtattgaagtaaattaccataggcatcaagatggctgcatcacattttcaaatgattttatattcagttgctacttataaagcagcattcaaaaagtcttttacactgtcatgttggacacaagcagactcagcttttatcaaaacttgtttaaataaaaaattgacagtagctgggttattaaattatgcaactgaaactcctgaattatatcttttctgtatcccttaataagattggagaccactgccgtttaggataatacaataataaaacgttttaatcagtactaaaactttaattaagccaataatgatgcatgcctgttgtagctgacagcatgggtcagtacatccttcagcgagtgccttactctaattgaaaccaagcacacgtaaggtacaatatgttagactctgtgattttgttttcaaaatcctctgttatggctatatttaaatttattttaaatattcctgtatgtattcatctaagcatttgggcatttggagtcttaatatacaagaaacacgtacttaaatttttatgcttatcaccgcaatgatggcaaacagtgattttttttttcatagtttaggtgtcattgttgccagcacctttagtgctcagtcttcagtgaaaaatataaagtgccaaaaaaatcttgcaagacagaatccatacttaacactctttccaagacactgtgaccatgtacagtagctatttcctgatgaccaaatctctcaacgaatcatgttattaataaatatttttagcactcatcagtattctccaatgtgaccttctcattggagtacacagaaggaaagcaaagaagagcatctgacttctagctctggcttacagcctctctaccaggccgaagcaagagacccgcggcagcagctccccgccactcagacctgggtggtgataacctcaaagaatggctctgttttctattgacagaaaacccacttgattttgcttctgagttagcagtcagaagaccctctaagtacaatagaagtgctcttaacggactctgcctgtgtgactcccaggccccggagtctccatctctctcgtaagccacctgccacagcacagctggaggctgttctctggtgttctcagcgctccggctccctccctggagttgtgcacccgtcccaaactcctccatgcaagttctgcttcctcttataagtacacaactcagttaagtattcacatacacacagaaaatacgggtgtgaaaagaaagaattttctgtaaaaattaagttgaatactttggtaaaaagtgataaaggctgagttgccaataaaagttgcttttaaattaggtgtggctgggaatattataagatattggggaaaatatacaaatcaagaaaatttctgagcttagattgcttcatagatttatttaagtactcatcccacctttaaaacctctaaactgagaagaagggacccaaatcatgttattggtgtgatttatgtgagaagtagaactgtagtcattggacccttaggcaaaggaaaatccgtgtctttatatcagaagatcggcaaacgaatgtatattacacagtttaggttatgattccctactttaacctacttactttattaaatgaccaactactgatactgatcacaatagttattagagattctaatttagttggaaggttctaatcactttcattacaggcatttgaaaaatagggattcatttcgaatatattagccaggagcatagttagatgttacccaggccatttatcatcctgttaatgatgattttcccgacccttgtgagatcagcgtgacaggagtgtgtgtgtgtgtgtgtgtttctgtgggtgtgtggttttggttgggtgctgccaggtggcaaaggcatatgtaaatacatctgatctgcatctttatttcacagttaactaaaagtaaaaatgtctattctgattccatattgattttgtctaagatgtaaaaatttgagttcatctttggccaaaacctacctgaattaacatacaaaatatttgatttttaaaatttaattcaaatctcaaaatcaattaagtattctcagatcctatatcttggttaatatgctcccagatactttaaacatggcaaccttttggcctaagagaatgtttgttcatggaaaaaagcttttgagatgagagggtgtcttactttcttgtggcaattgattttctgttttaacaccctttgggtaaaatcttgcaaagagcttttataatttgttttactgaattgtatggagattgtataccaagtaaagctcttttaaattac

SEQ ID NO: 8833 - DNA, 6197 bp, Homo sapiens
aggagcgggcccccggaggccgaggggttcggcgacgcggagggagggagagtctgggccgcgcgggagccgcagggcgccctagccttcgcagaaacgatggcggaggaagaaggaccacctgtagagctgcgccaaagaaaaaagccaaagtcttcagaaaataaggaatctgccaaagaagagaaaatcagtgacattccaattcctgaaagagctccaaaacatgtattatttcaacgctttgcaaagattttcattggctgtcttgcagcggttactagtggtatgatgtatgctctctacttatcagcataccatgaacggaaattctggttttccaacaggcaggagcttgaacgggaaatcacgtttcagggtgacagtgccatttattactcctattataaagatatgttaaaggcaccttcatttgaaagaggtgtttacgaactgacacacaataacaaaactgtatctctgaagactataaatgcagtgcagcaaatgtctctgtatccggaacttattgctagcattttatatcaagccactggtagcaatgagattattgagccagtgtatttctatattggcattgtttttggattgcaaggaatatatgttactgctttatttgttacaagttggcttatgagtggaacatggctagcaggaatgcttactgttgcgtggttcgttattaacagggtagatacaacaagaattgaatactccattcctttaagagaaaactgggcactaccatattttgcatgccaaattgctgcacttacaggctatttaaaaagcaacttaaatacttatggagagaggttttgctacttgttgatgagtgcttcaacttacacatttatgatgatgtgggagtatagccactatctcctgtttcttcaagcaatatctctattcctgctagataccttttcagtggagcaaagtgacaaggtttatgaagtttataaaatctacatattttccctctttctgggatatttactacagtttgagaatccagctttgttggtatctcctttattaagtttagtagcagccttaatgcttgctaagtgccttcagctgaatgtgaagaaaggaagttttgtagctaaaataataaaagtgattaatttttacttggtgtgtactctgacaataacattgaatattataatgaagatgtttgtcccacacaaagaaaatgggcacatgctgaaattccttgaagtaaaatttggactaaatatgaccaagaattttacaatgaattggctcctctgtcaagaatccctgcaggcaccatctcaagatttttttctgcgattgacacagtcttctttattacctttctacattctagtgttaattatttgttttctttctatgttgcaagttatttttaggaggattaatggtaagtccctgaaggaaactgttactcttgaagatggacgaattggagaaagaccagaaataatttatcatgtaattcacactattttattgggttctcttgcaatggttatagaaggcttgaagtacatctggattccttatgtgtgcatgttagcagcatttggtgtatgttctcccgaactttggatgacacttttcaagtggcttcgattaagaactgtacacccaatattgttggctcttattctgagcatggccgtgcctactataataggtctcagcttatggaaagagttttttcccagattaatgacagaattaatggaactacaggaattctatgacccagatacagtggaacttatgacctggataaaaaggcaagctccagttgcagctgtgtttgcagggagtccacagttaatgggtgcgattaaattatgcactggatggatggtgacaagtttgcctctttacaatgatgatgatcttctcaagagaaatgaaaatatctaccaaatctattcaaagcgatctgctgaggatatttataaaatactgacatcttacaaagctaattacctaattgtagaggatgctatctgcaatgaggtgggacccatgagaggctgtagggttaaagatttattagacattgcaaatggccacatggtttgtgaagaaggtgacaagctaacctactcaaaatatgggcgattttgtcatgaggtcaaaattaactattctccatatgtgaattatttcactagagtatactggaacagatcctactttgtatataaaatcaacactgtgatatccttccagtcttgaaaaataacagagccttcatttcaaagactacctgaagtaaaatgcagttttcttctacctactcggtgtcttttgcagatcagagtatggacatttgaaatattgctgcttctttcccccttctgctgttaactggatccagagttctgtgggaaatagaagatcaagcattactgtcctttgattaaatgtgatatctaccactctgcaatattccagacaggtgtcttccttaccgttacatggtctttaacacttttactgattgcaatattttccccataaaatcttcattctattataatattgatcttgaatttgaatatgtgcaaggtcagatacatttctcaaacataacatttaataaataatgtgatataattatttaatagaaagaataattccgaccttcaagcaagtttctgaaggtattttatgatgtataacaactgaagttttacaataaaaactaatttaaatgttagctgaagatatgtggcatttaaattaaaatggaaattatataaaggaaagtgatttttaaggatatacataaagatatatttagaattttcatgatactgttctcctcatctactgcttatgttaagtgagaactttcttagtaatacataatgcatgatgttactgcattttctaaatgactagtaagtgattagttttttcacttatgcctattaatttgataccaatttaatcatgataaaacaataaccgttaacatatattttgttaaatggacatttaaaagaatgttgttcaggttttttttttaaatactgatatggggcatacaatctattcacatgttttctactgaagtactaagtaaaaaaattaaatcattatcagaataaaaatatgtgttctaaaattagcaacaatttctggggatacatgcagatgttgttaaacgtacctctgcatacagatatattataaaacacaagcaatgttatttatgaaactgtgatgcagtcttcaacatcaagaaaaaatgacaactataataaaatttacaacacagtttcacagtctaaatgctatgttcctttaagtattttcatatttttaatcatttattaagagaaaattgtgaaaagttaatttggccttatagagagattcaggatagatgtagcctatagatgtgtcattttaataagttgggatacatgtttagtttttccttatattcctgttcagtgaacagattttcataattctcacttgttaaagtgctgcaaaaattgcattttcagtactctaaattactacattagaagagagcatttctccattgtctttattttctgttatatatgtgttgtaaaagtacactacattagaagggagcttttccgttgtctttattttctgttatacatgtgttgttaaagtacatgcattcttagactaactctcagatgctttgctcttttggagctgaagaattgtttgatggtgatgtcatatatctgatagattagtttcagtggttctcatttcacttttatacgtaatttcttaactatattaagatagttgcaggcagtgtacctcaggttgactctgtacatctgaatagtgagtcactagtattttgcttcaagccttctgaaaatataaccatagttacctaagcacacagtgaatagtcacatggtagtacttgtgattagagcatgtaaaacaatgtaattgaaaagtcagcttccatattttgtaggggaaatagaacaccctactttttatctagtgtgaaatatttaatcgaatttttgttgatttatattatgttacctgtgctgaattaggtttggtacttgtgttttgtttgacatattagtaagttgcttttgcttctttctgtcaacttattttttaaataaaattgatctggaaaaattgttaatgggatgttttaaataatgaatttttcatccagcatcagttgaaaaggaaaagaaagcttcattatggaaatgacaatattgaatatgacagataagtttatttgcttctgttttaactgcagttaatagtactagacaactttaagtggaaagcatttagtttatttcttcacttatttgtagagtgaacaaatgattcacaattctacaagtaattccacttaggtaacttacagttgttaggtttgacaataaagatctactatgagaggagaagaatttatgggttttgggtggaaggaatttctcaaagaaataaaaaatgttctttgcccttgatactgcaaacccactgatacaagtgccttgaatttattattattattattttttatttttttgagatggagtttcactcttgtctcccaggctggagtgcaatggcgcgatcttggctcactgcaacctccgctcgctgcaacctccgcctcccaggttcaagtgattctcctgcctcagcctccggagtagctgggattacaggcacctgccaccaagcacggctaatttttgtatttttagtagaaacggggtttcgccatgttggccaggctggtctcgaactcctgacctcagatgatccactcaccccagcctcccaaagtgctgggattacagacgtgagccactgcgcccggcgcaagtctttgttaaaagtagagatggaggccaggcgcagtggctcactcctgtaatcccagcactttgggaggctgaggcaggcagatcacgaggtcaggagatcgagaccatcttggctaacacggtgaaaccccgtctctactgaaaatacaaaaaattagccgggcagggtggcgggcgcctgtagtcccagctactccgaggctgaagcaggagaatggcgtcaagcggcgaggcggagcttgcggtgagccgagatcatgccgctgcactccagcctgggcaacagagcaagactccatctcaaaaagaaaaaaaaagtagagatgggatctctagcctcctaagttaatttagcctcccaaatgccagacaaagaatctaacataaaatttaccttgaataagatatatgatattgattctgagctgctttgtattttttctgactttggcatctgtatcttggtgctttctgttagactggtagagtttaagaacctaaggagtatgcattgtacttcagtgctaacttttttcttcatttactttctgtgtatataggcagcatattttttttgtagaacattaacccagattgctaatagcttcatgttacggcattcttccacacagtccagattgatttaaggaaaagcagaaatggaagtcaaagtgtgttataaattgagactgaaaaacatgctttaaaaaatagatttaatttcttacactgtgaatagccattgtattgttttgtttctgataaatcagttgttttgggcccctatttttgaactgttaaaaaattttgatgcttttcgtggataaaagtagtgcctctctttatacaactgatggggttttaaaaagtgtaaattgccttttttgttaaacttattttaaatgctttagtatttaaagggtgtatgttattaattaatctgcatatttgtaacgcaaataactacttcctgatttacatctcaatatattcttctttcatttgcccaatttaaaaaatacgtagtctctattgttgctgtttactaatagttttagatcccaatgtgtattagaattatagctacaaaaagttgcaagtaaaatttagcaatttcctattcaaacaggatctcattagtatgttttttaatgtgtagaattaacactttaaaataaacaggtgtgaaaattataaaggaatatatatgacaattattttctgtacattaatgtctaaacattatacttactttttcataataaaggaaattttggaaccaaa

SEQ ID NO: 8834 - DNA, 631 bp, Homo sapiens
acggccggagctgtttgtgctgggagctggtggcgcggtgcagggctcttaagaacgaacggcttgggcgcgggtaatcagctccctttcccccactttctcacttattctaggtacttgggactgtcgtagagtttccagaccccatgtaggcgcccagtcgtggactgtcccactctgctgctctactgctcgtggtgctcccgcgcccagactggtatccggggactgtgacttgcagggtccgccatggagccagagcagatgctggagggacaaacgcaggttgcagaaaatcctcactctgagtacggtctcacagacaacgttgagagaatagtagaaaatgagaagattaatgcagaaaagtcatcaaagcagaaggtagatctccagtctttgccaactcgtgcctacctggatcagacagttgtgcctatcttattacagggacttgctgtgcttgcaaaggaaagaccaccaaatcccattgaatttctagcatcttatcttttaaaaaacaaggcacagtttgaagatcgaaactgacttaatgggaagaacagaaaaatttagttgctactgtagatttacatgattaagaggcagctttaattgccatgatcattcc

SEQ ID NO: 8835 - DNA, 708 bp, Homo sapiens
gtcacttacggccggagctgtttgtgctgggagctggtggcgcggtgcagggctcttaagaacgaacggcttgggcgcggactggtatccggggactgtgacttgcagggtccgccatggagccagagcagatgctggagggacaaacgcaggttgcagaaaatcctcactctgagtacggtctcacagacaacgttgagagaatagtagaaaatgagaagattaatgcagaaaagtcatcaaagcagaaggtagatctccagtctttgccaactcgtgcctacctggatcagacagttgtgcctatcttattacagggacttgctgtgcttgcaaaggaaagaccaccaaatcccattgaatttctagcatcttatcttttaaaaaacaaggcacagtttgaagatcgaaactgacttaatgggaagaacagaaaaatttagttgctactgtagatttacatgattaagaggcagctttaattgccatgatcattccctctttttggatgtataagaaccttccggacaacagaacctatttctggaattgcagaagataacatatttcccttattttgatttaatcaccataaaccatacctatttaatgagtgtattctgtgcaatttttttctcagattgtctttaactttgtttttaaaatgaccttcaaaataaactgtcaaaacaccattattttaaagta

SEQ ID NO: 8836 - DNA, 3072 bp, Homo sapiens
ggcggccggacgcggcccggaggcgcggggtcccgatgtggggcccggggccgcgtggccctgcgggagcccatcccccaccctaccccccgggcccgggggacaggtgtgcacggggcggccaagggcaccttcgccaccttcgagcgggcgaggtccgggcggggacggggcggggaccgagctagcggagccagcgcagcctgcccggctcagcccggcccggccacagcacaaaggaaagcgagggcgggggaggagcggagcgggctgggggccgggcgccccgcccaccggggggcctctcggagtgggccgccctccccccgaaacctgggctggagtgaggtggaaggatgtttgctgccacatggcgaccgcgaagtgactcccttaccgccgcgggtcgcggaggaggcagggggaaggtgcccatctggttcctaggcctcctctccctgctggcagatgggaacaggttcttcttgaggaaactgaggcaaagaggagggcaggtctgagggaccccgcttgggctggcctcacccgcacactgggagggcagccaggtggggactctgacctgggggcttctggaggagaggatgagatggctgggcatccatggcatggtactgcagcactggccagcagccaggcctggagggatggacgcgagagacaagctctcgtgtcctgcagggctctgtacacatatgaagatggctccgatgacctcaagcttgcagcatcaggagaagggggcttgcaggagctttcgggacactttgagaaccagaaggtgatgtacggcttctgcagtgtcaaggactcccaagctgctctgccaaaatacgtgctcatcaactgggtgggcgaagatgtgcctgatgcccgcaagtgcgcttgtgccagccacgtggctaaggtggcggagttcttccagggtgtcgacgtgatcgtgaacgccagcagcgtggaagacatagacgcgggtgccatcgggcagcggctctctaacgggctggcgcgactctccagccctgtgctgcaccgactgcggctgcgagaggatgagaacgcagagcccgtgggcaccacctaccagaagacggatgcagctgtggaaatgaagcggattaaccgagagcagttctgggagcaggccaagaaggaagaagagctgcggaaggaggaggagcggaagaaggccctggatgagaggctcaggttcgagcaggagcggatggagcaggagcggcaggagcaagaggagcgcgagcggcgctaccgggagcgggagcagcagatcgaggagcacaggaggaaacagcagactttagaagcggaagaggccaagaggcggttgaaggagcagtctatctttggtgaccatcgggatgaggaggaagagacccacatgaagaagtcagagtcggaggtggaggaggcagcagctattattgcccagcggcctgacaacccaagggagttcttcaagcagcaggaaagagtcgcatcggcctctgcgggcagctgtgatgtaccctcgcccttcaaccatcgaccaggcagccacctggacagccaccggaggatggcgcccactcccatccccacgcggagcccgtctgactccagcaccgcctccacccctgtcgctgagcagatagagcgggccctggatgaggtcacctcctcgcagcctccaccactgccaccgccacccccaccagcccaagagacccaggagcccagccccatcctagacagtgaggagaccagagcagcagcccctcaggcctgggccggccccatggaggagccccctcaggcacaggcgcctccccgggggccaggcagccctgcagaggacttgatgttcatggagtctgcagagcaggctgtcctggctgctcccgtggagcctgccacagctgacgccacggagatccacgatgcagctgacaccattgaaactgacactgccactgctgacaccactgttgccaacaacgtaccccccgccgccaccagcctcattgacctatggcctggcaacggggaaggggcctccacactccagggtgagcccagggcccccacgccaccctcgggtactgaggtcaccctggcagaggtgcccctgctggatgaggtggctccggagccactgctgccagcaggcgaaggctgtgccacccttctcaactttgatgagctgcctgagccgccagccaccttctgtgacccagaggaagtggaaggggagtccctggctgccccccagaccccaactctgccctcagcccttgaggagctggagcaagagcaggagccggagccccacctgctaaccaatggcgagaccacccagaaggaggggacccaggccagtgaggggtacttcagtcaatcacaggaggaggagtttgcccaatcggaagagctctgtgccaaggctccgcctcctgtgttctacaacaagcctccagagatcgacatcacatgctgggatgcagacccagttccagaagaggaggagggcttcgagggtggtgattagcggtggcgccagccctaggctacccttgccaaggccgcccacctgcatcagcctctggccagacggcccgccgtgcctgcattcgcagcagctccgcctggcacccactccggattccggccctggctggggacttggccgcttccctacccacagggcctgacttttacagcttttctctttttttaaaaagttgataggagacttgtacagttgactggctttcctctcgttggtagttgagacgctgttgcaaattccacccctccttccctggtccagattgtagctcttagtcctccctgctcagctggccgggttggaggcctcaccctgcttggggcctggcgtggggggagctctggtgggaaaatgtcccccacctcttttcctagttttatgtttcttgggaaaatatcactttgtattctctgtccagggcttcagatattttgcacgaattttaaaacatggcaataaatggctcgtgggctctggctccctgg

SEQ ID NO: 8837 - DNA, 2995 bp, Homo sapiens
gggcggcgctaggaccgagcgagcggagggagcgagccgggcggagccagcgccccccgccccccgccggccggctcccctcccccggccgctggctcgctcggctcgcgacgctgcagaggctccgaggcggcggcggcgactccctctttccctccctcctcctccgtccgcccgtccgtccgcgcgtctgtccgttcggcccggtccggcccgaagcatggccggcgtcagcttcagcggccaccgcctggagctgctggcggcttacgaggaggtgatccgagaggagagcgcggccgactgggctctgtacacatatgaagatggctccgatgacctcaagcttgcagcatcaggagaagggggcttgcaggagctttcgggacactttgagaaccagaaggtgatgtacggcttctgcagtgtcaaggactcccaagctgctctgccaaaatacgtgctcatcaactgggtgggcgaagatgtgcctgatgcccgcaagtgcgcttgtgccagccacgtggctaaggtggcggagttcttccagggtgtcgacgtgatcgtgaacgccagcagcgtggaagacatagacgcgggtgccatcgggcagcggctctctaacgggctggcgcgactctccagccctgtgctgcaccgactgcggctgcgagaggatgagaacgcagagcccgtgggcaccacctaccagaagacggatgcagctgtggaaatgaagcggattaaccgagagcagttctgggagcaggccaagaaggaagaagagctgcggaaggaggaggagcggaagaaggccctggatgagaggctcaggttcgagcaggagcggatggagcaggagcggcaggagcaagaggagcgcgagcggcgctaccgggagcgggagcagcagatcgaggagcacaggaggaaacagcagactttagaagcggaagaggccaagaggcggttgaaggagcagtctatctttggtgaccatcgggatgaggaggaagagacccacatgaagaagtcagagtcggaggtggaggaggcagcagctattattgcccagcggcctgacaacccaagggagttcttcaagcagcaggaaagagtcgcatcggcctctgcgggcagctgtgatgtaccctcgcccttcaaccatcgaccaggcagccacctggacagccaccggaggatggcgcccactcccatccccacgcggagcccgtctgactccagcaccgcctccacccctgtcgctgagcagatagagcgggccctggatgaggtcacctcctcgcagcctccaccactgccaccgccacccccaccagcccaagagacccaggagcccagccccatcctagacagtgaggagaccagagcagcagcccctcaggcctgggccggccccatggaggagccccctcaggcacaggcgcctccccgggggccaggcagccctgcagaggacttgatgttcatggagtctgcagagcaggctgtcctggctgctcccgtggagcctgccacagctgacgccacggagatccacgatgcagctgacaccattgaaactgacactgccactgctgacaccactgttgccaacaacgtaccccccgccgccaccagcctcattgacctatggcctggcaacggggaaggggcctccacactccagggtgagcccagggcccccacgccaccctcgggtactgaggtcaccctggcagaggtgcccctgctggatgaggtggctccggagccactgctgccagcaggcgaaggctgtgccacccttctcaactttgatgagctgcctgagccgccagccaccttctgtgacccagaggaagtggaaggggagtccctggctgccccccagaccccaactctgccctcagcccttgaggagctggagcaagagcaggagccggagccccacctgctaaccaatggcgagaccacccagaaggaggggacccaggccagtgaggggtacttcagtcaatcacaggaggaggagtttgcccaatcggaagagctctgtgccaaggctccgcctcctgtgttctacaacaagcctccagagatcgacatcacatgctgggatgcagacccagttccagaagaggaggagggcttcgagggtggtgattagcggtggcgccagccctaggctacccttgccaaggccgcccacctgcatcagcctctggccagacggcccgccgtgcctgcattcgcagcagctccgcctggcacccactccggattccggccctggctggggacttggccgcttccctacccacagggcctgacttttacagcttttctctttttttaaaaagttgataggagacttgtacagttgactggctttcctctcgttggtagttgagacgctgttgcaaattccacccctccttccctggtccagattgtagctcttagtcctccctgctcagctggccgggttggaggcctcaccctgcttggggcctggcgtggggggagctctggtgggaaaatgtcccccacctcttttcctagttttatgtttcttgggaaaatatcactttgtattctctgtccagggcttcagatattttgcacgaattttaaaacatggcaataaatggctcgtgggctctggctccctgggaccccctccccgcccttcttttgaccccttcctgtctggcccaaaggaagtagcaggcccagctggggcccctcggctaccccccgtctcctgccgggcaggtcccaggttggaggccctaggcgcggttcaggtcagggctatggatggggcccaggggctttggtggcccctccccaactccttcctctttgcttgggttcctttttcacgtttagtaactgttttttttttttttttttttttttttttggaaagcacaaacttctgtaacgggtcgtgctcatgtctgttaataaagaaatccagatcccttcg

SEQ ID NO: 8838 - DNA, 1403 bp, Homo sapiens
acgctgcagctggaaaccagagggcctggcccccgggtggggagcaggcatttgggagggaggccagtctcccatgctgaggcttggaggtgggaacgggtgtgcctgttctgggaactgactgcgtcgtgctgaggacttgatgtctacatctcacaggtgaccatcgggatgaggaggaagagacccacatgaagaagtcagagtcggaggtggaggaggcagcagctattattgcccagcggcctgacaacccaagggagttcttcaagcagcaggaaagagtcgcatcggcctctgcgggcagctgtgatgtaccctcgcccttcaaccatcgaccaggcagccacctggacagccaccggaggatggcgcccactcccatccccacgcggagcccgtctgactccagcaccgcctccacccctgtcgctgagcagatagagcgggccctggatgaggtcacctcctcgcagcctccaccactgccaccgccacccccaccagcccaagagacccaggagcccagccccatcctagacagtgaggagaccagagcagcagcccctcaggcctgggccggccccatggaggagccccctcaggcacaggcgcctccccgggggccaggcagccctgcagaggacttgatgttcatggagtctgcagagcaggctgtcctggctgctcccgtggagcctgccacagctgacgccacggagatccacgatgcagctgacaccattgaaactgacactgccactgctgacaccactgttgccaacaacgtaccccccgccgccaccagcctcattgacctatggcctggcaacggggaaggggcctccacactccagggtgagcccagggcccccacgccaccctcgggtactgaggtcaccctggcagaggtgcccctgctggatgaggtggctccggagccactgctgccagcaggcgaaggctgtgccacccttctcaactttgatgagctgcctgagccgccagccaccttctgtgacccagaggaagtggaaggggagtccctggctgccccccagaccccaactctgccctcagcccttgaggagctggagcaagagcaggagccggagccccacctgctaaccaatggcgagaccacccagaaggaggggacccaggccagtgaggggtacttcagtcaatcacaggaggaggagtttgcccaatcggaagagctctgtgccaaggctccgcctcctgtgttctacaacaagcctccagagatcgacatcacatgctgggatgcagacccagttccagaagaggaggagggcttcgagggtggtgattagcggtggcgccagccctaggctacccttgccaaggccgcccacctgcatcagcctctggccagacgg

SEQ ID NO: 8839 - DNA, 1044 bp, Homo sapiens
ggcggcggcggcgactccctctttccctccctcctcctccgtccgcccgtccgtccgcgcgtctgtccgttcggcccggtccggcccgaagcatggccggcgtcagcttcagcggccaccgcctggagctgctggcggcttacgaggaggtgatccgagaggagagcgcggccgactgggctctgtacacatatgaagatggctccgatgacctcaagcttgcagcatcaggagggggcttgcaggagctttcgggacactttgagaaccagaaggtgatgtacggcttctgcagtgtcaaggactcccaagctgctctgccaaaatacgtgctcatcaactgggtgggcgaagatgtgcctgatgcccgcaagtgcgcttgtgccagccacgtggctaaggtggcggagttcttccagggtgtcgacgtgatcgtgaacgccagcagcgtggaagacatagacgcgggtgccatcgggcagcggctctctaacgggctggcgcgactctccagccctgtgctgcaccgactgcggctgcgagaggatgagaacgcagagcccgtgggcaccacctaccagaagacggatgcagctgtggaaatgaagcggattaaccgagagcagttctgggagcaggccaagaaggaagaagagctgcggaaggaggaggagcggaagaaggccctggatgagaggctcaggttcgagcaggagcggatggagcaggagcggcaggagcaagaggagcgcgagcggcgctaccgggagcgggagcagcagatcgaggagcacaggaggaaacagcagactttagaagcggaagaggccaagaggcggttgaaggagcagtctatctttggtgaccatcgggatgaggaggaagagacccacatgaagaagtcagagtcggaggtggaggaggcagcagctattattgcccagcggcctgacaacccaagggagttcttcaagcagcaggaaagagtcgcatcggcctctgcgggcagctgtgatgtaccctcgcccttcaaccatcgaccag

SEQ ID NO: 8840 - DNA, 456 bp, Homo sapiens
aaaggatctcctagctggccccatctgagagggcacaggcgtggaggggaggagaggcctggaatggagggataatgagctggcatggccggcgtcagcttcagcggccaccgcctggagctgctggcggcttacgaggaggtgatccgagaggagagcgcggccgactgggctctgtacacatatgaagatggctccgatgacctcaagcttgcagcatcaggagaagggggcttgcaggagctttcgggacactttgagaaccagaaggtgatgtacggcttctgcagtgtcaaggactcccaagctgctctgccaaaatacgtgctcatcaactgggtgggcgaagatgtgcctgatgcccgcaagtgcgcttgtgccagccacgtggctaaggtggcggagttcttccagggtgtcgacgtgatcgtgaacgccagcagcgtggaagacata

SEQ ID NO: 8841 - DNA, 4179 bp, Homo sapiens
cacagaatgtcgttccacccgggacgagggtgtccccgaggacgaggaggacatggagccagaccctcagcaccatcctttaggccccaaaatctgaggctgcttcaccctcagcagcctcctgtgcaatatcaatatgaacctccaagtgccccttccaccactttctcaaactctccagcccccaattttctccctccacgaccagactttgtacccttccccccacccatgcctccgtcagcgcaaggccctcttcccccctgcccaatcaggccgcctttccccaaccaccagatgaggcaccccttcccagttcctccttgttttcctcccatgccaccaccaatgccttgtcctaataaccccccagtccctggggcacctcctggacaaggcactttccccttcatgatgccccctccctccatgcctcatcccccgccccctccagtcatgccgcagcaggttaattatcagtaccctccgggctattctcaccacaacttcccacctcccagttttaatagtttccagaacaaccctagttctttcctgcccagtgctaataacagcagtagtcctcatttcagacatctccctccatacccactcccaaaggctcccagtgagagaaggtccccagaaaggctgaaacactatgatgaccacaggcaccgagatcacagtcatgggcgaggtgagaggcatcggtccctggatcggcgggagcgaggccgcagtcccgacaggagaagacaagacagccggtacagatctgattatgaccgagggagaacaccatctcgccaccgcagctacgaacggagcagtcgctccccaagtagggagaagaagagagctcgttgggaggaagaaaaagaccgttggagtgacaaccagagttctggcaaagacaagaactatacctcaatcaaggaaaaagagcccgaggagaccatgcctgacaagaatgaggaggaagaagaagaacttcttaagcctgtgtggattcgatgcactcattcagaaaactactactccagtgaccccatggatcaggtgggagattctacagtggttggaacgagtaggcttcgtgacttatatgacaaatttgaggaggagttggggagcaggcaagaaaaggccaaagctgctcggcctccgtgggaacctccaaagacgaagctcgatgaagatttagagagttccagtgaatccgagtgtgagtctgatgaggacagcacctgttctagcagctcagactctgaagtttttgacgttattgcagaaatcaaacgcaaaaaggcccaccctgaccgacttcatgatgaactttggtacaacgatccaggccagatgaatgatggaccactctgcaaatgcagcgcaaaggcaagacgcacaggaattaggcacagcatttatcctggagaagaggccatcaagccctgtcgtcctatgaccaacaatgctggcagacttttccactaccggatcacagtctccccgcctacgaactttttaactgacaggccaactgttatagaatacgatgatcacgagtatatctttgaaggattttctatgtttgcacatgcccccctgaccaatattccactgtgtaaagtaattagattcaacatagactacacgattcatttcattgaagagatgatgccggagaatttttgtgtgaaagggcttgaactcttttcactgttcctattcagagatattttggaattatatgactggaatcttaaaggtcctttgtttgaagacagccctccctgctgcccaagatttcatttcatgccacgttttgtaagatttcttccagatggaggaaaggaagtgctgtccatgcaccagattctcctgtacttgttaaggtgcagcaaagccctggtgcctgaggaggagattgccaatatgcttcagtgggaggagctggagtggcagaaatatgcagaagaatgcaaaggcatgattgttaccaaccctgggacgaaaccaagctctgtccgtatcgatcaactggatcgtgaacagttcaaccccgatgtgattacttttccgattatcgtccactttgggatacgccctgcacagttgagttatgcaggagacccacagtaccaaaaactgtggaagagttatgtgaaacttcgccacctcctagcaaatagtcccaaagtcaaacaaactgacaaacagaagctggcacagagggaggaagccctccaaaaaatacggcagaagaatacaatgagacgagaagtaacggtggagctaagtagccaaggattctggaaaactggcatccgttctgatgtctgtcagcatgcaatgatgctacctgttctgacccatcatatccgctaccaccaatgcctaatgcatttggacaagttgataggatatactttccaagatcgttgtctgttgcagctggccatgactcatccaagtcatcatttaaattttggaatgaatcctgatcatgccaggaattcattatctaactgtggaattcggcagcccaaatacggagacagaaaagttcatcacatgcacatgcggaagaaagggattaacaccttgataaatatcatgtcacgccttggccaagatgacccaactccctcgaggattaaccacaatgaacggttggaattcctgggtgatgctgttgttgaatttctgaccagcgtccatttgtactatttgtttcctagtctggaagaaggaggattagcaacctatcggactgccattgttcagaatcagcaccttgccatgctagcaaagaaacttgaactggatcgatttatgctgtatgctcacgggcctgacctttgtagagaatcggaccttcgacatgcaatggccaattgttttgaagcgttaataggagctgtttacttggagggaagcctggaggaagccaagcagttatttggacgcttgctctttaatgatccggacctgcgcgaagtctggctcaattatcctctccacccactccaactacaagagccaaatactgatcgacaacttattgaaacttctccagttctacaaaaacttactgagtttgaagaagcaattggagtaatttttactcatgttcgacttctggcaagggcattcacattgagaactgtgggatttaaccatctgaccctaggccacaatcagagaatggaattcctaggtgactccataatgcaactggtagccacagagtacttattcattcatttcccagatcatcatgaaggacacttaactttgttgcgaagctctttggtgaataatagaactcaggccaaggtagcggaggagctgggcatgcaggagtacgccataaccaacgacaagaccaagaggcctgtggcgcttcgcaccaagaccttggcggaccttttggaatcatttattgcagcgctgtacattgataaggatttggaatatgttcatactttcatgaatgtctgcttctttccacgattgaaagagttcattttgaatcaggattggaatgaccccaaatcccagcttcagcagtgttgcttgacacttaggacagaaggaaaagagccagacattcctctgtacaagactctgcagacagtgggcccatcccatgcccgaacctacactgtggctgtttatttcaagggagaaagaataggctgtgggaaaggaccaagtattcagcaagcggaaatgggagcagcaatggatgcgcttgaaaaatataattttccccagatggcccatcagaagcggttcatcgaacggaagtacagacaagagttaaaagaaatgaggtgggaaagagagcatcaagagagagagccagatgagactgaagacatcaagaaataaaggagggcatgcaagtgtggagtatttacttgctcagtaactgtgactgttgtctattgagacctagcctagttttcctgcagacaatgaatgaagtgtgctcattgaaataaaatacagagtcaaatcgctattgttgttttaatgatctgtttttagctggatggtctttattacaaagtattagatttttcttctatttaacggaaaacttgactttggtgaatgtgcattacttccttttattttgctctttaaataataaaattcaagaagcat

SEQ ID NO: 8842 - DNA, 5102 bp, Homo sapiens
gagcttatattctctgtggaagatgtgacatatccaggcggaacatcatgatgcagggaaacacatgtcacagaatgtcgttccacccgggacgagggtgtccccgaggacgaggaggacatggagccagaccctcagcaccatcctttaggccccaaaatctgaggctgcttcaccctcagcagcctcctgtgcaatatcaatatgaacctccaagtgccccttccaccactttctcaaactctccagcccccaattttctccctccacgaccagactttgtacccttccccccacccatgcctccgtcagcgcaaggccctcttcccccctgcccaatcaggccgcctttccccaaccaccagatgaggcaccccttcccagttcctccttgttttcctcccatgccaccaccaatgccttgtcctaataaccccccagtccctggggcacctcctggacaaggcactttccccttcatgatgccccctccctccatgcctcatcccccgccccctccagtcatgccgcagcaggttaattatcagtaccctccgggctattctcaccacaacttcccacctcccagttttaatagtttccagaacaaccctagttctttcctgcccagtgctaataacagcagtagtcctcatttcagacatctccctccatacccactcccaaaggctcccagtgagagaaggtccccagaaaggctgaaacactatgatgaccacaggcaccgagatcacagtcatgggcgaggtgagaggcatcggtccctggatcggcgggagcgaggccgcagtcccgacaggagaagacaagacagccggtacagatctgattatgaccgagggagaacaccatctcgccaccgcagctacgaacggagcagagagcgagaacgggagagacacaggcatcgagacaaccgaagatcaccatctctggaaaggtcctacaaaaaagagtataagagatctggaaggagttacggtttatcggttgttcctgaacctgctggatgcacaccagaattacctggggagattattaaaaatacagattcttgggccccacccctggagattgtgaatcatcgctccccaagtagggagaagaagagagctcgttgggaggaagaaaaagaccgttggagtgacaaccagagttctggcaaagacaagaactatacctcaatcaaggaaaaagagcccgaggagaccatgcctgacaagaatgaggaggaagaagaagaacttcttaagcctgtgtggattcgatgcactcattcagaaaactactactccagtgaccccatggatcaggtgggagattctacagtggttggaacgagtaggcttcgtgacttatatgacaaatttgaggaggagttggggagcaggcaagaaaaggccaaagctgctcggcctccgtgggaacctccaaagacgaagctcgatgaagatttagagagttccagtgaatccgagtgtgagtctgatgaggacagcacctgttctagcagctcagactctgaagtttttgacgttattgcagaaatcaaacgcaaaaaggcccaccctgaccgacttcatgatgaactttggtacaacgatccaggccagatgaatgatggaccactctgcaaatgcagcgcaaaggcaagacgcacaggaattaggcacagcatttatcctggagaagaggccatcaagccctgtcgtcctatgaccaacaatgctggcagacttttccactaccggatcacagtctccccgcctacgaactttttaactgacaggccaactgttatagaatacgatgatcacgagtatatctttgaaggattttctatgtttgcacatgcccccctgaccaatattccactgtgtaaagtaattagattcaacatagactacacgattcatttcattgaagagatgatgccggagaatttttgtgtgaaagggcttgaactcttttcactgttcctattcagagatattttggaattatatgactggaatcttaaaggtcctttgtttgaagacagccctccctgctgcccaagatttcatttcatgccacgttttgtaagatttcttccagatggaggaaaggaagtgctgtccatgcaccagattctcctgtacttgttaaggtgcagcaaagccctggtgcctgaggaggagattgccaatatgcttcagtgggaggagctggagtggcagaaatatgcagaagaatgcaaaggcatgattgttaccaaccctgggacgaaaccaagctctgtccgtatcgatcaactggatcgtgaacagttcaaccccgatgtgattacttttccgattatcgtccactttgggatacgccctgcacagttgagttatgcaggagacccacagtaccaaaaactgtggaagagttatgtgaaacttcgccacctcctagcaaatagtcccaaagtcaaacaaactgacaaacagaagctggcacagagggaggaagccctccaaaaaatacggcagaagaatacaatgagacgagaagtaacggtggagctaagtagccaaggattctggaaaactggcatccgttctgatgtctgtcagcatgcaatgatgctacctgttctgacccatcatatccgctaccaccaatgcctaatgcatttggacaagttgataggatatactttccaagatcgttgtctgttgcagctggccatgactcatccaagtcatcatttaaattttggaatgaatcctgatcatgccaggaattcattatctaactgtggaattcggcagcccaaatacggagacagaaaagttcatcacatgcacatgcggaagaaagggattaacaccttgataaatatcatgtcacgccttggccaagatgacccaactccctcgaggattaaccacaatgaacggttggaattcctgggtgatgctgttgttgaatttctgaccagcgtccatttgtactatttgtttcctagtctggaagaaggaggattagcaacctatcggactgccattgttcagaatcagcaccttgccatgctagcaaagaaacttgaactggatcgatttatgctgtatgctcacgggcctgacctttgtagagaatcggaccttcgacatgcaatggccaattgttttgaagcgttaataggagctgtttacttggagggaagcctggaggaagccaagcagttatttggacgcttgctctttaatgatccggacctgcgcgaagtctggctcaattatcctctccacccactccaactacaagagccaaatactgatcgacaacttattgaaacttctccagttctacaaaaacttactgagtttgaagaagcaattggagtaatttttactcatgttcgacttctggcaagggcattcacattgagaactgtgggatttaaccatctgaccctaggccacaatcagagaatggaattcctaggtgactccataatgcaactggtagccacagagtacttattcattcatttcccagatcatcatgaaggacacttaactttgttgcgaagctctttggtgaataatagaactcaggccaaggtagcggaggagctgggcatgcaggagtacgccataaccaacgacaagaccaagaggcctgtggcgcttcgcaccaagaccttggcggaccttttggaatcatttattgcagcgctgtacattgataaggatttggaatatgttcatactttcatgaatgtctgcttctttccacgattgaaagagttcattttgaatcaggattggaatgaccccaaatcccagcttcagcagtgttgcttgacacttaggacagaaggaaaagagccagacattcctctgtacaagactctgcagacagtgggcccatcccatgcccgaacctacactgtggctgtttatttcaagggagaaagaataggctgtgggaaaggaccaagtattcagcaagcggaaatgggagcagcaatggatgcgcttgaaaaatataattttccccagatggcccatcagaagcggttcatcgaacggaagtacagacaagagttaaaagaaatgaggtgggaaagagagcatcaagagagagagccagatgagactgaagacatcaagaaataaaggagggcatgcaagtgtggagtatttacttgctcagtaactgtgactgttgtctattgagacctagcctagttttcctgcagacaatgaatgaagtgtgctcattgaaataaaatacagagtcaaatcgctattgttgttttaatgatctgtttttagctggatggtctttattacaaagtattagatttttcttctatttaacggaaaacttgactttggtgaatgtgcattacttccttttattttgctctttaaataataaaattcaagaagcatattctatgtggaatagatcctgtttttccatctgtgtcccagattgtgaccctagactttcaattgacaagtaaaaaattgactttactagacattttgactgtgctctagtaacatctatcctttttcaaatctctggatttttaagtagattgttcagctttcatccggtggctgttcatcaagttatcagctgcaaatattgaacttacctctctctaagcagtgagtgttttgtagaaggaatccgtttaacaattaattggctaatgggagaaggggaaagactgatattcaagtcatacagattctttgaatcattagaataggagagaaatcatgattctaagccaggccacactttaaaccaagtgctctcaccctggggttagtggaacctttaagaagttaatgaacagacttcaaggaagtcaaaaacctcccaatactatattcaattttctgtgtgtgtttgagatttgagagggcatggggagcaggaaggaggagggtttatagcttttatcagcctctctaagtgggccctgcagtaaaaggctaacatgacattcaaagacataacattttaaaaaaagttattccaaactaaacatcactggtttcttattaataaaggcaaaacttctttgt

SEQ ID NO: 8843 - DNA, 3558 bp, Homo sapiens
cacagaatgtcgttccacccgggacgagggtgtccccgaggacgaggaggacatggagccagaccctcagcaccatcctttaggccccaaaatctgaggctgcttcaccctcagcagcctcctgtgcaatatcaatatgaacctccaagtgccccttccaccactttctcaaactctccagcccccaattttctccctccacgaccagactttgtacccttccccccacccatgcctccgtcagcgcaaggccctcttcccccctgcccaatcaggccgcctttccccaaccaccagatgaggcaccccttcccagttcctccttgttttcctcccatgccaccaccaatgccttgtcctaataaccccccagtccctggggcacctcctggacaaggcactttccccttcatgatgccccctccctccatgcctcatcccccgccccctccagtcatgccgcagcaggttaattatcagtaccctccgggctattctcaccacaacttcccacctcccagttttaatagtttccagaacaaccctagttctttcctgcccagtgctaataacagcagtagtcctcatttcagacatctccctccatacccactcccaaaggctcccagtgagagaaggtccccagaaaggctgaaacactatgatgaccacaggcaccgagatcacagtcatgggcgaggtgagaggcatcggtccctggatcggcgggagcgaggccgcagtcccgacaggagaagacaagacagccggtacagatctgattatgaccgagggagaacaccatctcgccaccgcagctacgaacggagcagagagcgagaacgggagagacacaggcatcgagacaaccgaagatcaccatctctggaaaggtcctacaaaaaagagtataagagatctggaagtcgctccccaagtagggagaagaagagagctcgttgggaggaagaaaaagaccgttggagtgacaaccagagttctggcaaagacaagaactatacctcaatcaaggaaaaagagcccgaggagaccatgcctgacaagaatgaggaggaagaagaagaacttcttaagcctgtgtggattcgatgcactcattcagaaaactactactccagtgaccccatggatcaggtgggagattctacagtggttggaacgagtaggcttcgtgacttatatgacaaatttgaggaggagttggggagcaggcaagaaaaggccaaagctgctcggcctccgtgggaacctccaaagacgaagctcgatgaagatttagagagttccagtgaatccgagtgtgagtctgatgaggacagcacctgttctagcagctcagactctgaagtttttgacgttattgcagaaatcaaacgcaaaaaggcccaccctgaccgacttcatgatgaactttggtacaacgatccaggccagatgaatgatggaccactctgcaaatgcagcgcaaaggcaagacgcacaggaattaggcacagcatttatcctggagaagaggccatcaagccctgtcgtcctatgaccaacaatgctggcagacttttccactaccggatcacagtctccccgcctacgaactttttaactgacaggccaactgttatagaatacgatgatcacgagtatatctttgaaggattttctatgtttgcacatgcccccctgaccaatattccactgtgtaaagtaattagattcaacatagactacacgattcatttcattgaagagatgatgccggagaatttttgtgtgaaagggcttgaactcttttcactgttcctattcagagatattttggaattatatgactggaatcttaaaggtcctttgtttgaagacagccctccctgctgcccaagatttcatttcatgccacgttttgtaagatttcttccagatggaggaaaggaagtgctgtccatgcaccagattctcctgtacttgttaaggtgcagcaaagccctggtgcctgaggaggagattgccaatatgcttcagtgggaggagctggagtggcagaaatatgcagaagaatgcaaaggcatgattgttaccaaccctgggacgaaaccaagctctgtccgtatcgatcaactggatcgtgaacagttcaaccccgatgtgattacttttccgattatcgtccactttgggatacgccctgcacagttgagttatgcaggagacccacagtaccaaaaactgtggaagagttatgtgaaacttcgccacctcctagcaaatagtcccaaagtcaaacaaactgacaaacagaagctggcacagagggaggaagccctccaaaaaatacggcagaagaatacaatgagacgagaagtaacggtggagctaagtagccaaggattctggaaaactggcatccgttctgatgtctgtcagcatgcaatgatgctacctgttctgacccatcatatccgctaccaccaatgcctaatgcatttggacaagttgataggatatactttccaagatcgttgtctgttgcagctggccatgactcatccaagtcatcatttaaattttggaatgaatcctgatcatgccaggaattcattatctaactgtggaattcggcagcccaaatacggagacagaaaagttcatcacatgcacatgcggaagaaagggattaacaccttgataaatatcatgtcacgccttggccaagatgacccaactccctcgaggattaaccacaatgaacggttggaattcctgggtgatgctgttgttgaatttctgaccagcgtccatttgtactatttgtttcctagtctggaagaaggaggattagcaacctatcggactgccattgttcagaatcagcaccttgccatgctagcaaagaaacttgaactggatcgatttatgctgtatgctcacgggcctgacctttgtagagaatcggaccttcgacatgcaatggccaattgttttgaagcgttaataggagctgtttacttggagggaagcctggaggaagccaagcagttatttggacgcttgctctttaatgatccggacctgcgcgaagtctggctcaattatcctctccacccactccaactacaagagccaaatactgatcgacaacttattgaaacttctccagttctacaaaaacttactgagtttgaagaagcaattggagtaatttttactcatgttcgacttctggcaagggcattcacattgagaactgtgggatttaaccatctgaccctaggccacaatcagagaatggaattcctaggtgactccataatgcaactggtagccacagagtacttattcattcatttcccagatcatcatgaaggacacttaactttgttgcgaagctctttggtgaataatagaactcaggccaaggtagcggaggagctgggcatgcaggagtggagtatttacttgctcagtaactgtgactgttgtctattgagacctagcctagttttcctgcagacaatgaatgaagtgtgctcattgaaataa

SEQ ID NO: 8844 - DNA, 4991 bp, Homo sapiens
gagcttatattctctgtggaagatgtgacatatccaggcggaacatcatgatgcagggaaacacatgtcacagaatgtcgttccacccgggacgagggtgtccccgaggacgaggaggacatggagccagaccctcagcaccatcctttaggccccaaaatctgaggctgcttcaccctcagcagcctcctgtgcaatatcaatatgaacctccaagtgccccttccaccactttctcaaactctccagcccccaattttctccctccacgaccagactttgtacccttccccccacccatgcctccgtcagcgcaaggccctcttcccccctgcccaatcaggccgcctttccccaaccaccagatgaggcaccccttcccagttcctccttgttttcctcccatgccaccaccaatgccttgtcctaataaccccccagtccctggggcacctcctggacaaggcactttccccttcatgatgccccctccctccatgcctcatcccccgccccctccagtcatgccgcagcaggttaattatcagtaccctccgggctattctcaccacaacttcccacctcccagttttaatagtttccagaacaaccctagttctttcctgcccagtgctaataacagcagtagtcctcatttcagacatctccctccatacccactcccaaaggctcccagtgagagaaggtccccagaaaggctgaaacactatgatgaccacaggcaccgagatcacagtcatgggcgaggtgagaggcatcggtccctggatcggcgggagcgaggccgcagtcccgacaggagaagacaagacagccggtacagatctgattatgaccgagggagaacaccatctcgccaccgcagctacgaacggagcagagagcgagaacgggagagacacaggcatcgagacaaccgaagatcaccatctctggaaaggtcctacaaaaaagagtataagagatctggaagtcgctccccaagtagggagaagaagagagctcgttgggaggaagaaaaagaccgttggagtgacaaccagagttctggcaaagacaagaactatacctcaatcaaggaaaaagagcccgaggagaccatgcctgacaagaatgaggaggaagaagaagaacttcttaagcctgtgtggattcgatgcactcattcagaaaactactactccagtgaccccatggatcaggtgggagattctacagtggttggaacgagtaggcttcgtgacttatatgacaaatttgaggaggagttggggagcaggcaagaaaaggccaaagctgctcggcctccgtgggaacctccaaagacgaagctcgatgaagatttagagagttccagtgaatccgagtgtgagtctgatgaggacagcacctgttctagcagctcagactctgaagtttttgacgttattgcagaaatcaaacgcaaaaaggcccaccctgaccgacttcatgatgaactttggtacaacgatccaggccagatgaatgatggaccactctgcaaatgcagcgcaaaggcaagacgcacaggaattaggcacagcatttatcctggagaagaggccatcaagccctgtcgtcctatgaccaacaatgctggcagacttttccactaccggatcacagtctccccgcctacgaactttttaactgacaggccaactgttatagaatacgatgatcacgagtatatctttgaaggattttctatgtttgcacatgcccccctgaccaatattccactgtgtaaagtaattagattcaacatagactacacgattcatttcattgaagagatgatgccggagaatttttgtgtgaaagggcttgaactcttttcactgttcctattcagagatattttggaattatatgactggaatcttaaaggtcctttgtttgaagacagccctccctgctgcccaagatttcatttcatgccacgttttgtaagatttcttccagatggaggaaaggaagtgctgtccatgcaccagattctcctgtacttgttaaggtgcagcaaagccctggtgcctgaggaggagattgccaatatgcttcagtgggaggagctggagtggcagaaatatgcagaagaatgcaaaggcatgattgttaccaaccctgggacgaaaccaagctctgtccgtatcgatcaactggatcgtgaacagttcaaccccgatgtgattacttttccgattatcgtccactttgggatacgccctgcacagttgagttatgcaggagacccacagtaccaaaaactgtggaagagttatgtgaaacttcgccacctcctagcaaatagtcccaaagtcaaacaaactgacaaacagaagctggcacagagggaggaagccctccaaaaaatacggcagaagaatacaatgagacgagaagtaacggtggagctaagtagccaaggattctggaaaactggcatccgttctgatgtctgtcagcatgcaatgatgctacctgttctgacccatcatatccgctaccaccaatgcctaatgcatttggacaagttgataggatatactttccaagatcgttgtctgttgcagctggccatgactcatccaagtcatcatttaaattttggaatgaatcctgatcatgccaggaattcattatctaactgtggaattcggcagcccaaatacggagacagaaaagttcatcacatgcacatgcggaagaaagggattaacaccttgataaatatcatgtcacgccttggccaagatgacccaactccctcgaggattaaccacaatgaacggttggaattcctgggtgatgctgttgttgaatttctgaccagcgtccatttgtactatttgtttcctagtctggaagaaggaggattagcaacctatcggactgccattgttcagaatcagcaccttgccatgctagcaaagaaacttgaactggatcgatttatgctgtatgctcacgggcctgacctttgtagagaatcggaccttcgacatgcaatggccaattgttttgaagcgttaataggagctgtttacttggagggaagcctggaggaagccaagcagttatttggacgcttgctctttaatgatccggacctgcgcgaagtctggctcaattatcctctccacccactccaactacaagagccaaatactgatcgacaacttattgaaacttctccagttctacaaaaacttactgagtttgaagaagcaattggagtaatttttactcatgttcgacttctggcaagggcattcacattgagaactgtgggatttaaccatctgaccctaggccacaatcagagaatggaattcctaggtgactccataatgcaactggtagccacagagtacttattcattcatttcccagatcatcatgaaggacacttaactttgttgcgaagctctttggtgaataatagaactcaggccaaggtagcggaggagctgggcatgcaggagtacgccataaccaacgacaagaccaagaggcctgtggcgcttcgcaccaagaccttggcggaccttttggaatcatttattgcagcgctgtacattgataaggatttggaatatgttcatactttcatgaatgtctgcttctttccacgattgaaagagttcattttgaatcaggattggaatgaccccaaatcccagcttcagcagtgttgcttgacacttaggacagaaggaaaagagccagacattcctctgtacaagactctgcagacagtgggcccatcccatgcccgaacctacactgtggctgtttatttcaagggagaaagaataggctgtgggaaaggaccaagtattcagcaagcggaaatgggagcagcaatggatgcgcttgaaaaatataattttccccagatggcccatcagaagcggttcatcgaacggaagtacagacaagagttaaaagaaatgaggtgggaaagagagcatcaagagagagagccagatgagactgaagacatcaagaaataaaggagggcatgcaagtgtggagtatttacttgctcagtaactgtgactgttgtctattgagacctagcctagttttcctgcagacaatgaatgaagtgtgctcattgaaataaaatacagagtcaaatcgctattgttgttttaatgatctgtttttagctggatggtctttattacaaagtattagatttttcttctatttaacggaaaacttgactttggtgaatgtgcattacttccttttattttgctctttaaataataaaattcaagaagcatattctatgtggaatagatcctgtttttccatctgtgtcccagattgtgaccctagactttcaattgacaagtaaaaaattgactttactagacattttgactgtgctctagtaacatctatcctttttcaaatctctggatttttaagtagattgttcagctttcatccggtggctgttcatcaagttatcagctgcaaatattgaacttacctctctctaagcagtgagtgttttgtagaaggaatccgtttaacaattaattggctaatgggagaaggggaaagactgatattcaagtcatacagattctttgaatcattagaataggagagaaatcatgattctaagccaggccacactttaaaccaagtgctctcaccctggggttagtggaacctttaagaagttaatgaacagacttcaaggaagtcaaaaacctcccaatactatattcaattttctgtgtgtgtttgagatttgagagggcatggggagcaggaaggaggagggtttatagcttttatcagcctctctaagtgggccctgcagtaaaaggctaacatgacattcaaagacataacattttaaaaaaagttattccaaactaaacatcactggtttcttattaataaaggcaaaacttctttgt

SEQ ID NO: 8845 - DNA, 860 bp, Homo sapiens
gctttcgttgacgcgccaatcaccgcgcacaaggccctgcggtgggctgaagagttttccctcccttggcccagctttctcaggttgcttttcccggggatgtgaaggatacagaaatgactgtgaatcaacccatatcatcaaggagctgataatctagtggaagagttagacgtgtgcatacttcactatgatatgaggcagtctctgagcttatattctctgtggaagatgtgacatatccaggcggaacatcatgatgcagggaaacacatgtcacagaatgtcgttccacccgggacgagggtgtccccgaggacgaggaggacatggagccagaccctcagcaccatcctttaggccccaaaatctgaggctgcttcaccctcagcagcctcctgtgcaatatcaatatgaacctccaagtgccccttccaccactttctcaaactctccagcccccaattttctccctccacgaccagactttgtacccttccccccacccatgcctccgtcagcgcaaggccctcttcccccctgcccaatcaggccgcctttccccaaccaccagatgaggcaccccttcccagttcctccttgttttcctcccatgccaccaccaatgccttgtcctaataaccccccagtccctggggcacctcctggacaaggcactttccccttcatgatgccccctccctccatgcctcatcccccgccccctccagtcatgccgcagcaggttaattatcagtaccctccgggctattctcaccacaacttcccacctcccagttttaatagtttccagaacaaccctagttctttcctgcccagtgctaataacagcagtagtc

SEQ ID NO: 8846 - DNA, 5305 bp, Homo sapiens
ctgtcttggtacctgcggtagtagcctggctttgctctgacggcgatctcgcggcccgagagccttttataggttgcttttcccggggatgtgaaggatacagaaatgactgtgaatcaacccatatcatcaaggagctgataatctagtggaagagttagacgtgtgcatacttcactatgatatgaggcagtctctgagcttatattctctgtggaagatgtgacatatccaggcggaacatcatgatgcagggaaacacatgtcacagaatgtcgttccacccgggacgagggtgtccccgaggacgaggaggacatggagccagaccctcagcaccatcctttaggccccaaaatctgaggctgcttcaccctcagcagcctcctgtgcaatatcaatatgaacctccaagtgccccttccaccactttctcaaactctccagcccccaattttctccctccacgaccagactttgtacccttccccccacccatgcctccgtcagcgcaaggccctcttcccccctgcccaatcaggccgcctttccccaaccaccagatgaggcaccccttcccagttcctccttgttttcctcccatgccaccaccaatgccttgtcctaataaccccccagtccctggggcacctcctggacaaggcactttccccttcatgatgccccctccctccatgcctcatcccccgccccctccagtcatgccgcagcaggttaattatcagtaccctccgggctattctcaccacaacttcccacctcccagttttaatagtttccagaacaaccctagttctttcctgcccagtgctaataacagcagtagtcctcatttcagacatctccctccatacccactcccaaaggctcccagtgagagaaggtccccagaaaggctgaaacactatgatgaccacaggcaccgagatcacagtcatgggcgaggtgagaggcatcggtccctggatcggcgggagcgaggccgcagtcccgacaggagaagacaagacagccggtacagatctgattatgaccgagggagaacaccatctcgccaccgcagctacgaacggagcagagagcgagaacgggagagacacaggcatcgagacaaccgaagatcaccatctctggaaaggtcctacaaaaaagagtataagagatctggaaggagttacggtttatcggttgttcctgaacctgctggatgcacaccagaattacctggggagattattaaaaatacagattcttgggccccacccctggagattgtgaatcatcgctccccaagtagggagaagaagagagctcgttgggaggaagaaaaagaccgttggagtgacaaccagagttctggcaaagacaagaactatacctcaatcaaggaaaaagagcccgaggagaccatgcctgacaagaatgaggaggaagaagaagaacttcttaagcctgtgtggattcgatgcactcattcagaaaactactactccagtgaccccatggatcaggtgggagattctacagtggttggaacgagtaggcttcgtgacttatatgacaaatttgaggaggagttggggagcaggcaagaaaaggccaaagctgctcggcctccgtgggaacctccaaagacgaagctcgatgaagatttagagagttccagtgaatccgagtgtgagtctgatgaggacagcacctgttctagcagctcagactctgaagtttttgacgttattgcagaaatcaaacgcaaaaaggcccaccctgaccgacttcatgatgaactttggtacaacgatccaggccagatgaatgatggaccactctgcaaatgcagcgcaaaggcaagacgcacaggaattaggcacagcatttatcctggagaagaggccatcaagccctgtcgtcctatgaccaacaatgctggcagacttttccactaccggatcacagtctccccgcctacgaactttttaactgacaggccaactgttatagaatacgatgatcacgagtatatctttgaaggattttctatgtttgcacatgcccccctgaccaatattccactgtgtaaagtaattagattcaacatagactacacgattcatttcattgaagagatgatgccggagaatttttgtgtgaaagggcttgaactcttttcactgttcctattcagagatattttggaattatatgactggaatcttaaaggtcctttgtttgaagacagccctccctgctgcccaagatttcatttcatgccacgttttgtaagatttcttccagatggaggaaaggaagtgctgtccatgcaccagattctcctgtacttgttaaggtgcagcaaagccctggtgcctgaggaggagattgccaatatgcttcagtgggaggagctggagtggcagaaatatgcagaagaatgcaaaggcatgattgttaccaaccctgggacgaaaccaagctctgtccgtatcgatcaactggatcgtgaacagttcaaccccgatgtgattacttttccgattatcgtccactttgggatacgccctgcacagttgagttatgcaggagacccacagtaccaaaaactgtggaagagttatgtgaaacttcgccacctcctagcaaatagtcccaaagtcaaacaaactgacaaacagaagctggcacagagggaggaagccctccaaaaaatacggcagaagaatacaatgagacgagaagtaacggtggagctaagtagccaaggattctggaaaactggcatccgttctgatgtctgtcagcatgcaatgatgctacctgttctgacccatcatatccgctaccaccaatgcctaatgcatttggacaagttgataggatatactttccaagatcgttgtctgttgcagctggccatgactcatccaagtcatcatttaaattttggaatgaatcctgatcatgccaggaattcattatctaactgtggaattcggcagcccaaatacggagacagaaaagttcatcacatgcacatgcggaagaaagggattaacaccttgataaatatcatgtcacgccttggccaagatgacccaactccctcgaggattaaccacaatgaacggttggaattcctgggtgatgctgttgttgaatttctgaccagcgtccatttgtactatttgtttcctagtctggaagaaggaggattagcaacctatcggactgccattgttcagaatcagcaccttgccatgctagcaaagaaacttgaactggatcgatttatgctgtatgctcacgggcctgacctttgtagagaatcggaccttcgacatgcaatggccaattgttttgaagcgttaataggagctgtttacttggagggaagcctggaggaagccaagcagttatttggacgcttgctctttaatgatccggacctgcgcgaagtctggctcaattatcctctccacccactccaactacaagagccaaatactgatcgacaacttattgaaacttctccagttctacaaaaacttactgagtttgaagaagcaattggagtaatttttactcatgttcgacttctggcaagggcattcacattgagaactgtgggatttaaccatctgaccctaggccacaatcagagaatggaattcctaggtgactccataatgcaactggtagccacagagtacttattcattcatttcccagatcatcatgaaggacacttaactttgttgcgaagctctttggtgaataatagaactcaggccaaggtagcggaggagctgggcatgcaggagtacgccataaccaacgacaagaccaagaggcctgtggcgcttcgcaccaagaccttggcggaccttttggaatcatttattgcagcgctgtacattgataaggatttggaatatgttcatactttcatgaatgtctgcttctttccacgattgaaagagttcattttgaatcaggattggaatgaccccaaatcccagcttcagcagtgttgcttgacacttaggacagaaggaaaagagccagacattcctctgtacaagactctgcagacagtgggcccatcccatgcccgaacctacactgtggctgtttatttcaagggagaaagaataggctgtgggaaaggaccaagtattcagcaagcggaaatgggagcagcaatggatgcgcttgaaaaatataattttccccagatggcccatcagaagcggttcatcgaacggaagtacagacaagagttaaaagaaatgaggtgggaaagagagcatcaagagagagagccagatgagactgaagacatcaagaaataaaggagggcatgcaagtgtggagtatttacttgctcagtaactgtgactgttgtctattgagacctagcctagttttcctgcagacaatgaatgaagtgtgctcattgaaataaaatacagagtcaaatcgctattgttgttttaatgatctgtttttagctggatggtctttattacaaagtattagatttttcttctatttaacggaaaacttgactttggtgaatgtgcattacttccttttattttgctctttaaataataaaattcaagaagcatattctatgtggaatagatcctgtttttccatctgtgtcccagattgtgaccctagactttcaattgacaagtaaaaaattgactttactagacattttgactgtgctctagtaacatctatcctttttcaaatctctggatttttaagtagattgttcagctttcatccggtggctgttcatcaagttatcagctgcaaatattgaacttacctctctctaagcagtgagtgttttgtagaaggaatccgtttaacaattaattggctaatgggagaaggggaaagactgatattcaagtcatacagattctttgaatcattagaataggagagaaatcatgattctaagccaggccacactttaaaccaagtgctctcaccctggggttagtggaacctttaagaagttaatgaacagacttcaaggaagtcaaaaacctcccaatactatattcaattttctgtgtgtgtttgagatttgagagggcatggggagcaggaaggaggagggtttatagcttttatcagcctctctaagtgggccctgcagtaaaaggctaacatgacattcaaagacataacattttaaaaaaagttattccaaactaaacatcactggtttcttattaataaaggcaaaacttctttgtaaaac

SEQ ID NO: 8847 - DNA, 1387 bp, Homo sapiens
ctatcgccaggccgagagtgggcgtggccgacgtggggtgggtagcagccgaccgagtcggaccggccagttgggcgcgcttccgggtgtcacctccagagggcgccggctgcggagccgccctcagagtcgcgaggccggacgcagcgcggcgccgccccactcgccccagccgccgccatgaaggccgtggtgcagcgcgtcacccgggccagcgtcacagttggaggagagcagattagtgccattggaaggggcatatgtgtgttgctgggtatttccctggaggatacgcagaaggaactggaacacatggtccgaaagattctaaacctgcgtgtatttgaggatgagagtgggaagcactggtcgaagagtgtgatggacaaacagtacgagattctgtgtgtcagccagtttaccctccagtgtgtcctgaagggaaacaagcctgatttccacctagcaatgcccacggagcaggcagagggcttctacaacagcttcctggagcagctgcgtaaaacatacaggccggagcttatcaaagatggcaagtttggggcctacatgcaggtgcacattcagaatgatgggcctgtgaccatagagctggaatcgccagctcccggcactgctacctctgacccaaagcagctgtcaaagctcgaaaaacagcagcagaggaaagaaaagaccagagctaagggaccttctgaatcaagcaaggaaagaaacactccccgaaaagaagaccgcagtgccagcagcggggctgagggcgacgtgtcctctgaacgggagccgtagctcaggaggcagaattcagtgtgttatcattgggcagaactggatcctgaaaaattcaagatgctaagcacctacactactttaagaatttggaactgaaacatgaagaggaagacagaaataagaatttgggaacctgaatagctctgcaaaaaacaccaaaggaccgttttatcgttttctgttgttgctgtggtggagtgatgcagtgggcactgccggtgggccagggggcgggtgcgcatgtggtagaaggtgtgcgctcgtgcctcccccacagaaaggctttgttggtttctaccacatcttggcttgcttttggaacaggctggcccagcatcatttgtcatcaagtccactgtggtgtattctgcgtgtccatggcgggggttctccaatacactcacactgtccatgttctttttattgccagggcccgtgttgaagtgtcaagagagcaatcatcaatgataatgtattgtgtgagacctttgcatcttgtaaattttctcttttttctaaaaataaataataataaaatcctaaatctcaacaaaccactttattatcaaacaaa

SEQ ID NO: 8848 - DNA, 1440 bp, Homo sapiens
tcacagagcgagaaggtgtcaggagcagcccagttgtgtctctctctctacctctgtgaagggcgcgaatgggcagagcagaacttctagaagggaagatgagcacccaggatccctcagatctgtggagcagatccgatggagaggctgagctgctccaggacttggggtggtatcacggcaacctcacacgccatgctgctgaagctcttctcctctcaaatggatgtgacggcagctaccttctgagggacagcaatgagaccaccgggctgtactctctctctgtgagggccaaagattctgttaaacactttcatgttgaatatactggatattcatttaaatttggctttaatgaattctcatctttgaaggattttgtcaagcattttgcaaatcagcctttgattggaagcgagacaggcactctgatggttctaaaacatccctacccaagaaaagtggaagaaccctccatttatgaatctgtccgggttcacacagcaatgcagacaggaagaacagaagatgaccttgtgcccacagcaccttctctgggcaccaaagaaggttacctcaccaaacagggaggcctggtcaagacctggaaaacaagatggtttactctgcacaggaatgaactgaaatacttcaaagaccagatgtcaccagaaccaattcggatcctagacctaacagaatgttcagctgtacaattcgattattcacaagaaagggtaaactgtttttgtttggtatttccattcaggacattttatctctgtgcaaagaccggagtagaagctgatgagtggatcaagatattacgctggaaattgtcacaaataagaaaacagctcaaccaaggggaaggcacgatccgatctcggtcgttcatctttaaatagatctttcttgccaaggaatgctctggcccaggagcaaggtggaatgtttccctgacgctgtgatctgcagcaggcttcaaatgaaaaccgactaaggattttctttcaaaaacaaatcagaagcagatgctgattgggacccatataccacgttgctgactcacgttgctgcccttccatgatgttgccatctccttgagaacactgaagcaatcaccattctgatagaaagtgcttaaaccaccactcttaggtctgctcactcttagaacacacaatggaagaggaagggtttttgttttcactcattgtggtccccaagcctattgacactagttgcctagagtcccactgtgagtcatggtcagcctgtctgacatccaggttgtgctattaaccaagaaggaaacagatacttggaggcttagatgacttctgcaggatttatattcagatagaaaacatcaaatattttcaggggagaggtttttttttttaatttttccccctttatacaaaaaaaaaagaa

SEQ ID NO: 8849 - DNA, 5738 bp, Homo sapiens
gtggctgagccgagccgggccgtgccttcccctcctcacccccagccccgcccgtcccggcgcagagctgcagaggcaccggacgagagagggctccgcgggcccagctggcagccaggccggagacaagttgcagtcccgggctctggtgacgccgtggccgcagctggaagaggaaaacaaggatcagattggagaagtgatttatctaagatcccacagtggactggcagcagcactgagacctcagcctagtctcctgatccccaagcagggccctgcctaaggaacacactctgcagagtgctgggccaaagcagggttttccaactaatcttagaaggtaaagtccatgaagggtctccattttgggacattctaatccctgagcccctattattttcatcatgggcttctgcctggctctagcatggacacttctggttggggcatggacccctctgggagctcagaaccccatttcgtgggaggtgcagcgatttgatgggtggtacaacaacctcatggagcacagatggggcagcaaaggctcccggctgcagcgcctggtcccagccagctatgcagatggcgtgtaccagcccttgggagaaccccacctgcccaacccccgagaccttagcaacaccatctcaaggggccctgcagggctggcctccctgagaaaccgcacagtgttgggggtcttctttggctatcacgtgctttcagacctggtgagcgtggaaactcccggctgccccgccgagttcctcaacattcgcatcccgcccggagaccccatgttcgaccccgaccagcgcggggacgtggtgctgcccttccagagaagccgctgggaccccgagaccggacggagtcccagcaatccccgggacccggccaaccaggtgacgggctggctggacggcagcgccatctatggttcctcgcattcctggagcgacgcgctgcggagcttctccaggggacagctggcgtcggggcccgaccccgcttttccccgagactcgcagaaccccctgctcatgtgggcggcgcccgaccccgccaccgggcagaacgggccccgggggctgtacgccttcggggcagagagagggaaccgggaacccttcctgcaggcgctgggcctgctctggttccgctaccacaacctgtgggcgcagaggctggcccgccagcacccagactgggaggacgaggagctgttccagcacgcacgcaagagggtcatcgccacctaccagaacatcgctgtgtatgagtggctgcccagcttcctgcagaaaacactcccggagtatacaggataccggccatttctggaccccagcatctcctcagagttcgtggcggcctctgagcagttcctgtccaccatggtgccccctggcgtctacatgagaaatgccagctgccacttccagggggtcatcaatcggaactcaagtgtctccagagctctccgggtctgcaacagctactggagccgtgagcacccaagcctacaaagtgctgaagatgtggatgcactgctgctgggcatggcctcccagatcgcagagcgagaggaccatgtgttggttgaagatgtgcgggatttctggcctgggccactgaagttttcccgcacagaccacctggccagctgcctgcagcggggccgggatctgggcctgccctcttacaccaaggccagggcagcactgggcttgtctcccattacccgctggcaggacatcaaccctgcactctcccggagcaatgacactgtactggaggccacagctgccctgtacaaccaggacttatcctggctagagctgctccctgggggactcctggagagccaccgggaccctggacctctgttcagcaccatcgtccttgaacaatttgtgcggctacgggatggtgaccgctactggtttgagaacaccaggaatgggctgttctccaagaaggagattgaagaaatccgaaataccaccctgcaggacgtgctggtcgctgttatcaacattgaccccagtgctctgcagcccaatgtctttgtctggcataaaggagacccctgtccgcagccgagacagctcagcactgaaggcctgccagcgtgtgctccctctgttgttcgtgactattttgagggcagtggatttggcttcggggtcaccatcgggaccctctgttgcttccctttggtgagcctgctcagtgcctggattgttgcccggctccggatgagaaatttcaagaggctccagggccaggaccgccagagcatcgtgtctgagaagctcgtgggaggcatggaagctttggaatggcaaggccacaaggagccctgccggcccgtgcttgtgtacctgcagcccgggcagatccgtgtggtagatggcaggctcaccgtgctccgcaccatccagctgcagcctccacagaaggtcaacttcgtcctgtccagcaaccgtggacgccgcactctgctgctcaagatccccaaggagtatgacctggtgctgctgtttaacttggaggaagagcggcaggcgctggtggaaaatctccggggagctctgaaggagagcgggttgagcatccaggagtgggagctgcgggagcaggagctgatgagagcagctgtgacacgggagcagcggaggcacctcctggagacctttttcaggcaccttttctcccaggtgctggacatcaaccaggccgacgcagggaccctgcccctggactcctcccagaaggtgcgggaggccctgacctgtgagctgagcagggccgagtttgccgagtccctgggcctcaagccccaggacatgtttgtggagtccatgttctctctggctgacaaggatggcaatggctacctgtccttccgagagttcctggacatcctggtggtcttcatgaaaggctctcctgaggaaaagtctcgccttatgttccgcatgtacgactttgatgggaatggcctcatttccaaggatgagttcatcaggatgctgagatccttcatcgagatctccaacaactgcctgtccaaggcccagctggctgaggtggtggagtccatgttccgggagtcgggattccaggacaaggaggaactgacatgggaagattttcacttcatgctgcgggaccacaatagcgagctccgcttcacgcagctctgtgtcaaaggggtggaggtgcctgaagtcatcaaggacctctgccggcgagcctcctacatcagccaggatatgatctgtccctctcccagagtgagtgcccgctgttcccgcagcgacattgagactgagttgacacctcagagactgcagtgccccatggacacagaccctccccaggagattcggcggaggtttggcaagaaggtaacgtcattccagcccttgctgttcactgaggcgcaccgagagaagttccaacgcagctgtctccaccagacggtgcaacagttcaagcgcttcattgagaactaccggcgccacatcggctgcgtggccgtgttctacgccatcgctggggggcttttcctggagagggcctactactacgcctttgccgcacatcacacgggcatcacagacaccacccgcgtgggaatcatcctgtcgcggggcacagcagccagcatctctttcatgttctcctacatcttgctcaccatgtgccgcaacctcatcaccttcctgcgagaaaccttcctcaaccgctacgtgcccttcgacgccgccgtggacttccatcgcctcattgcctccaccgccatcgtcctcacagtcttacacagtgtgggccatgtggtgaatgtgtacctgttctccatcagccccctcagcgtcctctcttgcctctttcctggcctcttccatgatgatgggtctgagctcccccagaagtattactggtggttcttccagaccgtaccaggcctcacgggggttgtgctgctcctgatcctggccatcatgtatgtctttgcctcccaccacttccgccgccgcagtttccggggcttctggctgacccaccacctctacatcctgctctatgtcctgctcatcatccatggtagctttgccctgatccagctgccccgtttccacatcttcttcctggtcccagcaatcatctatgggggcgacaagctggtgagcctgagccggaagaaggtggagatcagcgtggtgaaggcggagctgctgccctcaggagtgacccacctgcggttccagcggccccagggctttgagtacaagtcagggcagtgggtgcggatcgcttgcctggctctggggaccaccgagtaccaccccttcacactgacctctgcgccccatgaggacacgcttagcctgcacatccgggcagcagggccctggaccactcgcctcagggagatctactcagccccgacgggtgacagatgtgccagatacccaaagctgtaccttgatggaccatttggagagggccaccaggagtggcataagtttgaggtgtcagtgttagtgggagggggcattggggtcaccccttttgcctccatcctcaaagacctggtcttcaagtcatccgtcagctgccaagtgttctgtaagaagatctacttcatctgggtgacgcggacccagcgtcagtttgagtggctggctgacatcatccgagaggtggaggagaatgaccaccaggacctggtgtctgtgcacatctacatcacccagctggctgagaagttcgacctcaggaccactatgctgtacatctgtgagcggcacttccagaaggttctgaaccggagtctattcacaggcctgcgctccatcacccactttggccgtcccccctttgagcccttcttcaactccctgcaggaggtccacccccaggtccggaagatcggggtgtttagctgtggcccccctggcatgaccaagaatgtggaaaaggcctgtcagctcatcaacaggcaggaccggactcacttctcccaccattatgagaacttctaggcccctgcccgggggttctgcccactgcccagttgagcagaggtttgagcccacacctcacctctgttcttcctatttctggctgcctcagccttctctgatttcccacctcccaaccttgttccaggtggccatagtcagtcaccatgtgtgggctcagggacccccaggaccaggatgtgtctcagcctggagaaatggtgggggggcagtgtctagggactagagtgagaagtaggggagctactgatttggggcaaagtgaaacctctgcttccagacttcagaaacaaatctcagaagacaagctgacctgacaagtactatgtgtgtgcatgtctgtatgtgtgttggggcggtgagtgtaaggatgcagtgggagcatggatgctggcatcttagaaccctccctactcccatacctcctcctcttctgggctccccactgtcagacgggctggcaaatgccttgcaggaggtagaggctggacccatggcaagccatttacagaaacccactcggcaccccagtctaacaccacaactaatttcacccaaggttttaagcacgttctttcatcagaccctggcccaatacctatgtatgcaatgctcctcagccctcttctccctgctccagtagtctcccttccaaataaatcacttttctgcctt

SEQ ID NO: 8850 - DNA, 5483 bp, Homo sapiens
gcagagctgcagaggcaccggacgagagagggctccgcgggcccagctggcagccaggccggagacaagttgcagtcccgggctctggtgacgccgtggccgcagggtctccattttgggacattctaatccctgagcccctattattttcatcatgggcttctgcctggctctagcatggacacttctggttggggcatggacccctctgggagctcagaaccccatttcgtgggaggtgcagcgatttgatgggtggtacaacaacctcatggagcacagatggggcagcaaaggctcccggctgcagcgcctggtcccagccagctatgcagatggcgtgtaccagcccttgggagaaccccacctgcccaacccccgagaccttagcaacaccatctcaaggggccctgcagggctggcctccctgagaaaccgcacagtgttgggggtcttctttggctatcacgtgctttcagacctggtgagcgtggaaactcccggctgccccgccgagttcctcaacattcgcatcccgcccggagaccccatgttcgaccccgaccagcgcggggacgtggtgctgcccttccagagaagccgctgggaccccgagaccggacggagtcccagcaatccccgggacccggccaaccaggtgacgggctggctggacggcagcgccatctatggttcctcgcattcctggagcgacgcgctgcggagcttctccaggggacagctggcgtcggggcccgaccccgcttttccccgagactcgcagaaccccctgctcatgtgggcggcgcccgaccccgccaccgggcagaacgggccccgggggctgtacgccttcggggcagagagagggaaccgggaacccttcctgcaggcgctgggcctgctctggttccgctaccacaacctgtgggcgcagaggctggcccgccagcacccagactgggaggacgaggagctgttccagcacgcacgcaagagggtcatcgccacctaccagaacatcgctgtgtatgagtggctgcccagcttcctgcagaaaacactcccggagtatacaggataccggccatttctggaccccagcatctcctcagagttcgtggcggcctctgagcagttcctgtccaccatggtgccccctggcgtctacatgagaaatgccagctgccacttccagggggtcatcaatcggaactcaagtgtctccagagctctccgggtctgcaacagctactggagccgtgagcacccaagcctacaaagtgctgaagatgtggatgcactgctgctgggcatggcctcccagatcgcagagcgagaggaccatgtgttggttgaagatgtgcgggatttctggcctgggccactgaagttttcccgcacagaccacctggccagctgcctgcagcggggccgggatctgggcctgccctcttacaccaaggccagggcagcactgggcttgtctcccattacccgctggcaggacatcaaccctgcactctcccggagcaatgacactgtactggaggccacagctgccctgtacaaccaggacttatcctggctagagctgctccctgggggactcctggagagccaccgggaccctggacctctgttcagcaccatcgtccttgaacaatttgtgcggctacgggatggtgaccgctactggtttgagaacaccaggaatgggctgttctccaagaaggagattgaagaaatccgaaataccaccctgcaggacgtgctggtcgctgttatcaacattgaccccagtgctctgcagcccaatgtctttgtctggcataaaggagacccctgtccgcagccgagacagctcagcactgaaggcctgccagcgtgtgctccctctgttgttcgtgactattttgagggcagtggatttggcttcggggtcaccatcgggaccctctgttgcttccctttggtgagcctgctcagtgcctggattgttgcccggctccggatgagaaatttcaagaggctccagggccaggaccgccagagcatcgtgtctgagaagctcgtgggaggcatggaagctttggaatggcaaggccacaaggagccctgccggcccgtgcttgtgtacctgcagcccgggcagatccgtgtggtagatggcaggctcaccgtgctccgcaccatccagctgcagcctccacagaaggtcaacttcgtcctgtccagcaaccgtggacgccgcactctgctgctcaagatccccaaggagtatgacctggtgctgctgtttaacttggaggaagagcggcaggcgctggtggaaaatctccggggagctctgaaggagagcgggttgagcatccaggagtgggagctgcgggagcaggagctgatgagagcagctgtgacacgggagcagcggaggcacctcctggagacctttttcaggcaccttttctcccaggtgctggacatcaaccaggccgacgcagggaccctgcccctggactcctcccagaaggtgcgggaggccctgacctgtgagctgagcagggccgagtttgccgagtccctgggcctcaagccccaggacatgtttgtggagtccatgttctctctggctgacaaggatggcaatggctacctgtccttccgagagttcctggacatcctggtggtcttcatgaaaggctctcctgaggaaaagtctcgccttatgttccgcatgtacgactttgatgggaatggcctcatttccaaggatgagttcatcaggatgctgagatccttcatcgagatctccaacaactgcctgtccaaggcccagctggctgaggtggtggagtccatgttccgggagtcgggattccaggacaaggaggaactgacatgggaagattttcacttcatgctgcgggaccacaatagcgagctccgcttcacgcagctctgtgtcaaaggggtggaggtgcctgaagtcatcaaggacctctgccggcgagcctcctacatcagccaggatatgatctgtccctctcccagagtgagtgcccgctgttcccgcagcgacattgagactgagttgacacctcagagactgcagtgccccatggacacagaccctccccaggagattcggcggaggtttggcaagaaggtaacgtcattccagcccttgctgttcactgaggcgcaccgagagaagttccaacgcagctgtctccaccagacggtgcaacagttcaagcgcttcattgagaactaccggcgccacatcggctgcgtggccgtgttctacgccatcgctggggggcttttcctggagagggcctactactacgcctttgccgcacatcacacgggcatcacagacaccacccgcgtgggaatcatcctgtcgcggggcacagcagccagcatctctttcatgttctcctacatcttgctcaccatgtgccgcaacctcatcaccttcctgcgagaaaccttcctcaaccgctacgtgcccttcgacgccgccgtggacttccatcgcctcattgcctccaccgccatcgtcctcacagtcttacacagtgtgggccatgtggtgaatgtgtacctgttctccatcagccccctcagcgtcctctcttgcctctttcctggcctcttccatgatgatgggtctgagctcccccagaagtattactggtggttcttccagaccgtaccaggcctcacgggggttgtgctgctcctgatcctggccatcatgtatgtctttgcctcccaccacttccgccgccgcagtttccggggcttctggctgacccaccacctctacatcctgctctatgtcctgctcatcatccatggtagctttgccctgatccagctgccccgtttccacatcttcttcctggtcccagcaatcatctatgggggcgacaagctggtgagcctgagccggaagaaggtggagatcagcgtggtgaaggcggagctgctgccctcaggagtgacccacctgcggttccagcggccccagggctttgagtacaagtcagggcagtgggtgcggatcgcttgcctggctctggggaccaccgagtaccaccccttcacactgacctctgcgccccatgaggacacgcttagcctgcacatccgggcagcagggccctggaccactcgcctcagggagatctactcagccccgacgggtgacagatgtgccagatacccaaagctgtaccttgatggaccatttggagagggccaccaggagtggcataagtttgaggtgtcagtgttagtgggagggggcattggggtcaccccttttgcctccatcctcaaagacctggtcttcaagtcatccgtcagctgccaagtgttctgtaagaagatctacttcatctgggtgacgcggacccagcgtcagtttgagtggctggctgacatcatccgagaggtggaggagaatgaccaccaggacctggtgtctgtgcacatctacatcacccagctggctgagaagttcgacctcaggaccactatgctgtacatctgtgagcggcacttccagaaggttctgaaccggagtctattcacaggcctgcgctccatcacccactttggccgtcccccctttgagcccttcttcaactccctgcaggaggtccacccccaggtccggaagatcggggtgtttagctgtggcccccctggcatgaccaagaatgtggaaaaggcctgtcagctcatcaacaggcaggaccggactcacttctcccaccattatgagaacttctaggcccctgcccgggggttctgcccactgcccagttgagcagaggtttgagcccacacctcacctctgttcttcctatttctggctgcctcagccttctctgatttcccacctcccaaccttgttccaggtggccatagtcagtcaccatgtgtgggctcagggacccccaggaccaggatgtgtctcagcctggagaaatggtgggggggcagtgtctagggactagagtgagaagtaggggagctactgatttggggcaaagtgaaacctctgcttccagacttcagaaacaaatctcagaagacaagctgacctgacaagtactatgtgtgtgcatgtctgtatgtgtgttggggcggtgagtgtaaggatgcagtgggagcatggatgctggcatcttagaaccctccctactcccatacctcctcctcttctgggctccccactgtcagacgggctggcaaatgccttgcaggaggtagaggctggacccatggcaagccatttacagaaacccactcggcaccccagtctaacaccacaactaatttcacccaaggttttaagcacgttctttcatcagaccctggcccaatacctatgtatgcaatgctcctcagccctcttctccctgctccagtagtctcccttccaaataaatcacttttctgcc

SEQ ID NO: 8851 - DNA, 5158 bp, Homo sapiens
gtggctgagccgagccgggccgtgccttcccctcctcacccccagccccgcccgtcccggcgcagagctgcagaggcaccggacgagagagggctccgcgggcccagctggcagccaggccggagacaagttgcagtcccgggctctggtgacgccgtggccgcagctggaagaggaaaacaaggatcagattggagaagtgatttatctaagatcccacagtggactggcagcagcactgagacctcagcctagtctcctgatccccaagcagggccctgcctaaggaacacactctgcagagtgctgggccaaagcagggttttccaactaatcttagaaggtaaagtccatgaagggtctccattttgggacattctaatccctgagcccctattattttcatcatgggcttctgcctggctctagcatggacacttctggttggggcatggacccctctgggagctcagaaccccatttcgtgggaggtgcagcgatttgatgggtggtacaacaacctcatggagcacagatggggcagcaaaggctcccggctgcagcgcctggtcccagccagctatgcagatggcgtgtaccagcccttgggagaaccccacctgcccaacccccgagaccttagcaacaccatctcaaggggccctgcagggctggcctccctgagaaaccgcacagtgttgggggtcttctttggctatcacgtgctttcagacctggtgagcgtggaaactcccggctgccccgccgagttcctcaacattcgcatcccgcccggagaccccatgttcgaccccgaccagcgcggggacgtggtgctgcccttccagagaagccgctgggaccccgagaccggacggagtcccagcaatccccgggacccggccaaccaggtgacgggctggctggacggcagcgccatctatggttcctcgcattcctggagcgacgcgctgcggagcttctccaggggacagctggcgtcggggcccgaccccgcttttccccgagactcgcagaaccccctgctcatgtgggcggcgcccgaccccgccaccgggcagaacgggccccgggggctgtacgccttcggggcagagagagggaaccgggaacccttcctgcaggcgctgggcctgctctggttccgctaccacaacctgtgggcgcagaggctggcccgccagcacccagactgggaggacgaggagctgttccagcacgcacgcaagagggtcatcgccacctaccagaacatcgctgtgtatgagtggctgcccagcttcctgcagaaaacactcccggagtatacaggataccggccatttctggaccccagcatctcctcagagttcgtggcggcctctgagcagttcctgtccaccatggtgccccctggcgtctacatgagaaatgccagctgccacttccagggggtcatcaatcggaactcaagtgtctccagagctctccgggtctgcaacagctactggagccgtgagcacccaagcctacaaagtgctgaagatgtggatgcactgctgctgggcatggcctcccagatcgcagagcgagaggaccatgtgttggttgaagatgtgcgggatttctggcctgggccactgaagttttcccgcacagaccacctggccagctgcctgcagcggggccgggatctgggcctgccctcttacaccaaggccagggcagcactgggcttgtctcccattacccgctggcaggacatcaaccctgcactctcccggagcaatgacactgtactggaggccacagctgccctgtacaaccaggacttatcctggctagagctgctccctgggggactcctggagagccaccgggaccctggacctctgttcagcaccatcgtccttgaacaatttgtgcggctacgggatggtgaccgctactggtttgagaacaccaggaatgggctgttctccaagaaggagattgaagaaatccgaaataccaccctgcaggacgtgctggtcgctgttatcaacattgaccccagtgctctgcagcccaatgtctttgtctggcataaaggagacccctgtccgcagccgagacagctcagcactgaaggcctgccagcgtgtgctccctctgttgttcgtgactattttgagggcagtggatttggcttcggggtcaccatcgggaccctctgttgcttccctttggtgagcctgctcagtgcctggattgttgcccggctccggatgagaaatttcaagaggctccagggccaggaccgccagagcatcgtgtctgagaagctcgtgggaggcatggaagctttggaatggcaaggccacaaggagccctgccggcccgtgcttgtgtacctgcagcccgggcagatccgtgtggtagatggcaggctcaccgtgctccgcaccatccagctgcagcctccacagaaggtcaacttcgtcctgtccagcaaccgtggacgccgcactctgctgctcaagatccccaaggagtatgacctggtgctgctgtttaacttggaggaagagcggcaggcgctggtggaaaatctccggggagctctgaaggagagcgggttgagcatccaggagtgggagctgcgggagcaggagctgatgagagcagctgtgacacgggagcagcggaggcacctcctggagacctttttcaggcaccttttctcccaggtgctggacatcaaccaggccgacgcagggaccctgcccctggactcctcccagaaggtgcgggaggccctgacctgtgagctgagcagggccgagtttgccgagtccctgggcctcaagccccaggacatgtttgtggagtccatgttctctctggctgacaaggatggcaatggctacctgtccttccgagagttcctggacatcctggtggtcttcatgaaaggctctcctgaggaaaagtctcgccttatgttccgcatgtacgactttgatgggaatggcctcatttccaaggatgagttcatcaggatgctgagatccttcatcgagatctccaacaactgcctgtccaaggcccagctggctgaggtggtggagtccatgttccgggagtcgggattccaggacaaggaggaactgacatgggaagattttcacttcatgctgcgggaccacaatagcgagctccgcttcacgcagctctgtgtcaaaggggtggaggtgcctgaagtcatcaaggacctctgccggcgagcctcctacatcagccaggatatgatctgtccctctcccagagtgagtgcccgctgttcccgcagcgacattgagactgagttgacacctcagagactgcagtgccccatggacacagaccctccccaggagattcggcggaggtttggcaagaaggtaacgtcattccagcccttgctgttcactgaggcgcaccgagagaagttccaacgcagctgtctccaccagacggtgcaacagttcaagcgcttcattgagaactaccggcgccacatcggctgcgtggccgtgttctacgccatcgctggggggcttttcctggagagggcctactactacgcctttgccgcacatcacacgggcatcacagacaccacccgcgtgggaatcatcctgtcgcggggcacagcagccagcatctctttcatgttctcctacatcttgctcaccatgtgccgcaacctcatcaccttcctgcgagaaaccttcctcaaccgctacgtgcccttcgacgccgccgtggacttccatcgcctcattgcctccaccgccatcgtcctcacagtcttacacagtgtgggccatgtggtgaatgtgtacctgttctccatcagccccctcagcgtcctctcttgcctctttcctggcctcttccatgatgatgggtctgagctcccccagaagtattactggtggttcttccagaccgtaccaggcctcacgggggttgtgctgctcctgatcctggccatcatgtatgtctttgcctcccaccacttccgccgccgcagtttccggggcttctggctgacccaccacctctacatcctgctctatgtcctgctcatcatccatggtagctttgccctgatccagctgccccgtttccacatcttcttcctggtcccagcaatcatctatgggggcgacaagctggtgagcctgagccggaagaaggtggagatcagcgtggtgaaggcggagctgctgccctcaggagtgacccacctgcggttccagcggccccagggctttgagtacaagtcagggcagtgggtgcggatcgcttgcctggctctggggaccaccgagtaccaccccttcacactgacctctgcgccccatgaggacacgcttagcctgcacatccgggcagcagggccctggaccactcgcctcagggagatctactcagccccgacgggtgacagatgtgccagatacccaaagctgtaccttgatggaccatttggagagggccaccaggagtggcataagtttgaggtgtcagtgttagtgggagggggcattggggtcaccccttttgcctccatcctcaaagacctggtcttcaagtcatccgtcagctgccaagtgttctgtaagaagatctacttcatctgggtgacgcggacccagcgtcagtttgagtggctggctgacatcatccgagaggtggaggagaatgaccaccaggacctggtgtctgtgcacatctacatcacccagctggctgagaagttcgacctcaggaccactatgctgtacatctgtgagcggcacttccagaaggttctgaaccggagtctattcacaggcctgcgctccatcacccactttggccgtcccccctttgagcccttcttcaactccctgcaggaggtccacccccaggtccggaagatcggggtgtttagctgtggcccccctggcatgaccaagaatgtggaaaaggcctgtcagctcatcaacaggcaggaccggactcacttctcccaccattatgagaacttctaggcccctgcccgggggttctgcccactgttcttcctatttctggctgcctcagccttctctgatttcccacctcccaaccttgttccaggtggcca

SEQ ID NO: 8852 - DNA, 436 bp, Homo sapiens
agagagggctccgcgggcccagctggcagccaggccggagacaagttgcagtcccgggctctggtgacgccgtggccgcagctggaagaggaaaacaaggatcagattggagaagtgatttatctaagatcccacagtggactggcagcagcactgagacctcagcctagtctcctgatccccaagcagggccctgcctaaggaacacactctgcagagtgctgggccaaagcagggttttccaactaatcttagaagggtctccattttgggacattctaatccctgagcccctattattttcatcatgggcttctgcctggctctagcatggacacttctggttggggcatggacccctctgggagctcagaaccccatttcgtgggaggtgcagcgatttgatgggtggtacaacaacctcatggagcacaga

SEQ ID NO: 8853 - DNA, 4539 bp, Homo sapiens
aaggtcaaagtaaaattttaagatcccttgtgcttgtatagacctctgtcaggcagcactgacagaggggacacccctcaccctgagtggggaatcaacctgcagaagaggaatgtcccaccggtttgggagcaaacagcaggactgggtgggctcagggataaggatgatggtgtggagggagccggctgtctaacctctgaccccattaaccacacccctttcctccccacccccaacctataaagcacccaagcctacaaagtgctgaagatgtggatgcactgctgctgggcatggcctcccagatcgcagagcgagaggaccatgtgttggttgaagatgtgcggggtgagtctgaggctgtccctgcaggttgtgaactcctggcctctgggaagaggctcagctggacttccagaaccagatttctggcctgggccactgaagttttcccgcacagaccacctggccagctgcctgcagcggggccgggatctgggcctgccctcttacaccaaggccagggcagcactgggcttgtctcccattacccgctggcaggacatcaaccctgcactctcccggagcaatgacactgtactggaggccacagctgccctgtacaaccaggacttatcctggctagagctgctccctgggggactcctggagagccaccgggaccctggacctctgttcagcaccatcgtccttgaacaatttgtgcggctacgggatggtgaccgctactggtttgagaacaccaggaatgggctgttctccaagaaggagattgaagaaatccgaaataccaccctgcaggacgtgctggtcgctgttatcaacattgaccccagtgctctgcagcccaatgtctttgtctggcataaaggagacccctgtccgcagccgagacagctcagcactgaaggcctgccagcgtgtgctccctctgttgttcgtgactattttgagggcagtggatttggcttcggggtcaccatcgggaccctctgttgcttccctttggtgagcctgctcagtgcctggattgttgcccggctccggatgagaaatttcaagaggctccagggccaggaccgccagagcatcgtgtctgagaagctcgtgggaggcatggaagctttggaatggcaaggccacaaggagccctgccggcccgtgcttgtgtacctgcagcccgggcagatccgtgtggtagatggcaggctcaccgtgctccgcaccatccagctgcagcctccacagaaggtcaacttcgtcctgtccagcaaccgtggacgccgcactctgctgctcaagatccccaaggagtatgacctggtgctgctgtttaacttggaggaagagcggcaggcgctggtggaaaatctccggggagctctgaaggagagcgggttgagcatccaggagtgggagctgcgggagcaggagctgatgagagcagctgtgacacgggagcagcggaggcacctcctggagacctttttcaggcaccttttctcccaggtgctggacatcaaccaggccgacgcagggaccctgcccctggactcctcccagaaggtgcgggaggccctgacctgtgagctgagcagggccgagtttgccgagtccctgggcctcaagccccaggacatgtttgtggagtccatgttctctctggctgacaaggatggcaatggctacctgtccttccgagagttcctggacatcctggtggtcttcatgaaaggctctcctgaggaaaagtctcgccttatgttccgcatgtacgactttgatgggaatggcctcatttccaaggatgagttcatcaggatgctgagatccttcatcgagatctccaacaactgcctgtccaaggcccagctggctgaggtggtggagtccatgttccgggagtcgggattccaggacaaggaggaactgacatgggaagattttcacttcatgctgcgggaccacaatagcgagctccgcttcacgcagctctgtgtcaaaggggtggaggtgcctgaagtcatcaaggacctctgccggcgagcctcctacatcagccaggatatgatctgtccctctcccagagtgagtgcccgctgttcccgcagcgacattgagactgagttgacacctcagagactgcagtgccccatggacacagaccctccccaggagattcggcggaggtttggcaagaaggtaacgtcattccagcccttgctgttcactgaggcgcaccgagagaagttccaacgcagctgtctccaccagacggtgcaacagttcaagcgcttcattgagaactaccggcgccacatcggctgcgtggccgtgttctacgccatcgctggggggcttttcctggagagggcctactactacgcctttgccgcacatcacacgggcatcacagacaccacccgcgtgggaatcatcctgtcgcggggcacagcagccagcatctctttcatgttctcctacatcttgctcaccatgtgccgcaacctcatcaccttcctgcgagaaaccttcctcaaccgctacgtgcccttcgacgccgccgtggacttccatcgcctcattgcctccaccgccatcgtcctcacagtcttacacagtgtgggccatgtggtgaatgtgtacctgttctccatcagccccctcagcgtcctctcttgcctctttcctggcctcttccatgatgatgggtctgagctcccccagaagtattactggtggttcttccagaccgtaccaggcctcacgggggttgtgctgctcctgatcctggccatcatgtatgtctttgcctcccaccacttccgccgccgcagtttccggggcttctggctgacccaccacctctacatcctgctctatgtcctgctcatcatccatggtagctttgccctgatccagctgccccgtttccacatcttcttcctggtcccagcaatcatctatgggggcgacaagctggtgagcctgagccggaagaaggtggagatcagcgtggtgaaggcggagctgctgccctcaggagtgacccacctgcggttccagcggccccagggctttgagtacaagtcagggcagtgggtgcggatcgcttgcctggctctggggaccaccgagtaccaccccttcacactgacctctgcgccccatgaggacacgcttagcctgcacatccgggcagcagggccctggaccactcgcctcagggagatctactcagccccgacgggtgacagatgtgccagatacccaaagctgtaccttgatggaccatttggagagggccaccaggagtggcataagtttgaggtgtcagtgttagtgggagggggcattggggtcaccccttttgcctccatcctcaaagacctggtcttcaagtcatccgtcagctgccaagtgttctgtaagaagatctacttcatctgggtgacgcggacccagcgtcagtttgagtggctggctgacatcatccgagaggtggaggagaatgaccaccaggacctggtgtctgtgcacatctacatcacccagctggctgagaagttcgacctcaggaccactatgctgtacatctgtgagcggcacttccagaaggttctgaaccggagtctattcacaggcctgcgctccatcacccactttggccgtcccccctttgagcccttcttcaactccctgcaggaggtccacccccaggtccggaagatcggggtgtttagctgtggcccccctggcatgaccaagaatgtggaaaaggcctgtcagctcatcaacaggcaggaccggactcacttctcccaccattatgagaacttctaggcccctgcccgggggttctgcccactgcccagttgagcagaggtttgagcccacacctcacctctgttcttcctatttctggctgcctcagccttctctgatttcccacctcccaaccttgttccaggtggccatagtcagtcaccatgtgtgggctcagggacccccaggaccaggatgtgtctcagcctggagaaatggtgggggggcagtgtctagggactagagtgagaagtaggggagctactgatttggggcaaagtgaaacctctgcttccagacttcagaaacaaatctcagaagacaagctgacctgacaagtactatgtgtgtgcatgtctgtatgtgtgttggggcggtgagtgtaaggatgcagtgggagcatggatgctggcatcttagaaccctccctactcccatacctcctcctcttctgggctccccactgtcagacgggctggcaaatgccttgcaggaggtagaggctggacccatggcaagccatttacagaaacccactcggcaccccagtctaacaccacaactaatttcacccaaggttttaagcacgttctttcatcagaccctggcccaatacctatgtatgcaatgctcctcagccctcttctccctgctccagtagtctcccttccaaataaatcacttttctgc

SEQ ID NO: 8854 - DNA, 6533 bp, Homo sapiens
ggttctgcgggttggcgctgagtttggaagtcgcgcgggaccccttttatagcagcgtgggcgacgtgccacacgggtgtcccagcccaggggctggtctgagctggaagaggttgtgcaaataagggccccacctccacggcaggagggtgagccctaggtccagatgctcacactggcgcaggtctgtcctgagccgacacctgcacagtggcgagaccaaggacccagagagaaaggtgagagtgcagccggggaggctgaggatcggcggagctggaagagtgagggtgaaggcaagaagtagagcacagaagcaaagattttaagaggaaagaagacatctgaacccaacaccaccctaaaccacaggctgcagggttggcatgctccgtgcaagaccagaggcactgatgctcctgggagctcttctgactggatccctgggtccatcgggcaatcaggacgcactctcactgccctgggaagtgcagcgctatgacggctggtttaacaacctgaggcaccacgagcgtggtgctgttggctgccggttgcagcgccgcgtaccagccaattacgccgacggtgtgtatcaggctctggaggagccgcagctgcccaacccgcgccggctcagcaacgcagccacgcggggcatagccggcctgccgtcgctccacaaccgcaccgtactgggggtcttctttggctaccatgttctttccgacgtggtgagcgtggaaacgcccggttgccccgccgagttcctcaacatccgcatcccacctggagaccccgtgttcgaccccgaccagcgcggggacgtggtgctgcccttccagaggagccgctgggaccccgagaccggacggagtcccagcaacccccgggacctggccaaccaggtgacgggctggctggacggcagcgccatctatggctcctcgcactcctggagcgacgcgctgcggagcttctcggggggacagctggcgtcggggcccgaccccgctttcccccgagactcgcagaaccccctgctcatgtgggcggcgcccgaccccgccaccgggcagaacgggccccgggggctgtacgccttcggggcagagagagggaaccgggaacccttcctgcaggcgctgggcctgctctggttccgctaccacaacctgtgggcgcagaggctggcccgccagcacccagactgggaggacgaggagctgttccagcacgcacgcaagagggtcatcgccacctaccagaacatcgctgtgtatgagtggctgcccagcttcctgcagaaaacactcccggagtatacaggataccgtcctttcctagaccccagcatctccccggaatttgtggtggcctctgagcagttcttctctaccatggtgccccctggtgtctacatgagaaatgccagctgtcatttccggaaggtcctgaacaagggttttcaaagctcccaagctctcagggtctgcaacaactactggattcgggagaaccccaatctgaacagtacccaggaggtgaatgagctgctgctgggaatggcctcccagatttcggagttggaggacaacatagtggttgaagatctgagggattactggcctggccctggcaaattctcccgtacagactatgtggccagcagcatccaacgtggccgagatatggggctgcccagctatagccaggccctgctggcctttgggctggacatcccaaggaactggagtgatctcaaccctaatgtggacccccaggtgctggaggccacagctgccctgtacaaccaggacctatcccagctagagctgctccttggggggctcctggagagccatggggaccctggacccctgttcagtgccattgtcctcgaccagtttgtacggctgcgggatggtgaccgctactggtttgagaacaccaggaatgggctgttctccaagaaggagattgaagacatccgaaataccaccctgcgggacgtgctggtcgctgttatcaacattgaccccagtgccctgcagcccaatgtctttgtctggcataaaggtgcaccctgccctcaacctaagcagctcacaactgacggcctgccccagtgtgcacccctgactgtgcttgacttctttgaaggcagcagccctggttttgccatcaccatcattgctctctgctgccttcccttagtgagtctgcttctctctggagtggtggcctatttccggggccgagaacacaagaagctacaaaagaaactcaaagagagcgtgaagaaggaagcagccaaagatggagtgccagcgatggagtggccaggccccaaggagaggagcagtcccatcatcatccagctgctgtcagacaggtgtctgcaggtcctgaacaggcatctcactgtgctccgtgtggtccagctgcagcctctgcagcaggtcaacctcatcctgtccaacaaccgaggatgccgcaccctgctgctcaagatccctaaggagtatgacctggtgctgctgtttagttctgaagaggaacggggcgcctttgtgcagcagctatgggacttctgcgtgcgctgggctctgggcctccatgtggctgagatgagcgagaaggagctatttaggaaggctgtgacaaagcagcagcgggaacgcatcctggagatcttcttcagacacctttttgctcaggtgctggacatcaaccaggccgacgcagggaccctgcccctggactcctcccagaaggtgcgggaggccctgacctgcgagctgagcagggccgagtttgccgagtccctgggcctcaagccccaggacatgtttgtggagtccatgttctctctggctgacaaggatggcaatggctacctgtccttccgagagttcctggacatcctggtggtcttcatgaaaggctccccagaggataagtcccgtctaatgtttaccatgtatgacctggatgagaatggcttcctctccaaggacgaattcttcaccatgatgcgatccttcatcgagatctccaacaactgcctgtccaaggcccagctggccgaggtggtggagtctatgttccgggagtcgggattccaggacaaggaggagctgacatgggaggattttcacttcatgctgcgggaccatgacagcgagctccgcttcacgcagctctgtgtcaaaggtggaggtggaggtggaaatggtattagagatatctttaaacaaaacatcagctgtcgagtctcgttcatcactcggacacctggggagcgctcccacccccagggactggggccccctgccccagaagccccagagctgggaggccctggactgaagaagaggtttggcaaaaaggcagcagtgcccactccccggctgtacacagaggcgctgcaagagaagatgcagcgaggcttcctagcccaaaagctgcagcagtacaagcgcttcgtggagaactaccggaggcacatcgtgtgtgtggcaatcttctcggccatctgtgttggcgtgtttgcagatcgtgcttactactatggctttgcctcgccaccctcggacattgcacagaccaccctcgtgggcatcatcctgtcacgaggcacggcggccagcgtctccttcatgttctcttatatcttgctcaccatgtgccgcaacctcataaccttcctgcgagagactttcctcaaccgctatgtgccttttgatgccgcagtggacttccaccgctggatcgccatggctgctgttgtcctggccattttgcacagtgctggccacgcagtcaatgtctacatcttctcagtcagcccactcagcctgctggcctgcatattccccaacgtctttgtgaatgatgggtccaagcttccccagaagttctattggtggttcttccagaccgtcccaggtatgacaggtgtgcttctgctcctggtcctggccatcatgtatgtcttcgcctcccaccacttccgccgccgcagcttccggggcttctggctgacccaccacctctacatcctgctctatgccctgctcatcatccatggcagctatgctctgatccagctgcccactttccacatctacttcctggtcccggcaatcatctatggaggtgacaagctggtgagcctgagccggaagaaggtggagatcagcgtggtgaaggcggagctgctgccctcaggagtgacctacctgcaattccagaggccccaaggctttgagtacaagtcaggacagtgggtgcggatcgcctgcctggctctggggaccaccgagtaccaccccttcacactgacctccgcgccccatgaggacacactcagcctgcacatccgggcagtggggccctggaccactcgcctcagggagatctactcatccccaaagggcaatggctgtgctggatacccaaagctgtaccttgatggaccgtttggagagggccatcaggagtggcataaatttgaggtgtcagtgttggtgggagggggcattggggtcaccccctttgcctccatcctcaaagacctggtcttcaagtcatccttgggcagccaaatgctgtgtaagaagatctacttcatctgggtgacacggacccagcgtcagtttgagtggctggctgacatcatccaagaggtggaggagaacgaccaccaggacctggtgtctgtgcacatttatgtcacccagctggctgagaagttcgacctcaggaccaccatgctatacatctgcgagcggcacttccagaaagtgctgaaccggagtctgttcacgggcctgcgctccatcacccactttggccgtccccccttcgagcccttcttcaactccctgcaggaggtccacccacaggtgcgcaagatcggggtgttcagctgcggccctccaggaatgaccaagaatgtagagaaggcctgtcagctcgtcaacaggcaggaccgagcccacttcatgcaccactatgagaacttctgagcctgtcctccctggctgctgcttccagtatcctgccttctcttctgtgcacctaagttgcccagccctgctggcaatctctccatcagaatccaccttaggcctcagctggagggctgcagagcccctcccaatattgggagaatattgacccagacaattatacaaatgagaaaaggcaggagactatgttctacaattgcagtgcatgatgattataagtccacctgtttatcaacggcaccattcctgcagccctccagacttcctgcccttagcaagtgcgcaaccagtcaggatctcccaaagaagataaagaccactcctcaccccagctcaagccatggcaggcgtggcaagcaaagtggggaggagacagtccctgcttgtgacaagtgtggaggtgaaaaggtacaatagtgcttgtctccgatagctccccacatctctaattgacttccacaaaatcgatgcgttgctttggtatttgcttggactgacatttgagggaggaggaggctgggatcctctggctgagaatctcctcagagcccagtgcagaagctgtgatgcttagaacctggacagcccgactgcctcaactctgtctccaggtctattccctccagctccaaaaggagcagccctacttctaccccttcccgtccccaaagtgtcagcaactttgaggagggcaccaggaaacaaagatgcctccccagccctgatattcttgatgtcaccagtgatacccactgccctgacccctgggcaggcccctctctgcatctactggagtggtccctgggctctggggctgaaggattccagcctctctgccagatattcagtactcgatctcaattcccctcttccacaagagttgggtgaccagctgtcctagtttgcccaggactctccctgttttagcactgaaagtctcttgccccaggaaaccccatcagtcccaggcagattgggacagctggtcaccttacgcaagagccaggctgaaacatcccctccatactcagctctttaacttttcttttcctttttcatcgggctctttcctaaaaagctgagctgtaaaatattttacatcgaggtataataaataatcatgtacatgttttaccaccacccaggtcaagacatagaatgtttcaacatttccatcaccccagaaactccccttgtacccccttccacttcgtctcccctagctcctagaagcaaccactgatgtgatttctaccaaatccagttttggtcctactaaatatactcttttgagactggcctcttttactcaccataatgcctttgtaattcatccatgctgttgtgtgtatcagcagtttgttccttttcattgctgagtagtattctattgtagagatgtaccacagtttgtttattcttctgttgatggacgtttgggttgtttctaattttgaatgattataaataaaaattctgtgagtgttcttgtaccta

SEQ ID NO: 8855 - DNA, 1996 bp, Homo sapiens
cgcgcgaggtgagacggcgagggctcccggggcgcaggtagagatgttccgtcggtgccgaaggcccggctagtgcggttgtgtggacggcgaaaaaaaccaggccaggcgtcaaagcaagtcacccatccgacctaaacccctctaagaccccggagtcacgtctccctccggggatcctcgtgaggtcttgggggtcccaccgccctgcgagccgcgcccgcgccccgccagacccggaactgcgtcgctagaacgtcgggacctggttccctctttaatcacacccccgggggcgcttcgtgtgaggttccacgggggaaggcgagaggcgcaggctgccacacacgcactgtttggaagaggggaagcattgccccccctgcaccacctcaccaagatggctactttgggacacacattccccttctatgctggccccaagccaaccttcccgatggacaccactttggccagcatcatcatgatctttctgactgcactggccacgttcatcgtcatcctgcctggcattcggggaaagacgaggctgttctggctgcttcgggtggtgaccagcttattcatcggggctgcaatcctggctgtgaatttcagttctgagtggtctgtgggccaggtcagcaccaacacatcatacaaggccttcagttctgagtggatcagcgctgatattgggctgcaggtcgggctgggtggagtcaacatcacactcacagggacccccgtgcagcagctgaatgagaccatcaattacaacgaggagttcacctggcgcctgggtgagaactatgctgaggagtatgcaaaggctctggagaaggggctgccagaccctgtgttgtacctagctgagaagttcactccaagaagcccatgtggcctataccgccagtaccgcctggcgggacactacacctcagccatgctatgggtggcattcctctgctggctgctggccaatgtgatgctctccatgcctgtgctggtatatggtggctacatgctattggccacgggcatcttccagctgttggctctgctcttcttctccatggccacatcactcacctcaccctgtcccctgcacctgggcgcttctgtgctgcatactcaccatgggcctgccttctggatcacattgaccacaggactgctgtgtgtgctgctgggcctggctatggcggtggcccacaggatgcagcctcacaggctgaaggctttcttcaaccagagtgtggatgaagaccccatgctggagtggagtcctgaggaaggtggactcctgagcccccgctaccggtccatggctgacagtcccaagtcccaggacattcccctgtcagaggcttcctccaccaaggcatactatcgccccaggagactttccctggtgcctgcggatgtccgaggcctcgcgccagcagcgctcagtgcccttcctggagctctcctggcccaggcctggcgggcactgcttcccggcctgcgatgtcccaaggcggggaaggagtccagattgggtccccctcacagtccttggcgctttggtccagaagggtgcgaagagcgctgggccgaacatactggagactcaccacggcccctccgaggaagaggcacaggacgcctgtggcggtggggatcgaaagaaaggagggcatgtggagtcagggctatgttgcccaggctggtctcgaactctggcctcaaacgaccttcctgcctcgacctcccaaagtgctgggattacaggcgtgatgcccgggccttcttccatcttttggagcctaccccttgtgttacctcccgccacacacctctaatctgaattacatgaaacacggcaagacaccaaacccttctgagccccccacttttcatctgtaaaatggtcataacagtgcctgtttctgcgaactattgagaggggcaaatagggtaatagatgtgaattcattctgtaaactggaaa

SEQ ID NO: 8856 - DNA, 1317 bp, Homo sapiens
atggctactttgggacacacattccccttctatgctggccccaagccaaccttcccgatggacaccactttggccagcatcatcatgatctttctgactgcactggccacgttcatcgtcatcctgcctggcattcggggaaagacgaggctgttctggctgcttcgggtggtgaccagcttattcatcggggctgcaatcctggggacccccgtgcagcagctgaatgagaccatcaattacaacgaggagttcacctggcgcctgggtgagaactatgctgaggagtatgcaaaggctctggagaaggggctgccagaccctgtgttgtacctagctgagaagttcactccaagaagcccatgtggcctataccgccagtaccgcctggcgggacactacacctcagccatgctatgggtggcattcctctgctggctgctggccaatgtgatgctctccatgcctgtgctggtatatggtggctacatgctattggccacgggcatcttccagctgttggctctgctcttcttctccatggccacatcactcacctcaccctgtcccctgcacctgggcgcttctgtgctgcatactcaccatgggcctgccttctggatcacattgaccacaggactgctgtgtgtgctgctgggcctggctatggcggtggcccacaggatgcagcctcacaggctgaaggctttcttcaaccagagtgtggatgaagaccccatgctggagtggagtcctgaggaaggtggactcctgagcccccgctaccggtccatggctgacagtcccaagtcccaggacattcccctgtcagaggcttcctccaccaaggcatactatcgccccaggagactttccctggtgcctgcggatgtccgaggcctcgcgccagcagcgctcagtgcccttcctggagctctcctggcccaggcctggcgggcactgcttcccggcctgcgatgtcccaaggcggggaaggagtccagattgggtccccctcacagtccttggcgctttggtccagaagggtgcgaagagcgctgggccgaacatactggagactcaccacggcccctccgaggaagaggcacaggacgcctgtggcggtggggatcgaaagaaaggagggcatgtggagtcagggctatgttgcccaggctggtctcgaactctggcctcaaacgaccttcctgcctcgacctcccaaagtgctgggattacaggcgtgatgcccgggccttcttccatcttttggagcctaccccttgtgttacctcccgccacacacctctaatctga

SEQ ID NO: 8857 - DNA, 562 bp, Homo sapiens
gtgcttccagcggacggcagcgcgcgagaccaggccaggcgtcaaagcaagtcacccatccgacctaaacccctctaagaccccggagtcacgtctccctccggggatcctcgtgaggtcttgggggtcccaccgccctgcgagccgcgcccgcgccccgccagacccggaactgcgtcgctagaacgtcgggacctggttccctctttaatcacacccccgggggcgcttcgtgtgaggttccacgggggaaggcgagaggcgcaggctgccacacacgcactgtttggaagaggggaagcattgccccccctgcaccacctcaccaagatggctactttgggacacacattccccttctatgctggccccaagccaaccttcccgatggacaccactttggccagcatcatcatgatctttctgactgcactggccacgttcatcgtcatcctgcctggcattcggggaaagacgaggctgttctggctgcttcgggtggtgaccagcttattcatcggggctgcaatcctggggacccccgtgcagcagctgaatgaga

SEQ ID NO: 8858 - DNA, 578 bp, Homo sapiens
atggagtctggcgcctggggaggcgcggaggtgcttccagcggacggcagcgcgcgagaccaggccaggcgtcaaagcaagtcacccatccgacctaaacccctctaagaccccggagtcacgtctccctccggggatcctcgtgaggtcttgggggtcccaccgccctgcgagccgcgcccgcgccccgccagacccggaactgcgtcgctagaacgtcgggacctggttccctctttaatcacacccccgggggcgcttcgtgtgaggttccacgggggaaggcgagaggcgcaggctgccacacacgcactgtttggaagaggggaagcattgccccccctgcaccacctcaccaagatggctactttgggacacacattccccttctatgctggccccaagccaaccttcccgatggacaccactttggccagcatcatcatgatctttctgactgcactggccacgttcatcgtcatcctgcctggcattcggggaaagacgaggctgttctggctgcttcgggtggtgaccagcttattcatcggggctgcaatcctggctgtgaatttcag

SEQ ID NO: 8859 - DNA, 1678 bp, Homo sapiens
gcttccagcggacggcagcgcgcgagaccaggccaggcgtcaaagcaagtcacccatccgacctaaacccctctaagaccccggagtcacgtctccctccggggatcctcgtgaggtcttgggggtcccaccgccctgcgagccgcgcccgcgccccgccagacccggaactgcgtcgctagaacgtcgggacctggttccctctttaatcacacccccgggggcgcttcgtgtgaggttccacgggggaaggcgagaggcgcaggctgccacacacgcactgtttggaagaggggaagggctgcacttcctgctttcatccagaccaagttcggatcaagtgggagttcttcaaagagagagtttgcattgccccccctgcaccacctcaccaagatggctactttgggacacacattccccttctatgctggccccaagccaaccttcccgatggacaccactttggccagcatcatcatgatctttctgactgcactggccacgttcatcgtcatcctgcctggcattcggggaaagacgaggctgttctggctgcttcgggtggtgaccagcttattcatcggggctgcaatcctggggacccccgtgcagcagctgaatgagaccatcaattacaacgaggagttcacctggcgcctgggtgagaactatgctgaggagtatgcaaaggctctggagaaggggctgccagaccctgtgttgtacctagctgagaagttcactccaagaagcccatgtggcctataccgccagtaccgcctggcgggacactacacctcagccatgctatgggtggcattcctctgctggctgctggccaatgtgatgctctccatgcctgtgctggtatatggtggctacatgctattggccacgggcatcttccagctgttggctctgctcttcttctccatggccacatcactcacctcaccctgtcccctgcacctgggcgcttctgtgctgcatactcaccatgggcctgccttctggatcacattgaccacaggactgctgtgtgtgctgctgggcctggctatggcggtggcccacaggatgcagcctcacaggctgaaggctttcttcaaccagagtgtggatgaagaccccatgctggagtggagtcctgaggaaggtggactcctgagcccccgctaccggtccatggctgacagtcccaagtcccaggacattcccctgtcagaggcttcctccaccaaggcatactgtaaggaggcacaccccaaagatcctgattgtgctttataacattcctccccgtggaggccacctggacttccagtctggctccaaacctcattggcgccccataaaaccagcagaactgccctcagggtggctgttaccagacacccagcaccaatctacagacggagtagaaaaaggaggctctatatactgatgttaaaaaacaaaacaaaacaaaaagccctaagggactgaagagatgctgggcctgtccataaagcctgttgccatgataaggccaagcaggggctagcttatctgcacagcaacccagcctttccgtgctgccttgcctcttcaagatgctattcactgaaacctaacttcacccccataacaccagcagggtgggggttacatatgattctcctatggtttcctctca

SEQ ID NO: 8860 - DNA, 532 bp, Homo sapiens
agcgcgcgaggtgagacggcgagggctcccggggcgcaggtagagatgttccgtcggtgccgaaggcccggctagtgcggttgtgtggacggcgaaaaaaaccaggccaggcgtcaaagcaagtcacccatccgacctaaacccctctaagaccccggagtcacgtctccctccggggatcctcgtgaggtcttgggggtcccaccgccctgcgagccgcgcccgcgccccgccagacccggaactgcgtcgctaggccgggagagggaggcggcgccgcagagcctcgggtgcagtctgagaagtttgggagtgacttgaagagtgactggaagcaccccagacccgaacgtcgggacctggttccctctttaatcacacccccgggggcgcttcgtgtgaggttccacgggggaaggcgagaggcgcaggctgccacacacgcactgtttggaagaggggaagcattgccccccctgcaccacctcaccaagatggctactttgggacacacattccccttctatgctgg

SEQ ID NO: 8861 - DNA, 2684 bp, Homo sapiens
gcttccagcggacggcagcgcgcgagcattgccccccctgcaccacctcaccaagatggctactttgggacacacattccccttctatgctggccccaagccaaccttcccgatggacaccactttggccagcatcatcatgatctttctgactgcactggccacgttcatcgtcatcctgcctggcattcggggaaagacgaggctgttctggctgcttcgggtggtgaccagcttattcatcggggctgcaatcctggggacccccgtgcagcagctgaatgagaccatcaattacaacgaggagttcacctggcgcctgggtgagaactatgctgaggagtatgcaaaggctctggagaaggggctgccagaccctgtgttgtacctagctgagaagttcactccaagaagcccatgtggcctataccgccagtaccgcctggcgggacactacacctcagccatgctatgggtggcattcctctgctggctgctggccaatgtgatgctctccatgcctgtgctggtatatggtggctacatgctattggccacgggcatcttccagctgttggctctgctcttcttctccatggccacatcactcacctcaccctgtcccctgcacctgggcgcttctgtgctgcatactcaccatgggcctgccttctggatcacattgaccacaggactgctgtgtgtgctgctgggcctggctatggcggtggcccacaggatgcagcctcacaggctgaaggctttcttcaaccagagtgtggatgaagaccccatgctggagtggagtcctgaggaaggtggactcctgagcccccgctaccggtccatggctgacagtcccaagtcccaggacattcccctgtcagaggcttcctccaccaaggcatactgtaaggaggcacaccccaaagatcctgattgtgctttataacattcctccccgtggaggccacctggacttccagtctggctccaaacctcattggcgccccataaaaccagcagaactgccctcagggtggctgttaccagacacccagcaccaatctacagacggagtagaaaaaggaggctctatatactgatgttaaaaaacaaaacaaaacaaaaagccctaagggactgaagagatgctgggcctgtccataaagcctgttgccatgataaggccaagcaggggctagcttatctgcacagcaacccagcctttccgtgctgccttgcctcttcaagatgctattcactgaaacctaacttcacccccataacaccagcagggtgggggttacatatgattctcctatggtttcctctcatccctcggcacctcttgttttcctttttcctgggttccttttgttcttcctttacttctccagcttgtgtggccttttggtacaatgaaagacagcactggaaaggaggggaaaccaaacttctcatcctaggtctaacattaaccaactatgccacattctctttgagcttcagttcccaaatttgctacataagattgcaagacttgccaagaatcttgggatttatctttctatgccttgctgacacctaccttggccctcaaacaccacctcacaagaagccaggtgggaagttagggaatcaactccaaaacgctattccttcccaccccactcagctgggctagctgagtggcatccaggacgggggagtgggtgacctgcctcatcactgccacctaacgtccccctggggtggttcagaaagatgctagctctggtagggtccctccggcctcactagagggcgcccctattactctggagtcgacgcagagaatcaggtttcacagcactgcggagagtgtactaggctgtctccagcccagcgaagctcatgaggacgtgcgaccccggcgcggagaagccatgaaaattaatgggaaaaacagtttttaaaaaacaaaagaaaaaaaggtttatttacagatcgccccaggagactttccctggtgcctgcggatgtccgaggcctcgcgccagcagcgctcagtgcccttcctggagctctcctggcccaggcctggcgggcactgcttcccggcctgcgatgtcccaaggcggggaaggagtccagattgggtccccctcacaggttagtggtgatacattttaagtctgggagagcggcctgcttgtgcagtgggtcgccgaggataagaggtgagccccctctctcctggctgcagtccttggcgctttggtccagaagggtgcgaagagcgctgggccgaacatactggagactcaccacggcccctccgaggaagaggcacaggacgcctgtggcggtggggatcgaaagaaaggagggcatgtggagtcagggctatgttgcccaggctggtctcgaactctggcctcaaacgaccttcctgcctcgacctcccaaagtgctgggattacaggcgtgatgcccgggccttcttccatcttttggagcctaccccttgtgttacctcccgccacacacctctaatctgaattacatgaaacacggcaagacaccaaacccttctgagccccccacttttcatctgtaaaatggtcataacagtgcctgtttctgcgaactattgagaggggcaaatagggtaatagatgtgaattcattctgtaaactgg

SEQ ID NO: 8862 - DNA, 1965 bp, Homo sapiens
agcgcgcgaggtgagacggcgagggctcccggggcgcagtccaaggccatcgatcacctgccacccacagaccaggccaggcgtcaaagcaagtcacccatccgacctaaacccctctaagaccccggagtcacgtctccctccggggatcctcgtgaggtcttgggggtcccaccgccctgcgagccgcgcccgcgccccgccagacccggaactgcgtcgctagaacgtcgggacctggttccctctttaatcacacccccgggggcgcttcgtgtgaggttccacgggggaaggcgagaggcgcaggctgccacacacgcactgtttggaagaggggaagcattgccccccctgcaccacctcaccaagatggctactttgggacacacattccccttctatgctggccccaagccaaccttcccgatggacaccactttggccagcatcatcatgatctttctgactgcactggccacgttcatcgtcatcctgcctggcattcggggaaagacgaggctgttctggctgcttcgggtggtgaccagcttattcatcggggctgcaatcctggctgtgaatttcagttctgagtggtctgtgggccaggtcagcaccaacacatcatacaaggccttcagttctgagtggatcagcgctgatattgggctgcaggtcgggctgggtggagtcaacatcacactcacagggacccccgtgcagcagctgaatgagaccatcaattacaacgaggagttcacctggcgcctgggtgagaactatgctgaggagtatgcaaaggctctggagaaggggctgccagaccctgtgttgtacctagctgagaagttcactccaagaagcccatgtggcctataccgccagtaccgcctggcgggacactacacctcagccatgctatgggtggcattcctctgctggctgctggccaatgtgatgctctccatgcctgtgctggtatatggtggctacatgctattggccacgggcatcttccagctgttggctctgctcttcttctccatggccacatcactcacctcaccctgtcccctgcacctgggcgcttctgtgctgcatactcaccatgggcctgccttctggatcacattgaccacaggactgctgtgtgtgctgctgggcctggctatggcggtggcccacaggatgcagcctcacaggctgaaggctttcttcaaccagagtgtggatgaagaccccatgctggagtggagtcctgaggaaggtggactcctgagcccccgctaccggtccatggctgacagtcccaagtcccaggacattcccctgtcagaggcttcctccaccaaggcatactatcgccccaggagactttccctggtgcctgcggatgtccgaggcctcgcgccagcagcgctcagtgcccttcctggagctctcctggcccaggcctggcgggcactgcttcccggcctgcgatgtcccaaggcggggaaggagtccagattgggtccccctcacagtccttggcgctttggtccagaagggtgcgaagagcgctgggccgaacatactggagactcaccacggcccctccgaggaagaggcacaggacgcctgtggcggtggggatcgaaagaaaggagggcatgtggagtcagggctatgttgcccaggctggtctcgaactctggcctcaaacgaccttcctgcctcgacctcccaaagtgctgggattacaggcgtgatgcccgggccttcttccatcttttggagcctaccccttgtgttacctcccgccacacacctctaatctgaattacatgaaacacggcaagacaccaaacccttctgagccccccacttttcatctgtaaaatggtcataacagtgcctgtttctgcgaactattgagaggggcaaatagggtaatagatgtgaattcattctgtaaactgg

SEQ ID NO: 8863 - DNA, 572 bp, Homo sapiens
gcttccagcggacggcagcgcgcgaggtgagacggcgagggctcccggggcgcagaccaggccaggcgtcaaagcaagtcacccatccgacctaaacccctctaagaccccggagtcacgtctccctccggggatcctcgtgaggtcttgggggtcccaccgccctgcgagccgcgcccgcgccccgccagacccggaactgcgtcgctagaacgtcgggacctggttccctctttaatcacacccccgggggcgcttcgtgtgaggttccacgggggaaggcgagaggcgcaggctgccacacacgcactgtttggaagaggggaagcattgccccccctgcaccacctcaccaagatggctactttgggacacacattccccttctatgctggccccaagccaaccttcccgatggacaccactttggccagcatcatcatgatctttctgactgcactggccacgttcatcgtcatcctgcctggcattcggggaaagacgaggctgttctggctgcttcgggtggtgaccagcttattcatcggggctgcaatcctggggacccccgt

SEQ ID NO: 8864 - DNA, 641 bp, Homo sapiens
agccacggggcggggcgcagtggggcgggatggagtctggcgcctggggaggcgcggaggtgcttccagcggacggcagcgcgcgagaccaggccaggcgtcaaagcaagtcacccatccgacctaaacccctctaagaccccggagtcacgtctccctccggggatcctcgtgaggtcttgggggtcccaccgccctgcgagccgcgcccgcgccccgccagacccggaactgcgtcgctagcccttctctgtaccaggccgggagagggaggcggcgccgcagagcctcgggtgcagtctgagaagtttgggagtgacttgaagagtgactggaagcaccccagacccggtttgtccggtcacagccgggtccttacgtgagttaggagaggagtgggggtcggacgggagccccactgagagtaagggcgcgcgtttgttcacagaacgtcgggacctggttccctctttaatcacacccccgggggcgcttcgtgtgaggttccacgggggaaggcgagaggcgcaggctgccacacacgcactgtttggaagaggggaagcattgccccccctgcaccacctcaccaagatggctactttgggacacacattccccttctatgctggccccaagcc

SEQ ID NO: 8865 - DNA, 441 bp, Homo sapiens
gcggacggcagcgcgcgaggtgagacggcgagggctcccggggcgcagcattgccccccctgcaccacctcaccaagatggctactttgggacacacattccccttctatgctggccccaagccaaccttcccgatggacaccactttggccagcatcatcatgatctttctgactgcactggccacgttcatcgtcatcctgcctggcattcggggaaagacgaggctgttctggctgcttcgggtggtgaccagcttattcatcggggctgcaatcctggctgtgaatttcagttctgagtggtctgtgggccaggtcagcaccaacacatcatacaaggccttcagttctgagtggatcagcgctgatattgggctgcaggtcgggctgggtggagtcaacatcacactcacagggacccccgtgcagcagctgaatg

SEQ ID NO: 8866 - DNA, 1044 bp, Homo sapiens
accaagatggctactttgggacacacattccccttctatgctggccccaagccaaccttcccgatggacaccactttggccagcatcatcatgatctttctgactgcactggccacgttcatcgtcatcctgcctggcattcggggaaagacgaggctgttctggctgcttcgggtggtgaccagcttattcatcggggctgcaatcctggctgtgaatttcagttctgagtggtctgtgggccaggtcagcaccaacacatcatacaaggccttcagttctgagtggatcagcgctgatattgggctgcaggtcgggctgggtggagtcaacatcacactcacagggacccccgtgcagcagctgaatgagaccatcaattacaacgaggagttcacctggcgcctgggtgagaactatgctgaggagtatgcaaaggctctggagaaggggctgccagaccctgtgttgtacctagctgagaagttcactccaagaagcccatgtggcctataccgccagtaccgcctggcgggacactacacctcagccatgctatgggtggcattcctctgctggctgctggccaatgtgatgctctccatgcctgtgctggtatatggtggctacatgctattggccacgggcatcttccagctgttggctctgctcttcttctccatggccacatcactcacctcaccctgtcccctgcacctgggcgcttctgtgctgcatactcaccatgggcctgccttctggatcacattgaccacaggactgctgtgtgtgctgctgggcctggctatggcggtggcccacaggatgcagcctcacaggctgaaggctttcttcaaccagagtgtggatgaagaccccatgctggagtggagtcctgaggaaggtggactcctgagcccccgctaccggtccatggctgacagtcccaagtcccaggacattcccctgtcagaggcttcctccaccaaggcatactgtaaggaggcacaccccaaagatcctgattgtgctttataacattcc

SEQ ID NO: 8867 - DNA, 1760 bp, Homo sapiens
aactcagcgccaacccgcagaaccaggaaagtaacggctacagacagtgagaaatagtttcgctcgccggctagaaaaactctgtcggtaccaaccccagagcgttgagagcagcccacctccacgcttccttaacggagaggtgcaggactcagacttcaccagcccactcggtcccagccttgtacgcaaagagacgccaaggacgcgctctcccgcgtccaggcagccccagcttgctggcttgcctgcccgcctgcgtgcagcactcggccggcgtgcagcatgaccctgtggaacggcgtactgcctttttacccccagccccggcatgccgcaggcttcagcgttccactgctcatcgttattctagtgtttttggctctagcagcaagcttcctgctcatcttgccggggatccgtggccactcgcgctggttttggttggtgagagttcttctcagtctgttcataggcgcagaaattgtggctgtgcacttcagtgcagaatggttcgtgggtacagtgaacaccaacacatcctacaaagccttcagcgcagcgcgcgttacagcccgtgtccgtctgctcgtgggcctggagggcattaatattacactcacagggaccccagtgcatcagctgaacgagaccattgactacaacgagcagttcacctggcgtctgaaagagaattacgccgcggagtacgcgaacgcactggagaaggggctgccggacccagtgctctacctggcggagaagttcacaccgagtagcccttgcggcctgtaccaccagtaccacctggcgggacactacgcctcggccacgctatgggtggcgttctgcttctggctcctctccaacgtgctgctctccacgccggccccgctctacggaggcctggcactgctgaccaccggagccttcgcgctcttcggggtcttcgccttggcctccatctctagcgtgccgctctgcccgctccgcctaggctcctccgcgctcaccactcagtacggcgccgccttctgggtcacgctggcaaccggcgtcctgtgcctcttcctcggaggggccgtggtgagtctccagtatgttcggcccagcgctcttcgcacccttctggaccaaagcgccaaggactgcagccaggagagagggggctcacctcttatcctcggcgacccactgcacaagcaggccgctctcccagacttaaaatgtatcaccactaacctgtgagggggacccaatctggactccttccccgccttgggacatcgcaggccgggaagcagtgcccgccaggcctgggccaggagagctccaggaagggcactgagcgctgctggcgcgaggcctcggacatccgcaggcaccagggaaagtctcctggggcgatctgtaaataaacctttttttcttttgttttttaaaaactgtttttcccattaattttcatggcttctccgcgccggggtcgcacgtcctcatgagcttcgctgggctggagacagcctagtacactctccgcagtgctgtgaaacctgattctctgcgtcgactccagagtaataggggcgccctctagtgaggccggagggaccctaccagagctagcatctttctgaaccaccccagggggacgttaggtggcagtgatgaggcaggtcacccactcccccgtcctggatgccactcagctagcccagctgagtggggtgggaaggaatagcgttttggagttgattccc

SEQ ID NO: 8868 - DNA, 6885 bp, Homo sapiens
ggggaggagggaggccgggcctgcggccggggaccgagccgcaaagacagagcgggcagaggcgatggagggcgacggggtgccatggggcagcgagcccgtctcgggtcccggccccggcggcggcggaatgatccgcgagctgtgccggggcttcggccgctaccgccgctacctgggacggctgcgacagaacctgcgcgagacccagaagttcttccgcgacatcaagtgctcccacaaccacacttgtctctcctccctcacgggcggcggcggggccgagcgcggccctgcaggcgatgtcgccgaaaccgggctgcaggcgggccaactgagctgcatttccttcccacctaaggaagagaagtacctccagcagattgtggactgcctcccttgcatactgatcctcggccaggattgtaacgtcaagtgccagctgttgaatctgctgttgggggtgcaggtgcttcccaccaccaagctgggcagtgaggagagctgtaagcttcggcgcctccgcttcacctatgggactcagactcgggtcagcctggcgctccctggacagtatgaactagtgcacacgctggttgctcatcagggcaactgggagaccatccctgaggaggatctggaggtccaagagaacaatgaggatgctgctcatgttttagcggaactggaggtaacgatgcaccatgctctcttacaggaagtggacgttgtggtagcaccatgccaaggcctccggcccacagtggatgttctgggtgacttggtgaatgatttcttgcctgtgataacctatgcactccacaaagatgaactctctgagagggatgagcaagagcttcaggaaatccgaaagtatttctcctttcctgtattctttttcaaagtgccgaaactgggctcggagataatagactcctcaaccaggagaatggagagcgaaagatcaccgctttatcgccagctaattgacctgggctatctgagcagcagtcactggaactgtggggctcctggccaggatactaaagctcagagcatgttggtggaacagagtgaaaagctgagacacttgagcacattttctcaccaggtgttacagactcgcctggtggatgcagccaaggccctgaacctggtgcactgccactgccttgacatctttattaaccaggcatttgacatgcagcgggacctgcagatcactcccaaacgtctggaatatactcgaaaaaaggagaatgagttgtatgaatcattgatgaatattgccaaccgaaagcaggaggaaatgaaggatatgattgttgagacacttaataccatgaaggaggaacttctggatgatgctactaacatggagtttaaagacgtcattgtccctgagaatggagaaccaatcactgacttaggattctgcaagccagaggccatgatgtcaggcagcattgtggggacaccaatccatatggcccctgaacttttcacagggaagtacgataattccgtggatgtctacgcttttggaattcttttctggtatatctgctcaggctctgtcaagctccctgaggcatttgagaggtgtgctagcaaagaccatctctggaacaatgtgcggaggggggctcgcccagaacgtcttcctgtgtttgatgaggagtgctggcagttgatggaagcctgttgggatggcgaccccttgaagaggcctctcttgggcattgtccagcccatgctccagggcatcatgaatcggctctgcaagtccaattctgagcagccaaacagaggactagatgattctacttgaaagcaaagacctttctctttcactctctagttatttccttccccctcaccttttggccatggggagaatttgacatttattcactataggacacactcccaagggaactggtgcttgctgggaaacttggaaccttcccaggcagggatgactcctggacagtgaagagttgaatgactgagcatattcagcagctcactgaagcgccaagctatccctttagcaaaaaagtgtctcagatgtgtaaaagctgaggaatgtggtgttctggcttcacaaatgaaaaggaggcagatgttaccattgtcttttcactgtatatacttctaagacagcaagcgggacactgcagtggcaatagtgttaaaaaatctcattctcatgatttttggctctagctaggaatagtttagtcaggactcagaaaatttgagcttagttctgggattatgaaaacatggggacaaaaacaataacttgtggatgtctggttcctgctgtctgcagccaggtatctcaggttgcaatggtcagaagtcccagtgagggagctagaaacagagctatctgttcctcatagtgccagtgtgtttacatttataggaccacatatccctggtttctgggggagggtttcactgttacatcaccaagaggccctgaaaagaggaaaaaaaaaaaaaaagaggccaggcatggtggctcacgcctgtaatctcagcactttgggaggctgaggcgggcggatcacaaggtccagagttcaagagcagcctggccaacatggtgaaaccccgtctctactaaagatacaaaaaattagccgggcgtggtggtgcatgcctgtaatccaagatactcaggaggctgaggcaggagaatcgcttgaacctgggaggcggaggttgcagtgagccgagatcatgccattgcactccagcctgggcgacagagtgagactctgtctcaaaaaaaaaaaaaaaatagaatgtgtatgcatatatttgtgtgtatatgtatatatgtgtgtgtgtctatatctctatctatatagacatacacacaggagttattggatttagagttactgctaaccccagaacagaatctgttcttttacctttgagtcttttcttttgtttacctcttttcatctcaaagtgggaaagctccagataacatggtacttaggagtgagtgtctaagcaaaaccaacccaatgcgaagtatttgggtgagaactgagaggtgggagatgattggaggccatggcctatgtacaaacatactggaagaaaaccagcttgtttttaaaacttaacacaatcagaaatttttctttttgtgtttgaatctaacacactgacgtttggaaaacttgatcaatgagcttttaaccacgatttctcccgcaatttgttccttctttttacctttttaaaaatctgttagaagaaaaaaagcagcagacgaaagagaaaaaccctcctctggtagttctgtgtgtgcccctcacccctgtgtgctagtgtctgggaagtttccctgaaaggtgggaggcgggtgggtggtcttttggagggttcctcatgaagtgtgcttgaggaaagaaattctgattctaggcagaggaaggggaacaatttaaatattggtgcatctcagatgcacttgacttcaagccttcctcaaccaaactggtccattagattccgaaaaacaggtagacgaggaagtagacagtggaagtgagtagtctccctccatctgcctaatccccaataactgtggtctggcccctgtgttcagcccgagagtttgtaaaacaggtccccaggtaggtgtataagatgagttgcaaattagccgggcatgctggcacgcaccagtaatcccagctacttgggaggctgaggcaggagaatcacttgaacccgggaggcagaggtcatggtgagccgagatcacgccactgcactccagcctgggcaacagagcgagactctatctcaaaaaaaaacaaaaaaaaaaacaaaaaacaaagatgagtcgcacatctgctgctgggattttctagggttgtctatgacagaatgaccatcttttaaatattaatggagtataaatggagtctataatgggtctttcatataacttttaactctttggctatcctgggctctgatcatgatatgtttgagcatagtagctccctaaactcttggagcctttcagaaattccatgtagtgctaataacctttttacttgcaaatgataaagtaactgactcagtgtctttgggctctgcaggctttagccttgttttggtaggatgttcagtatattctcagaatttttaccacctatttagctatacttcaagtactctattctctgcactaacttactgtccttctgggaactatgatggggcttcaagggagtcaggtgtcaagaaaggaggggtaagtactctctacttgctggaaaatcattgtaagtctgttgtgtatgaaattttaggaaaagtcttatatagttccctttccagactgttttcttttgactctaactataatcataagtctgtgcttccattatgaaggtcacattcctagcattcttgggaagtattagctcatactctcattcacatatgggaggttagatttttttcctctacccagagtccctttttagtttaccccacggcttagtttgctgtcagataccagttctctagcagattccccaacagttttttccccagtggggagggtggaagggagggactgatataagtaaggagatgagtagttgtgttacagttcattttctttaaaaaaaagtattttgagaaaaggtgcaaaatattcttgaaagtctctaggccagccaaagtccacatatggatatttggggatgttatttaaatactcagcaggctgagtgcaggtatacgtgtgtatagagtgtgtatactttgcttttgttttataacattgtcagctaattttggctttgttctttggcatccattcttattataagtgatggaatgccatgaaatgtactgtattgtatattacttgggaggacactaggttttcaaagaagtctggcagcacttgggttatagagggctcagcatgaccaaagtcctaaagattttacctcccagctttggttgtatgtgttcccaagtggtgaggtgagattgtggctggaggaagaaaaaggatggcatgaaagaatgacccttattgtggtctgtccttctaatcaacataattagggcagcttaccccaacatgaaaatgatgacctggccatttttaatggccagagcttgaagtctggtctctcattttgtttcagaaatgagtgagaggccttcctgcagagcagtcaggagaaatggtggagcctggggccctggaatggctgaccctgtgcctagagagctgatggcaagggctgtctggcatggctcatttgggtggggtttccccaggcataccttagttccctgatcctctgcaaagagtagctcattgactgagcaagcgcttcaggaggactgtgctggttgttcccagaccaaagagagtcacttttgactccatcaacttcaaggggacagagcctaggcagcagattctcctaatttttaacactaaaattcaaggaagcagtggaggaaagaatgcattactaccacagatagaaataggggactcatagaactctcgactagtacctgtcagctctcaaatgcattcttgtgtctttgcttgagctgccaaagaagggtcacaaagtgttcttcctcatggaagaagtgcctcggggttgcagggctgcaaagtgacaactgcactgaatgacactttattttttggctttggcttattatttagcactgggaggcccaggggaattggtgattacagtagcactttgggaagttaaagccccctttgggcttgctttggagagatgatggcatgcttggtattccatttggataatcaggaagcctccctagtccatccatattgtgtcagagtgggattaacaaccctggaagagtccactgccaaaagagtagttgctttcctggaatttccaaagcttttggattttctggatcaagtaacccactttttaaaacctgaggtcaggagttcgagaccagcctggtaacatggtgaaaccccgtctctattaaaaatagaaaaaattagccaggcatggtggcgggcacctatagtcccagctactcaggaggctgaggtaggagaattgcttgaacccaggagacagaggctgcattgagccaagatcacaccactgcactccagcctgggcagcagagcaagactccatctcaaaaaaaaaaaaaagaaaaagaaaaagaaggttaatccttcagttatggaggtgggatgaatagagcttgtttgatgttaaagtgggtaaggagggagtggccttgagacacttgtattccaaactctcctggaggtttccagtagcactactgttcctaaaagggtttcatttttaacttcatctgttttgttaacatccagtccaattgaggtgatctcagaggtgcatcaggacatctagcactggggaggccaccttgcccagatagttgaaaagaaaattggtctgggcagcctgttgtcttttgtcttcatgtaatgttttttctttgttttaaaggactaatgtttattacagtgttaaataaaagtgtaagatactaagtgtgtagaataaaagtgcaataacaaaagacaatgactttggcacacacttcagtctttatcctctctcctttcttgtgctacctggctctttccataatattgttacagcaggaccgtcttaattgtgtgcattttgaagagatgcgactctgggttaatcttcattagtgtaatattgaagggttgggtttggttttatagagtattctgtatacttgttgggatacacaaataccagatgtgctgtataataaagatcacattaacgtttt

SEQ ID NO: 8869 - DNA, 7739 bp, Homo sapiens
ccgagccgcaaagacagagcgggcagaggcgatggagggcgacggggtgccatggggcagcgagcccgtctcgggtcccggccccggcggcggcggaatgatccgcgagctgtgccggggcttcggccgctaccgccgctacctgggacggctgcgacagaacctgcgcgagacccagaagttcttccgcgacatcaagtgctcccacaaccacacttgtctctcctccctcacgggcggcggcggggccgagcgcggccctgcaggcgatgtcgccgaaaccgggctgcaggcgggccaactgagctgcatttccttcccacctaaggaagagaagtacctccagcagattgtggactgcctcccttgcatactgatcctcggccaggattgtaacgtcaagtgccagctgttgaatctgctgttgggggtgcaggtgcttcccaccaccaagctgggcagtgaggagagctgtaagcttcggcgcctccgcttcacctatgggactcagactcgggtcagcctggcgctccctggacagtatgaactagtgcacacgctggttgctcatcagggcaactgggagaccatccctgaggaggatctggaggtccaagagaacaatgaggatgctgctcatgttttagcggaactggaggtaacgatgcaccatgctctcttacaggaagtggacgttgtggtagcaccatgccaaggcctccggcccacagtggatgttctgggtgacttggtgaatgatttcttgcctgtgataacctatgcactccacaaagatgaactctctgagagggatgagcaagagcttcaggaaatccgaaagtatttctcctttcctgtattctttttcaaagtgccgaaactgggctcggagataatagactcctcaaccaggagaatggagagcgaaagatcaccgctttatcgccagctaattgacctgggctatctgagcagcagtcactggaactgtggggctcctggccaggatactaaagctcagagcatgttggtggaacagagtgaaaagctgagacacttgagcacattttctcaccaggtgttacagactcgcctggtggatgcagccaaggccctgaacctggtgcactgccactgccttgacatctttattaaccaggcatttgacatgcagcgggacctgcagatcactcccaaacgtctggaatatactcgaaaaaaggagaatgagttgtatgaatcattgatgaatattgccaaccgaaagcaggaggaaatgaaggatatgattgttgagacacttaataccatgaaggaggaacttctggatgatgctactaacatggagtttaaagacgtcattgtccctgagaatggagaaccagtaggcaccagagagatcaaatgctgcatccgacagatccaggaactcatcatctcccgacttaatcaggcagtggctaataagctgatcagctcagtggattacctgagggaaagcttcgtcggaaccctggaacgatgtctgcagagcctggagaagtctcaggatgtctcagttcacatcaccagtaattatctcaaacagatcttaaatgctgcctatcatgttgaagtcacgtttcactcagggtcgtcagttacaaggatgctatgggagcaaatcaaacagatcatccagcgcatcacatgggtgagcccacctgccatcactctggaatggaagaggaaggtggcccaggaagccattgagagcctcagcgcctccaaattggctaagagcatttgcagccaattccggactcggctcaatagttcccacgaggcttttgcagcctccttgcggcagctggaagctggccactcaggccggttagagaaaacggaagatctatggctgagggttcggaaagatcatgctccccgcctggcccgcctttctctggaaagctgttctttacaggatgtcttgcttcatcgtaaacctaaactgggacaggaactgggccggggccagtatggtgtggtatacctgtgtgacaactggggaggacacttcccttgtgccctcaaatcagttgtccctccagatgagaagcactggaatgatctggctttggaatttcactatatgaggtctctgccgaagcatgagcgattggtggatctccatggttcagtcattgactacaactatggtggtggctccagcattgctgtgctcctcattatggagcggctacaccgggatctctacacagggctgaaggctgggctgaccctggagacacgtttgcagatagcactagatgtggtggagggaatccgcttcctgcacagccagggacttgtccatcgtgatatcaaactgaaaaatgtgctgctggataagcagaaccgtgccaagatcactgacttaggattctgcaagccagaggccatgatgtcaggcagcattgtggggacaccaatccatatggcccctgaacttttcacaggggctcgcccagaacgtcttcctgtgtttgatgaggagtgctggcagttgatggaagcctgttgggatggcgaccccttgaagaggcctctcttgggcattgtccagcccatgctccagggcatcatgaatcggctctgcaagtccaattctgagcagccaaacagaggactagatgattctacttgaaagcaaagacctttctctttcactctctagttatttccttccccctcaccttttggccatggggagaatttgacatttattcactataggacacactcccaagggaactggtgcttgctgggaaacttggaaccttcccaggcagggatgactcctggacagtgaagagttgaatgactgagcatattcagcagctcactgaagcgccaagctatccctttagcaaaaaagtgtctcagatgtgtaaaagctgaggaatgtggtgttctggcttcacaaatgaaaaggaggcagatgttaccattgtcttttcactgtatatacttctaagacagcaagcgggacactgcagtggcaatagtgttaaaaaatctcattctcatgatttttggctctagctaggaatagtttagtcaggactcagaaaatttgagcttagttctgggattatgaaaacatggggacaaaaacaataacttgtggatgtctggttcctgctgtctgcagccaggtatctcaggttgcaatggtcagaagtcccagtgagggagctagaaacagagctatctgttcctcatagtgccagtgtgtttacatttataggaccacatatccctggtttctgggggagggtttcactgttacatcaccaagaggccctgaaaagaggaaaaaaaaaaaaaaagaggccaggcatggtggctcacgcctgtaatctcagcactttgggaggctgaggcgggcggatcacaaggtccagagttcaagagcagcctggccaacatggtgaaaccccgtctctactaaagatacaaaaaattagccgggcgtggtggtgcatgcctgtaatccaagatactcaggaggctgaggcaggagaatcgcttgaacctgggaggcggaggttgcagtgagccgagatcatgccattgcactccagcctgggcgacagagtgagactctgtctcaaaaaaaaaaaaaaaatagaatgtgtatgcatatatttgtgtgtatatgtatatatgtgtgtgtgtctatatctctatctatatagacatacacacaggagttattggatttagagttactgctaaccccagaacagaatctgttcttttacctttgagtcttttcttttgtttacctcttttcatctcaaagtgggaaagctccagataacatggtacttaggagtgagtgtctaagcaaaaccaacccaatgcgaagtatttgggtgagaactgagaggtgggagatgattggaggccatggcctatgtacaaacatactggaagaaaaccagcttgtttttaaaacttaacacaatcagaaatttttctttttgtgtttgaatctaacacactgacgtttggaaaacttgatcaatgagcttttaaccacgatttctcccgcaatttgttccttctttttacctttttaaaaatctgttagaagaaaaaaagcagcagacgaaagagaaaaaccctcctctggtagttctgtgtgtgcccctcacccctgtgtgctagtgtctgggaagtttccctgaaaggtgggaggcgggtgggtggtcttttggagggttcctcatgaagtgtgcttgaggaaagaaattctgattctaggcagaggaaggggaacaatttaaatattggtgcatctcagatgcacttgacttcaagccttcctcaaccaaactggtccattagattccgaaaaacaggtagacgaggaagtagacagtggaagtgagtagtctccctccatctgcctaatccccaataactgtggtctggcccctgtgttcagcccgagagtttgtaaaacaggtccccaggtaggtgtataagatgagttgcaaattagccgggcatgctggcacgcaccagtaatcccagctacttgggaggctgaggcaggagaatcacttgaacccgggaggcagaggtcatggtgagccgagatcacgccactgcactccagcctgggcaacagagcgagactctatctcaaaaaaaaacaaaaaaaaaaacaaaaaacaaagatgagtcgcacatctgctgctgggattttctagggttgtctatgacagaatgaccatcttttaaatattaatggagtataaatggagtctataatgggtctttcatataacttttaactctttggctatcctgggctctgatcatgatatgtttgagcatagtagctccctaaactcttggagcctttcagaaattccatgtagtgctaataacctttttacttgcaaatgataaagtaactgactcagtgtctttgggctctgcaggctttagccttgttttggtaggatgttcagtatattctcagaatttttaccacctatttagctatacttcaagtactctattctctgcactaacttactgtccttctgggaactatgatggggcttcaagggagtcaggtgtcaagaaaggaggggtaagtactctctacttgctggaaaatcattgtaagtctgttgtgtatgaaattttaggaaaagtcttatatagttccctttccagactgttttcttttgactctaactataatcataagtctgtgcttccattatgaaggtcacattcctagcattcttgggaagtattagctcatactctcattcacatatgggaggttagatttttttcctctacccagagtccctttttagtttaccccacggcttagtttgctgtcagataccagttctctagcagattccccaacagttttttccccagtggggagggtggaagggagggactgatataagtaaggagatgagtagttgtgttacagttcattttctttaaaaaaaagtattttgagaaaaggtgcaaaatattcttgaaagtctctaggccagccaaagtccacatatggatatttggggatgttatttaaatactcagcaggctgagtgcaggtatacgtgtgtatagagtgtgtatactttgcttttgttttataacattgtcagctaattttggctttgttctttggcatccattcttattataagtgatggaatgccatgaaatgtactgtattgtatattacttgggaggacactaggttttcaaagaagtctggcagcacttgggttatagagggctcagcatgaccaaagtcctaaagattttacctcccagctttggttgtatgtgttcccaagtggtgaggtgagattgtggctggaggaagaaaaaggatggcatgaaagaatgacccttattgtggtctgtccttctaatcaacataattagggcagcttaccccaacatgaaaatgatgacctggccatttttaatggccagagcttgaagtctggtctctcattttgtttcagaaatgagtgagaggccttcctgcagagcagtcaggagaaatggtggagcctggggccctggaatggctgaccctgtgcctagagagctgatggcaagggctgtctggcatggctcatttgggtggggtttccccaggcataccttagttccctgatcctctgcaaagagtagctcattgactgagcaagcgcttcaggaggactgtgctggttgttcccagaccaaagagagtcacttttgactccatcaacttcaaggggacagagcctaggcagcagattctcctaatttttaacactaaaattcaaggaagcagtggaggaaagaatgcattactaccacagatagaaataggggactcatagaactctcgactagtacctgtcagctctcaaatgcattcttgtgtctttgcttgagctgccaaagaagggtcacaaagtgttcttcctcatggaagaagtgcctcggggttgcagggctgcaaagtgacaactgcactgaatgacactttattttttggctttggcttattatttagcactgggaggcccaggggaattggtgattacagtagcactttgggaagttaaagccccctttgggcttgctttggagagatgatggcatgcttggtattccatttggataatcaggaagcctccctagtccatccatattgtgtcagagtgggattaacaaccctggaagagtccactgccaaaagagtagttgctttcctggaatttccaaagcttttggattttctggatcaagtaacccactttttaaaacctgaggtcaggagttcgagaccagcctggtaacatggtgaaaccccgtctctattaaaaatagaaaaaattagccaggcatggtggcgggcacctatagtcccagctactcaggaggctgaggtaggagaattgcttgaacccaggagacagaggctgcattgagccaagatcacaccactgcactccagcctgggcagcagagcaagactccatctcaaaaaaaaaaaaaagaaaaagaaaaagaaggttaatccttcagttatggaggtgggatgaatagagcttgtttgatgttaaagtgggtaaggagggagtggccttgagacacttgtattccaaactctcctggaggtttccagtagcactactgttcctaaaagggtttcatttttaacttcatctgttttgttaacatccagtccaattgaggtgatctcagaggtgcatcaggacatctagcactggggaggccaccttgcccagatagttgaaaagaaaattggtctgggcagcctgttgtcttttgtcttcatgtaatgttttttctttgttttaaaggactaatgtttattacagtgttaaataaaagtgtaagatactaagtgtgtagaataaaagtgcaataacaaaagacaatgactttggcacacacttcagtctttatcctctctcctttcttgtgctacctggctctttccataatattgttacagcaggaccgtcttaattgtgtgcattttgaagagatgcgactctgggttaatcttcattagtgtaatattgaagggttgggtttggttttatagagtattctgtatacttgttgggatacacaaataccagatgtgctgtataataaagatcacattaacgttt

SEQ ID NO: 8870 - DNA, 7874 bp, Homo sapiens
ccgagccgcaaagacagagcgggcagaggcgatggagggcgacggggtgccatggggcagcgagcccgtctcgggtcccggccccggcggcggcggaatgatccgcgagctgtgccggggcttcggccgctaccgccgctacctgggacggctgcgacagaacctgcgcgagacccagaagttcttccgcgacatcaagtgctcccacaaccacacttgtctctcctccctcacgggcggcggcggggccgagcgcggccctgcaggcgatgtcgccgaaaccgggctgcaggcgggccaactgagctgcatttccttcccacctaaggaagagaagtacctccagcagattgtggactgcctcccttgcatactgatcctcggccaggattgtaacgtcaagtgccagctgttgaatctgctgttgggggtgcaggtgcttcccaccaccaagctgggcagtgaggagagctgtaagcttcggcgcctccgcttcacctatgggactcagactcgggtcagcctggcgctccctggacagtatgaactagtgcacacgctggttgctcatcagggcaactgggagaccatccctgaggaggatctggaggtccaagagaacaatgaggatgctgctcatgttttagcggaactggaggtaacgatgcaccatgctctcttacaggaagtggacgttgtggtagcaccatgccaaggcctccggcccacagtggatgttctgggtgacttggtgaatgatttcttgcctgtgataacctatgcactccacaaagatgaactctctgagagggatgagcaagagcttcaggaaatccgaaagtatttctcctttcctgtattctttttcaaagtgccgaaactgggctcggagataatagactcctcaaccaggagaatggagagcgaaagatcaccgctttatcgccagctaattgacctgggctatctgagcagcagtcactggaactgtggggctcctggccaggatactaaagctcagagcatgttggtggaacagagtgaaaagctgagacacttgagcacattttctcaccaggtgttacagactcgcctggtggatgcagccaaggccctgaacctggtgcactgccactgccttgacatctttattaaccaggcatttgacatgcagcgggacctgcagatcactcccaaacgtctggaatatactcgaaaaaaggagaatgagttgtatgaatcattgatgaatattgccaaccgaaagcaggaggaaatgaaggatatgattgttgagacacttaataccatgaaggaggaacttctggatgatgctactaacatggagtttaaagacgtcattgtccctgagaatggagaaccagtaggcaccagagagatcaaatgctgcatccgacagatccaggaactcatcatctcccgacttaatcaggcagtggctaataagctgatcagctcagtggattacctgagggaaagcttcgtcggaaccctggaacgatgtctgcagagcctggagaagtctcaggatgtctcagttcacatcaccagtaattatctcaaacagatcttaaatgctgcctatcatgttgaagtcacgtttcactcagggtcgtcagttacaaggatgctatgggagcaaatcaaacagatcatccagcgcatcacatgggtgagcccacctgccatcactctggaatggaagaggaaggtggcccaggaagccattgagagcctcagcgcctccaaattggctaagagcatttgcagccaattccggactcggctcaatagttcccacgaggcttttgcagcctccttgcggcagctggaagctggccactcaggccggttagagaaaacggaagatctatggctgagggttcggaaagatcatgctccccgcctggcccgcctttctctggaaagctgttctttacaggatgtcttgcttcatcgtaaacctaaactgggacaggaactgggccggggccagtatggtgtggtatacctgtgtgacaactggggaggacacttcccttgtgccctcaaatcagttgtccctccagatgagaagcactggaatgatctggctttggaatttcactatatgaggtctctgccgaagcatgagcgattggtggatctccatggttcagtcattgactacaactatggtggtggctccagcattgctgtgctcctcattatggagcggctacaccgggatctctacacagggctgaaggctgggctgaccctggagacacgtttgcagatagcactagatgtggtggagggaatccgcttcctgcacagccagggacttgtccatcgtgatatcaaactgaaaaatgtgctgctggataagcagaaccgtgccaagatcactgacttaggattctgcaagccagaggccatgatgtcaggcagcattgtggggacaccaatccatatggcccctgaacttttcacagggaagtacgataattccgtggatgtctacgcttttggaattcttttctggtatatctgctcaggctctgtcaagctccctgaggcatttgagaggtgtgctagcaaagaccatctctggaacaatgtgcggaggggggctcgcccagaacgtcttcctgtgtttgatgaggagtgctggcagttgatggaagcctgttgggatggcgaccccttgaagaggcctctcttgggcattgtccagcccatgctccagggcatcatgaatcggctctgcaagtccaattctgagcagccaaacagaggactagatgattctacttgaaagcaaagacctttctctttcactctctagttatttccttccccctcaccttttggccatggggagaatttgacatttattcactataggacacactcccaagggaactggtgcttgctgggaaacttggaaccttcccaggcagggatgactcctggacagtgaagagttgaatgactgagcatattcagcagctcactgaagcgccaagctatccctttagcaaaaaagtgtctcagatgtgtaaaagctgaggaatgtggtgttctggcttcacaaatgaaaaggaggcagatgttaccattgtcttttcactgtatatacttctaagacagcaagcgggacactgcagtggcaatagtgttaaaaaatctcattctcatgatttttggctctagctaggaatagtttagtcaggactcagaaaatttgagcttagttctgggattatgaaaacatggggacaaaaacaataacttgtggatgtctggttcctgctgtctgcagccaggtatctcaggttgcaatggtcagaagtcccagtgagggagctagaaacagagctatctgttcctcatagtgccagtgtgtttacatttataggaccacatatccctggtttctgggggagggtttcactgttacatcaccaagaggccctgaaaagaggaaaaaaaaaaaaaaagaggccaggcatggtggctcacgcctgtaatctcagcactttgggaggctgaggcgggcggatcacaaggtccagagttcaagagcagcctggccaacatggtgaaaccccgtctctactaaagatacaaaaaattagccgggcgtggtggtgcatgcctgtaatccaagatactcaggaggctgaggcaggagaatcgcttgaacctgggaggcggaggttgcagtgagccgagatcatgccattgcactccagcctgggcgacagagtgagactctgtctcaaaaaaaaaaaaaaaatagaatgtgtatgcatatatttgtgtgtatatgtatatatgtgtgtgtgtctatatctctatctatatagacatacacacaggagttattggatttagagttactgctaaccccagaacagaatctgttcttttacctttgagtcttttcttttgtttacctcttttcatctcaaagtgggaaagctccagataacatggtacttaggagtgagtgtctaagcaaaaccaacccaatgcgaagtatttgggtgagaactgagaggtgggagatgattggaggccatggcctatgtacaaacatactggaagaaaaccagcttgtttttaaaacttaacacaatcagaaatttttctttttgtgtttgaatctaacacactgacgtttggaaaacttgatcaatgagcttttaaccacgatttctcccgcaatttgttccttctttttacctttttaaaaatctgttagaagaaaaaaagcagcagacgaaagagaaaaaccctcctctggtagttctgtgtgtgcccctcacccctgtgtgctagtgtctgggaagtttccctgaaaggtgggaggcgggtgggtggtcttttggagggttcctcatgaagtgtgcttgaggaaagaaattctgattctaggcagaggaaggggaacaatttaaatattggtgcatctcagatgcacttgacttcaagccttcctcaaccaaactggtccattagattccgaaaaacaggtagacgaggaagtagacagtggaagtgagtagtctccctccatctgcctaatccccaataactgtggtctggcccctgtgttcagcccgagagtttgtaaaacaggtccccaggtaggtgtataagatgagttgcaaattagccgggcatgctggcacgcaccagtaatcccagctacttgggaggctgaggcaggagaatcacttgaacccgggaggcagaggtcatggtgagccgagatcacgccactgcactccagcctgggcaacagagcgagactctatctcaaaaaaaaacaaaaaaaaaaacaaaaaacaaagatgagtcgcacatctgctgctgggattttctagggttgtctatgacagaatgaccatcttttaaatattaatggagtataaatggagtctataatgggtctttcatataacttttaactctttggctatcctgggctctgatcatgatatgtttgagcatagtagctccctaaactcttggagcctttcagaaattccatgtagtgctaataacctttttacttgcaaatgataaagtaactgactcagtgtctttgggctctgcaggctttagccttgttttggtaggatgttcagtatattctcagaatttttaccacctatttagctatacttcaagtactctattctctgcactaacttactgtccttctgggaactatgatggggcttcaagggagtcaggtgtcaagaaaggaggggtaagtactctctacttgctggaaaatcattgtaagtctgttgtgtatgaaattttaggaaaagtcttatatagttccctttccagactgttttcttttgactctaactataatcataagtctgtgcttccattatgaaggtcacattcctagcattcttgggaagtattagctcatactctcattcacatatgggaggttagatttttttcctctacccagagtccctttttagtttaccccacggcttagtttgctgtcagataccagttctctagcagattccccaacagttttttccccagtggggagggtggaagggagggactgatataagtaaggagatgagtagttgtgttacagttcattttctttaaaaaaaagtattttgagaaaaggtgcaaaatattcttgaaagtctctaggccagccaaagtccacatatggatatttggggatgttatttaaatactcagcaggctgagtgcaggtatacgtgtgtatagagtgtgtatactttgcttttgttttataacattgtcagctaattttggctttgttctttggcatccattcttattataagtgatggaatgccatgaaatgtactgtattgtatattacttgggaggacactaggttttcaaagaagtctggcagcacttgggttatagagggctcagcatgaccaaagtcctaaagattttacctcccagctttggttgtatgtgttcccaagtggtgaggtgagattgtggctggaggaagaaaaaggatggcatgaaagaatgacccttattgtggtctgtccttctaatcaacataattagggcagcttaccccaacatgaaaatgatgacctggccatttttaatggccagagcttgaagtctggtctctcattttgtttcagaaatgagtgagaggccttcctgcagagcagtcaggagaaatggtggagcctggggccctggaatggctgaccctgtgcctagagagctgatggcaagggctgtctggcatggctcatttgggtggggtttccccaggcataccttagttccctgatcctctgcaaagagtagctcattgactgagcaagcgcttcaggaggactgtgctggttgttcccagaccaaagagagtcacttttgactccatcaacttcaaggggacagagcctaggcagcagattctcctaatttttaacactaaaattcaaggaagcagtggaggaaagaatgcattactaccacagatagaaataggggactcatagaactctcgactagtacctgtcagctctcaaatgcattcttgtgtctttgcttgagctgccaaagaagggtcacaaagtgttcttcctcatggaagaagtgcctcggggttgcagggctgcaaagtgacaactgcactgaatgacactttattttttggctttggcttattatttagcactgggaggcccaggggaattggtgattacagtagcactttgggaagttaaagccccctttgggcttgctttggagagatgatggcatgcttggtattccatttggataatcaggaagcctccctagtccatccatattgtgtcagagtgggattaacaaccctggaagagtccactgccaaaagagtagttgctttcctggaatttccaaagcttttggattttctggatcaagtaacccactttttaaaacctgaggtcaggagttcgagaccagcctggtaacatggtgaaaccccgtctctattaaaaatagaaaaaattagccaggcatggtggcgggcacctatagtcccagctactcaggaggctgaggtaggagaattgcttgaacccaggagacagaggctgcattgagccaagatcacaccactgcactccagcctgggcagcagagcaagactccatctcaaaaaaaaaaaaaagaaaaagaaaaagaaggttaatccttcagttatggaggtgggatgaatagagcttgtttgatgttaaagtgggtaaggagggagtggccttgagacacttgtattccaaactctcctggaggtttccagtagcactactgttcctaaaagggtttcatttttaacttcatctgttttgttaacatccagtccaattgaggtgatctcagaggtgcatcaggacatctagcactggggaggccaccttgcccagatagttgaaaagaaaattggtctgggcagcctgttgtcttttgtcttcatgtaatgttttttctttgttttaaaggactaatgtttattacagtgttaaataaaagtgtaagatactaagtgtgtagaataaaagtgcaataacaaaagacaatgactttggcacacacttcagtctttatcctctctcctttcttgtgctacctggctctttccataatattgttacagcaggaccgtcttaattgtgtgcattttgaagagatgcgactctgggttaatcttcattagtgtaatattgaagggttgggtttggttttatagagtattctgtatacttgttgggatacacaaataccagatgtgctgtataataaagatcacattaacgttt

SEQ ID NO: 8871 - DNA, 2019 bp, Homo sapiens
gcgaaggacatttgggctgtgtgtgcgacgcgggtcggaggggcagtcgggggaaccgcgaagaagccgaggagcccggagccccgcgtgacgctcctctctcagtccaaaagcggcttttggttcggcgcagagagacccgggggtctagcttttcctcgaaaagcgccgccctgcccttggccccgagaacagacaaagagcaccgcagggccgatcacgctgggggcgctgaggccggccatggtcatggaagtgggcaccctggacgctggaggcctgcgggcgctgctgggggagcgagcggcgcaatgcctgctgctggactgccgctccttcttcgctttcaacgccggccacatcgccggctctgtcaacgtgcgcttcagcaccatcgtgcggcgccgggccaagggcgccatgggcctggagcacatcgtgcccaacgccgagctccgcggccgcctgctggccggcgcctaccacgccgtggtgttgctggacgagcgcagcgccgccctggacggcgccaagcgcgacggcaccctggccctggcggccggcgcgctctgccgcgaggcgcgcgccgcgcaagtcttcttcctcaaaggaggatacgaagcgttttcggcttcctgcccggagctgtgcagcaaacagtcgacccccatggggctcagccttcccctgagtactagcgtccctgacagcgcggaatctgggtgcagttcctgcagtaccccactctacgatcagggtggcccggtggaaatcctgccctttctgtacctgggcagtgcgtatcacgcttcccgcaaggacatgctggatgccttgggcatcactgccttgatcaacgtctcagccaattgtcccaaccattttgagggtcactaccagtacaagagcatccctgtggaggacaaccacaaggcagacatcagctcctggttcaacgaggccattgacttcatagactccatcaagaatgctggaggaagggtgtttgtccactgccaggcaggcatttcccggtcagccaccatctgccttgcttaccttatgaggactaatcgagtcaagctggacgaggcctttgagtttgtgaagcagaggcgaagcatcatctctcccaacttcagcttcatgggccagctgctgcagtttgagtcccaggtgctggctccgcactgttcggcagaggctgggagccccgccatggctgtgctcgaccgaggcacctccaccaccaccgtgttcaacttccccgtctccatccctgtccactccacgaacagtgcgctgagctaccttcagagccccattacgacctctcccagctgctgaaaggccacgggaggtgaggctcttcacatcccattgggactccatgctccttgagaggagaaatgcaataactctgggaggggctcgagagggctggtccttatttatttaacttcacccgagttcctctgggtttctaagcagttatggtgatgacttagcgtcaagacatttgctgaactcagcacattcgggaccaatatatagtgggtacatcaagtccatctgacaaaatggggcagaagagaaaggactcagtgtgtgatccggtttctttttgctcgcccctgttttttgtagaatctcttcatgcttgacatacctaccagtattattcccgacgacacatatacatatgagaatataccttatttatttttgtgtaggtgtctgccttcacaaatgtcattgtctactcctagaagaaccaaatacctcaatttttgtttttgagtactgtactatcctgtaaatatatcttaagcaggtttgttttcagcactgatggaaaataccagtgttgggtttttttttagttgccaacagttgtatgtttgctgattatttatgacctgaaataatatatttcttcttctaagaagacattttgttacataaggatgacttttttatacaatggaataaattatggcatttctattgaaatttcaa

SEQ ID NO: 8872 - DNA, 1394 bp, Homo sapiens
gcgaaggacatttgggctgtgtgtgcgacgcgggtcggaggggcagtcgggggaaccgcgaagaagccgaggagcccggagccccgcgtgacgctcctctctcagtccaaaagcggcttttggttcggcgcagagagacccgggggtctagcttttcctcgaaaagcgccgccctgcccttggccccgagaacagacaaagagcaccgcagggccgatcacgctgggggcgctgaggccggccatggtcatggaagtgggcaccctggacgctggaggcctgcgggcgctgctgggggagcgagcggcgcaatgcctgctgctggactgccgctccttcttcgctttcaacgccggccacatcgccggctctgtcaacgtgcgcttcagcgccgcgcaagtcttcttcctcaaaggaggatacgaagcgttttcggcttcctgcccggagctgtgcagcaaacagtcgacccccatggggctcagccttcccctgagtactagcgtccctgacagcgcggaatctgggtgcagttcctgcagtaccccactctacgatcagggtggcccggtggaaatcctgccctttctgtacctgggcagtgcgtatcacgcttcccgcaaggacatgctggatgccttgggcatcactgccttgatcaacgtctcagccaattgtcccaaccattttgagggtcactaccagtacaagagcatccctgtggaggacaaccacaaggcagacatcagctcctggttcaacgaggccattgacttcatagactccatcaagaatgctggaggaagggtgtttgtccactgccaggcaggcatttcccggtcagccaccatctgccttgcttaccttatgaggactaatcgagtcaagctggacgaggcctttgagtttgtgaagcagaggcgaagcatcatctctcccaacttcagcttcatgggccagctgctgcagtttgagtcccaggtgctggctccgcactgttcggcagaggctgggagccccgccatggctgtgctcgaccgaggcacctccaccaccaccgtgttcaacttccccgtctccatccctgtccactccacgaacagtgcgctgagctaccttcagagccccattacgacctctcccagctgctgaaaggccacgggaggtgaggctcttcacatcccattgggactccatgctccttgagaggagaaatgcaataactctgggaggggctcgagagggctggtccttatttatttaacttcacccgagttcctctgggtttctaagcagttatggtgatgacttagcgtcaagacatttgctgaactcagcacattcgggaccaatatatagtgggtacatcaagtccatctgacaaaatggggcag

SEQ ID NO: 8873 - DNA, 1854 bp, Homo sapiens
gcgaaggacatttgggctgtgtgtgcgacgcgggtcggaggggcagtcgggggaaccgcgaagaagccgaggagcccggagccccgcgtgacgctcctctctcagtccaaaagcggcttttggttcggcgcagagagacccgggggtctagcttttcctcgaaaagcgccgccctgcccttggccccgagaacagacaaagagcaccgcagggccgatcacgctgggggcgctgaggccggccatggtcatggaagtgggcaccctggacgctggaggcctgcgggcgctgctgggggagcgagcggcgcaatgcctgctgctggactgccgctccttcttcgctttcaacgccggccacatcgccggctctgtcaacgtgcgcttcagcaccatcgtgcggcgccgggccaagggcgccatgggcctggagcacatcgtgcccaacgccaagcgcgacggcaccctggccctggcggccggcgcgctctgccgcgaggcgcgcgccgcgcaagtcttcttcctcaaaggaggatacgaagcgttttcggcttcctgcccggagctgtgcagcaaacagtcgacccccatggggctcagccttcccctgagtactagcgtccctgacagcgcggaatctgggtgcagttcctgcagtaccccactctacgatcagggtggcccggtggaaatcctgccctttctgtacctgggcagtgcgtatcacgcttcccgcaaggacatgctggatgccttgggcatcactgccttgatcaacgtctcagccaattgtcccaaccattttgagggtcactaccagtacaagagcatccctgtggaggacaaccacaaggcagacatcagctcctggttcaacgaggccattgacttcatagactccatcaagaatgctggaggaagggtgtttgtccactgccaggcaggcatttcccggtcagccaccatctgccttgcttaccttatgaggactaatcgagtcaagctggacgaggcctttgagtttgtgaagcagaggcgaagcatcatctctcccaacttcagcttcatgggccagctgctgcagtttgagtcccaggtgctggctccgcactgttcggcagaggctgggagccccgccatggctgtgctcgaccgaggcacctccaccaccaccgtgttcaacttccccgtctccatccctgtccactccacgaacagtgcgctgagctaccttcagagccccattacgacctctcccagctgctgaaaggccacgggaggtgaggctcttcacatcccattgggactccatgctccttgagaggagaaatgcaataactctgggaggggctcgagagggctggtccttatttatttaacttcacccgagttcctctgggtttctaagcagttatggtgatgacttagcgtcaagacatttgctgaactcagcacattcgggaccaatatatagtgggtacatcaagtccatctgacaaaatggggcagaagagaaaggactcagtgtgtgatccggtttctttttgctcgcccctgttttttgtagaatctcttcatgcttgacatacctaccagtattattcccgacgacacatatacatatgagaatataccttatttatttttgtgtaggtgtctgccttcacaaatgtcattgtctactcctagaagaaccaaatacctcaatttttgtttttgagtactgtactatcctgtaaatatatcttaagcaggtttgttttcagcactgatggaaaataccagtgttgggtttttttttagttgccaacagttgtatgtttgctgattatttatgacctgaaataatatattt

SEQ ID NO: 8874 - DNA, 1653 bp, Homo sapiens
agtaagccagcgtggctacgccatcacgaccggcggtggcacatgcgcaatagcgagacgctggagcgcggcgtaggtggctgccgagtcttttcctgtttagggtcttatcctggcattgagggcgccggactggcgcttttggccgacttggcattgggtgggcggcttcttgggacccacatgagccagtggcatcatccccgcagtggctggggccggagacgcgacttttcaggacgctcctcagccaagaagaagggcggaaaccacatccccgaaaggtggaaagactatctcccagttggacagcggatgcctgggactcgtttcattgctttcaaagttcctttgcaaaagagttttgaaaagaaacttgctccagaagaatgcttttcccctttggatctttttaacaaaatccgagaacaaaatgaagaacttggactgattattgatttaacatatactcaacgctattataaaccagaggatttgccagaaactgttccttacttaaaaatttttacagttggacatcaagtgcctgatgatgagactatttttaaattcaaacacgctgttaatgggtttttgaaagaaaataaagataatgataaacttattggtgtccactgtacccatggtttaaacaggactggctacctcatttgcagatatttgattgatgtagaaggcgtgaggccagatgatgcaattgaattattcaataggtgccggggacattgcttagaaagacaaaactacattgaagaccttcagaatggtcctatcagaaagaattggaattccagtgtacccaggtcaagtgattttgaagactcagcacatctcatgcaaccagtccacaataagcctgttaaacaaggacctaggtataatctacatcagatccagggtcactcagctcctcgacatttccacacccagacccaaagtttgcaacaatcagtcagaaaattttcagagaatccacatgtttaccagagacaccatctccctcctcctggtccccctggagaggactattcacacaggaggtattcttggaatgtgaagcccaatgccagtcgggcagcccaggatagaagaaggtggtatccttataattactccagactctcctatccagcctgttgggaatggacccagtgatacaaacctgtcctggaattctacctggagaccagagctggcctgaaaattactggtgtgacttttaattagttcaggtctaatcaggtttctttattgttcccttatgtattcaagcttaaggaaaaattgcattgctgtttacctctttgctgataaatttgcagtaattacagcattgcaggaaaaacaatctgttattccagtcttaaatttttctaaaagaagacaatattttagaactgaagcattgagaacttcccttgcaaattatttttaaaattctatcttgtttttctatgtatttctttctgactagacttgtgatatgcgtgtgtttatgtacagaaatttttagtgtttttgttatgttctgttattgacccaaaggccatctttattttctataactgttcaaaatttatattaaaatctacttaggagataatttctttagaacctagttactacctgtaa

SEQ ID NO: 8875 - DNA, 802 bp, Homo sapiens
ggagcgcggcgtaggtggctgccgagtcttttcctgtttagggtcttatcctggcattgagggcgccggactggcgcttttggccgacttggcattgggtgggcggcttcttgggacccacatgagccagtggcatcatccccgcagtggctggggccggagacgcgacttttcaggacgctcctcagccaagaagaagggcggaaaccacatccccgaaaggtggaaagactatctcccagttggacagcggatgcctgggactcgtttcattgctttcaaagttcctttgcaaaagagttttgaaaagaaacttgctccagaagaatgcttttcccctttggatctttttaacaaaatccgagaacaaaatgaagaacttggactgattattgatttaacatatactcaacgctattataaaccagaggatttgccagaaactgttccttacttaaaaatttttacagttggacatcaagtgcctgatgatgagactatttttaaattcaaacacgctgttaatgggtttttgaaagaaaataaagataatgataaacttattggtgtccactgtacccatggtttaaacaggactggctacctcatttgcagacggagtcttgctctgtcacccaggctggagtgcagtggcaccatctcgactcactccaagttctgcttcccaggttcacgccgttctcctgcctcagcctcccaagtagctgggactacaggtgcccgccaccacgcccggctaattttttgtatttttagtagagatgtggtttcaccgtgttag

SEQ ID NO: 8876 - DNA, 2175 bp, Homo sapiens
tggcacatgcgcaatagcgagacgctggagcgcggcgtaggtggctgccgagtcttttcctgtttagggtcttatcctggcattgagggcgccggactggcgcttttggccgacttggcattgggtgggcggcttcttgggacccacatgagccagtggcatcatccccgcagtggctggggccggagacgcgacttttcaggacgctcctcagccaagaagaagggcggaaaccacatccccgaaaggtggaaagactatctcccagttggacagcggatgcctgggactcgtttcattgctttcaaagttcctttgcaaaagagttttgaaaagaaacttgctccagaagaatgcttttcccctttggatctttttaacaaaatccgagaacaaaatgaagaacttggactgattattgatttaacatatactcaacgctattataaaccagaggatttgccagaaactgttccttacttaaaaatttttacagttggacatcaagtgcctgatgatgagactatttttaaattcaaacacgctgttaatgggtttttgaaagaaaataaagataatgataaacttattggtgtccactgtacccatggtttaaacaggactggctacctcatttgcagacggagtcttgctctgtcacccaggctggagtgcagtggcaccatctcgactcactccaagttctgcttcccaggttcacgccgttctcctgcctcagcctcccaagtagctgggactacaggtgcccgccaccacgcccggctaattttttgtatttttagtagagatgtggtttcaccgtgttagccaggatggtcttgatctcctgaccttgtgatccacccgcctcggcctcccaaagtgctggtattacaggagtgagccaccgcgcctggccagactccttattctttttaaggcctgcgttgttctttgcacaccgatgaacacaaaagtcagaagtttttgatattataaaacattgaagtagtgaacatttctatgtaaatatttttgaatgcatatctcatagccccggaggtaatttcactcaaaatagaatttcttaatcaaatagtatgtgtcgttatgctttttatggatgttgccacactgtactgagttatgtttgttcattcagaaaatatctcctgagcatctattatgtgtaagcagtgtgctgcgtgttagcaaagagactttagctgccctttgtgcgtcctaacagtctagggagggagtagatattaaagaatcacacaaatgcctatacaattacaattccaacaagtgctgagaaggggagtgacatggtacaatgagagcatagaatagggaggatttgacttcaacaagaggactagaggtttctgtggggaggtctgagcaaatatctgaagtataagtaggtgttaaccaggtagggatgttgtggagagaattctgaacgtaaggatcagcagagaccatattaacaggaaaatatatactgtgttggaggaactggctagggagactgggccatgggggtagtatggcgttaaaatggagctggaaatatgaataggagctgaaaccatgcagagctatgtttaaggttttagtcactaccttaagagcaatagaaaaccattgaattttttttgttggggatgagtgtggggaacacattcaaatttgtattttcaacctatcattttgctgctgagtggagaatacactgcagagggaaagaggtagaagcaaggagacaagttgggaggtgtttgtaggaactgaggcataatggtggattggaccagggcatggtggtcattttggtagaaagatacagatatactctatagagatatttaggtaatattgttgtcaggagttggtggtgaattgaatatgagagtttggaagaaatggctgacagtgatggtgactcccaagtttctggcccattctgttggttatacagtattttttagatataatgttaatatttttcccaatttgtcttttgttcattgttggtttctgataaatactctgtcatattaaggaagtctctatttttagtgtataaagcattttgataaaaaatgattctgcattttctttccttttgtttattaaattacattaatgtaaataaatatataaata

SEQ ID NO: 8877 - DNA, 1114 bp, Homo sapiens
agaggcagaggggtgggcgggctggcccatggctgagacctctctcccagagctggggggagaggacaaagccacgccttgccccagcatcctggagctggaggagctcctgcgggcagggaagtcttcttgcagccgtgtggacgaagtttggcccaaccttttcataggagatgcaaacagcatcaagtgtgcggagacaggcggctgaaagccagcagcacgaactgcccgtcagagaagtgcacagcctgggccagatactcccacaggatggactcactgcagaagcaggacctccggaggcccaagatccatggggcagtccaggcatctccctaccagccgcccacattggcttcgctgcagcgcttgctgtgggtccgtcaggctgccacactgaaccatatcgatgaggtctggcccagcctcttcctgggagatgcgtacgcagcccgggacaagagcaagctgatccagctgggaatcacccacgttgtgaatgccgctgcaggcaagttccaggtggacacaggtgccaaattctaccgtggaatgtccctggagtactatggcatcgaggcggacgacaaccccttcttcgacctcagtgtctactttctgcctgttgctcgatacatccgagctgccctcagtgttccccaaggccgcgtgctggtacactgtgccatgggggtaagccgctctgccacacttgtcctggccttcctcatgatctgtgagaacatgacgctggtagaggccatccagacggtgcaggcccaccgcaatatctgccctaactcaggcttcctccggcagctccaggttctggacaaccgactggggcgggagacggggcggttctgatctggcaggcagccaggatccctgacccttggcccaaccccaccagcctggccctgggaacagcaggctctgctgtttctagtgaccctgagatgtaaacagcaagtgggggctgaggcagaggcagggatagctgggtggtgacctcttagcgggtggatttccctgacccaattcagagattctttatgcaaaagtgagttcagtccatctctataataaaatattcatcgtcataaagaca

SEQ ID NO: 8878 - DNA, 747 bp, Homo sapiens
atggctgagacctctctcccagagctggggggagaggacaaagccacgccttgccccagcatcctggagctggaggagctcctgcgggcagggaagtcttcttgcagccgtgtggacgaagtttggcccaaccttttcataggagatgcgatggactcactgcagaagcaggacctccggaggcccaagatccatggggcagtccaggcatctccctaccagccgcccacattggcttcgctgcagcgcttgctgtgggtccgtcaggctgccacactgaaccatatcgatgaggtctggcccagcctcttcctgggagatgcgtacgcagcccgggacaagagcaagctgatccagctgggaatcacccacgttgtgaatgccgctgcaggcaagttccaggtggacacaggtgccaaattctaccgtggaatgtccctggagtactatggcatcgaggcggacgacaaccccttcttcgacctcagtgtctactttctgcctgttgctcgatacatccgagctgccctcagtgttccccaaggccgcgtgctggtacactgtgccatgggggtaagccgctctgccacacttgtcctggccttcctcatgatctgtgagaacatgacgctggtagaggccatccagacggtgcaggcccaccgcaatatctgccctaactcaggcttcctccggcagctccaggttctggacaaccgactggggcgggagacggggcggttctga

SEQ ID NO: 8879 - DNA, 1735 bp, Homo sapiens
agaggcagaggggtgggcgggctggcccatggctgagacctctctcccagagctggggggagaggacaaagccacgccttgccccagcatcctggagctggaggagctcctgcgggcagggaagtcttcttgcagccgtgtggacgaagtttggcccaaccttttcataggagatgcggccacggcaaacaaccgctttgagctgtggaagctgggcatcacccacgtgctgaacgccgcccacaagggcctctactgtcagggcggccctgacttctacggcagcagtgtgagctacctgggggtgccagcccacgacctccctgattttgacatcagtgcctacttctcctctgcggctgacttcatccaccgtgccctcaacacgcctggggccaaggtcctggtgcactgtgtggtgggcgtgagccgctctgccacgctggtcctggcctacctcatgctgcaccagcggctgtccctgcgccaggcggtgatcaccgtgaggcagcaccgatgggtcttccccaaccgaggcttcctgcaccagctctgcaggctggaccagcaactgcggggtgccggccagagctgaggggccagagctggtccttactccctgccatggggctctgccactttgccaccctggcactgatcctgctggtgctgctggaggctctggcccaggcggacacacagaagatggtggaagcccagcgtggggtcggccctagagcctgctactccatctggctcctcctggcgcctacaccccctctcagccactgtcttcagtctccacagaaacagcatcaagtgtgcggagacaggcggctgaaagccagcagcacgaactgcccgtcagagaagtgcacagcctgggccagatactcccacaggatggactcactgcagaagcaggacctccggaggcccaagatccatggggcagtccaggcatctccctaccagccgcccacattggcttcgctgcagcgcttgctgtgggtccgtcaggctgccacactgaaccatatcgatgaggtctggcccagcctcttcctgggagatgcgtacgcagcccgggacaagagcaagctgatccagctgggaatcacccacgttgtgaatgccgctgcaggcaagttccaggtggacacaggtgccaaattctaccgtggaatgtccctggagtactatggcatcgaggcggacgacaaccccttcttcgacctcagtgtctactttctgcctgttgctcgatacatccgagctgccctcagtgttccccaaggccgcgtgctggtacactgtgccatgggggtaagccgctctgccacacttgtcctggccttcctcatgatctgtgagaacatgacgctggtagaggccatccagacggtgcaggcccaccgcaatatctgccctaactcaggcttcctccggcagctccaggttctggacaaccgactggggcgggagacggggcggttctgatctggcaggcagccaggatccctgacccttggcccaaccccaccagcctggccctgggaacagcaggctctgctgtttctagtgaccctgagatgtaaacagcaagtgggggctgaggcagaggcagggatagctgggtggtgacctcttagcgggtggatttccctgacccaattcagagattctttatgcaaaagtgagttcagtccatctctataataaaatattcatcgtc

SEQ ID NO: 8880 - DNA, 1126 bp, Homo sapiens
acagaggcagaggggtgggcgggctggcccatggctgagacctctctcccagagctggggggagaggacaaagccacgccttgccccagcatcctggagctggaggagctcctgcgggcagggaagtcttcttgcagccgtgtggacgaagtttggcccaaccttttcataggagatgcagctggtccttactccctgccatggggctctgccactttgccaccctggcactgatcctgctggtgctgctggaggctctggcccaggcggacacacagaagatggtggaagcccagcgtggggtcggccctagagcctgctactccatctggctcctcctggcgcctacaccccctctcagccactgtcttcagtctccacagaaacagcatcaagtgtgcggagacaggcggctgaaagccagcagcacgaactgcccgtcagagaagtgcacagcctgggccagatactcccacaggatggactcactgcagaagcaggacctccggaggcccaagatccatggggcagtccaggcatctccctaccagccgcccacattggcttcgctgcagcgcttgctgtgggtccgtcaggctgccacactgaaccatatcgatgaggtctggcccagcctcttcctgggagatgcgtacgcagcccgggacaagagcaagctgatccagctgggaatcacccacgttgtgaatgccgctgcaggcaagttccaggtggacacaggtgccaaattctaccgtggaatgtccctggagtactatggcatcgaggcggacgacaaccccttcttcgacctcagtgtctactttctgcctgttgctcgatacatccgagctgccctcagtgttccccaaggccgcgtgctggtacactgtgccatgggggtaagccgctctgccacacttgtcctggccttcctcatgatctgtgagaacatgacgctggtagaggccatccagacggtgcaggcccaccgcaatatctgccctaactcaggcttcctccggcagctccaggttctggacaaccgactggggcgggagacggggcggttctgatctggcaggcagccaggatccctgacccttggcccaaccccaccagcctg

SEQ ID NO: 8881 - DNA, 908 bp, Homo sapiens
tgttccgctcaggcagagtcctgcccctgcacccactcccccattcccggccccaggccatgccccaggatggactcactgcagaagcaggacctccggaggcccaagatccatggggcagtccaggcatctccctaccagccgcccacattggcttcgctgcagcgcttgctgtgggtccgtcaggctgccacactgaaccatatcgatgaggtctggcccagcctcttcctgggagatgcgtacgcagcccgggacaagagcaagctgatccagctgggaatcacccacgttgtgaatgccgctgcaggcaagttccaggtggacacaggtgccaaattctaccgtggaatgtccctggagtactatggcatcgaggcggacgacaaccccttcttcgacctcagtgtctactttctgcctgttgctcgatacatccgagctgccctcagtgttccccaaggccgcgtgctggtacactgtgccatgggggtaagccgctctgccacacttgtcctggccttcctcatgatctgtgagaacatgacgctggtagaggccatccagacggtgcaggcccaccgcaatatctgccctaactcaggcttcctccggcagctccaggttctggacaaccgactggggcgggagacggggcggttctgatctggcaggcagccaggatccctgacccttggcccaaccccaccagcctggccctgggaacagcaggctctgctgtttctagtgaccctgagatgtaaacagcaagtgggggctgaggcagaggcagggatagctgggtggtgacctcttagcgggtggatttccctgacccaattcagagattctttatgcaaaagtgagttcagtccatctctataataaaatattcatcgtcataaaga

SEQ ID NO: 8882 - DNA, 1768 bp, Homo sapiens
actggagaggcagagaggagtgaccacagaggcagaggggtgggcgggctggcccatggctgagacctctctcccagagctggggggagaggacaaagccacgccttgccccagcatcctggagctggaggagctcctgcgggcagggaagtcttcttgcagccgtgtggacgaagtttggcccaaccttttcataggagatgcggccacggcaaacaaccgctttgagctgtggaagctgggcatcacccacgtgctgaacgccgcccacaagggcctctactgtcagggcggccctgacttctacggcagcagtgtgagctacctgggggtgccagcccacgacctccctgattttgacatcagtgcctacttctcctctgcggctgacttcatccaccgtgccctcaacacgcctggggccaaggtcctggtgcactgtgtggtgggcgtgagccgctctgccacgctggtcctggcctacctcatgctgcaccagcggctgtccctgcgccaggcggtgatcaccgtgaggcagcaccgatgggtcttccccaaccgaggcttcctgcaccagctctgcaggctggaccagcaactgcggggtgccggccagagctgaggggccagagctggtccttactccctgccatggggctctgccactttgccaccctggcactgatcctgctggtgctgctggaggctctggcccaggcggacacacagaagatggtggaagcccagcgtggggtcggccctagagcctgctactccatctggctcctcctggcgcctacaccccctctcagccactgtcttcagtctccacagaaacagcatcaagtgtgcggagacaggcggctgaaagccagcagcacgaactgcccgtcagagaagtgcacagcctgggccagatactcccacaggatggactcactgcagaagcaggacctccggaggcccaagatccatggggcagtccaggcatctccctaccagccgcccacattggcttcgctgcagcgcttgctgtgggtccgtcaggctgccacactgaaccatatcgatgaggtctggcccagcctcttcctgggagatgcgtacgcagcccgggacaagagcaagctgatccagctgggaatcacccacgttgtgaatgccgctgcaggcaagttccaggtggacacaggtgccaaattctaccgtggaatgtccctggagtactatggcatcgaggcggacgacaaccccttcttcgacctcagtgtctactttctgcctgttgctcgatacatccgagctgccctcagtgttccccaaggccgcgtgctggtacactgtgccatgggggtaagccgctctgccacacttgtcctggccttcctcatgatctgtgagaacatgacgctggtagaggccatccagacggtgcaggcccaccgcaatatctgccctaactcaggcttcctccggcagctccaggttctggacaaccgactggggcgggagacggggcggttctgatctggcaggcagccaggatccctgacccttggcccaaccccaccagcctggccctgggaacagcaggctctgctgtttctagtgaccctgagatgtaaacagcaagtgggggctgaggcagaggcagggatagctgggtggtgacctcttagcgggtggatttccctgacccaattcagagattctttatgcaaaagtgagttcagtccatctctataataaaatattcatcgtcataaag

SEQ ID NO: 8883 - DNA, 1559 bp, Homo sapiens
ctcatcttctgacgcttgggggaggagaggtagttgcttggtatttttggctttccaccataaaactggagacagtttccttcattccaagtcgttttaatgtcactgttgaacgtgtgtgtcctgagttctcatctgaaagctttcatatcggttgactgcagatttgatttgtatccactgtcaccagcactgctcacttaggactttctggatccggacccaggcagcgcacactggactcttgaggaagaaggagactctaattttggattccttggtggaggaaaataaaacactctggtcttgccgccaacgatgcaagtgtgactgctggcgtcttcatgagctccagaggtcacagcacgctaccaaggactctcatggcccctcggatgatttccgagggagacataggaggcattgctcaaatcacctcctctctattcctgggcagaggcagtgtggcctccaatcggcacctcctccaggctcgtggcatcacctgcattgttaatgctaccattgagatccctaatttcaactggccccaatttgagtatgttaaagtgcctctggctgacatgccgcatgcccccattggactgtactttgacaccgtggctgacaagatccacagtgtgagcaggaagcacggggccaccttggtgcactgtgctgcaggggtgagccgctcagccacgctgtgtatcgcgtacctgatgaaattccacaacgtgtgcctgctggaggcgtacaactgggtgaaagcccggcgacctgtcatcaggcccaacgtaggcttctggaggcaactgatagactacgagcgccagctctttgggaagtcgacagttaaaatggtacagacaccttatggcatagttcccgacgtctatgagaaggagtcccgacacctgatgccttactgggggatttagtgccactgaagcctgcgtcagcagcccgagcggggccggcatctgctccccgccgtctgctccctctccactctcttctcaaatggctgacttctggttctccctcaagtgttttttacactgggtgttcaaatttattttaagagatagggagggaggggacataaagggaatgcatacattgctagtcacatttttaaaattaacattttggaatagtgtttatggaaatctttagcttttaatcatttttaccaatttgaacagtttaataaactggttctgctctcttctgaatctcatgcctttggcaccttggtaggtgcaggaggagctcagtgcaaaaatcactttggggcctcattaaccctttagagacaagctttgccccaggctgcggaccagacagatgcttagggaaggttgataaccagcttcagtctctactggattagccctactctttcctttcccctccattatttagtgactctgtaagtaagttaaatacacccttattatttagctgttaagtaactataatgaaatctgctgcaaaatctctcttggaatccatgtgcccaggattatattagcattatttttaataaatctata

SEQ ID NO: 8884 - DNA, 1537 bp, Homo sapiens
cgcggcccgccccgggcgcgggcggagggaggaggaggcggcgcgcgcggcgcccagcccgcagaagccggtggccgcgcaggaggacggagccctaaccgcaacccgcgccgcgccgcgccgcgccgatttgatttgtatccactgtcaccagcactgctcacttaggactttctggatccggacccaggcagcgcacactggactcttgaggaagaaggagactctaattttggattccttggtggaggaaaataaaacactctggtcttgccgccaacgatgcaagtgtgactgctggcgtcttcatgagctccagaggtcacagcacgctaccaaggactctcatggcccctcggatgatttccgagggagacataggaggcattgctcaaatcacctcctctctattcctgggcagaggcagtgtggcctccaatcggcacctcctccaggctcgtggcatcacctgcattgttaatgctaccattgagatccctaatttcaactggccccaatttgagtatgttaaagtgcctctggctgacatgccgcatgcccccattggactgtactttgacaccgtggctgacaagatccacagtgtgagcaggaagcacggggccaccttggtgcactgtgctgcaggggtgagccgctcagccacgctgtgtatcgcgtacctgatgaaattccacaacgtgtgcctgctggaggcgtacaactgggtgaaagcccggcgacctgtcatcaggcccaacgtaggcttctggaggcaactgatagactacgagcgccagctctttgggaagtcgacagttaaaatggtacagacaccttatggcatagttcccgacgtctatgagaaggagtcccgacacctgatgccttactgggggatttagtgccactgaagcctgcgtcagcagcccgagcggggccggcatctgctccccgccgtctgctccctctccactctcttctcaaatggctgacttctggttctccctcaagtgttttttacactgggtgttcaaatttattttaagagatagggagggaggggacataaagggaatgcatacattgctagtcacatttttaaaattaacattttggaatagtgtttatggaaatctttagcttttaatcatttttaccaatttgaacagtttaataaactggttctgctctcttctgaatctcatgcctttggcaccttggtaggtgcaggaggagctcagtgcaaaaatcactttggggcctcattaaccctttagagacaagctttgccccaggctgcggaccagacagatgcttagggaaggttgataaccagcttcagtctctactggattagccctactctttcctttcccctccattatttagtgactctgtaagtaagttaaatacacccttattatttagctgttaagtaactataatgaaatctgctgcaaaatctctcttggaatccatgtgcccaggattatattagcattatttttaataaatctatatgcttaacatatta

SEQ ID NO: 8885 - DNA, 1688 bp, Homo sapiens
ggagtcgaccgctcgggcagcgccaccgccacgagagcccgggacgcgggaaagaccgaaaggaagaggaagaggcaccggtggccatggggctggaggcggcgcgcgagctggagtgcgcggcgctgggcacgctgctgcgggatccgcgggaggcggaacgcacgctgctgctggactgccgccccttcctggccttctgccggcgccacgtgcgcgccgcgcggccagtgccttggaacgcgctgctgcggcgccgcgcgcgcggccctcctgccgccgttctcgcctgcctgctgcccgaccgcgcgctgcggacgcgcctggtccgcggggagctggcgcgggccgtggtgctggacgagggcagtgcctcggtggcggagctccggcccgacagcccggctcatgtgctgctggccgcgctgctgcacgagacccgcgcggggcccactgccgtgtacttcctgcgaggaggcttcgacggcttccagggctgctgtcccgatctgtgctctgaggcccccgcccctgcgctgccgccaacaggggacaaaaccagccgctccgactccagggctcctgtctacgaccagggtggccctgtggagatcttgccctacctgttcctgggcagctgcagtcactcgtcagacctgcaggggctgcaggcctgtggcatcacagccgtcctcaacgtgtccgccagctgccccaaccactttgagggccttttccgctacaagagtatccctgtggaggacaaccagatggtggagatcagtgcctggttccaggaggccataggcttcattgactgggtgaagaacagcggaggccgggtgctggtgcactgccaggcgggtatctcgcgctctgccaccatctgtctggcatacctcatgcagagtcgccgtgtgcggctggacgaggcctttgacttcgttaagcagcgccggggggtcatctcccccaacttcagtttcatggggcagctgctgcagtttgagacccaggtgctgtgtcactgaggtggtgcccctctgcctgcctgccccactgtgctggcaggagctgactgtggactggtgggctcccctctgggccagcacagtcccctcacctctggcagggctgctacctcctcagagtttcagaagcccccacatgggggctctaggaatgccggcatgctggtctttccgacctggtgctcttctgctgggggactgaggctggccctcattcggggtcgggaaccaagggtgtgtctgctctttccctccccatcctctggcagaaatcagctagacgctataccgtggactctccctggtccaccaccatgttgaagcccttggcagcctgagagctccaaggaacaagctgtgacaaccaggagccctgtctgtgggttcgtctgcccagggcctggagcccaagccctgtgttcctggggaagctggggacttgggaagtgatgggtgtgtcatgttgcgtgtgtctgtctgtgagcctttcacacctgtgctggcgctggaaaattatttgtgctcagctgacatttaacactccctcccccgcttcctcctagccctgtgggcaggggttggaaacttagcactttatatttatacagaacattcaggatatgtcaataaaatattgttatatttaaaaaacaacaa

SEQ ID NO: 8886 - DNA, 4121 bp, Homo sapiens
gcgagcccccgcccagctgatccgccgctctccgcctcgcttgctcctgccgggcgtgcagggccccgccgccgccatgtcgggctcgttcgagctctcggtgcaggatctcaacgacctgctctcggacggcagcggctgctacagcctcccgagccagccctgcaacgaggtcaccccgcggatctacgtgggcaacgcgtctgtggctcaggacatccccaagctgcagaaactaggcatcacccatgtgctgaacgcggctgagggcaggtccttcatgcacgtcaacaccaatgccaacttctacaaggactccggcatcacatacctgggcatcaaggccaacgacacacaggagttcaacctcagcgcttactttgaaagggctgccgacttcattgaccaggctttggctcaaaagaatggccgggtgctcgtccactgccgggaaggttatagccgctccccaacgctagttatcgcctacctcatgatgcggcagaagatggacgtcaagtctgccctgagcatcgtgaggcagaaccgtgagatcggccccaacgatggcttcctggcccagctctgccagctcaatgacagactagccaaggaggggaagttgaaaccctagggcacccccaccacctctgctcgagaggtccgtgggggaggccgtgggcaaaggtgtcccgagctgccatgtttaggaaacacactgtaccctgctcccagcatcacaaggcacttgtctacaagtgtgtcccaacacagtcctgggccactttccccaccctggggagcacataaagaagcttgccaaggggggcgtccttgctccccagttgtcctgtttctgtaacttatgatgtcttttccctgagatgggggctcagagggggaaggcctgtggcctgcatgcttcccgatggcccacggcaggaggtgtgtggaagtgtaaggcctaagatgctcacagaggtccctcatgacctcccttccccaactcccgaatcctctcttgagtgtggacctcaacaccttgagccctagtaaaggaactatgcaaatgcaggccactctccccaccacgtctgtgccctgcactgtccccacagccttccacaccctgtgcataggcagccctctcacgtcttgaggtccgaagctggggtgggggtgtccgtcagttattagtggatggagattcccacagcaaggctgcatttgaatgatttccttaggatgaatggtccctacacaaagaggccttgtgggcaaacctggagaaccctcctaaatccatagagttttcaaaatgtgaatctttggaagccttgagttcagaatctgctgctctggaatatttcccttcgatcttatctcagtcacttcgtttttgagaagagtgatgccttgggcatgcttttttttttttcttttttagaaaacagggagttgaagtccaacctatttaaaaaccccaccatttggagaattacaagggttttgtcctgaattgtagtgttggcaagcccaagccactcgtgctaactgctttttgtctcggttgctattccaagaacagaaggaggaagttggccaattacagcgtgtgtgcatggatgtgtgtggggggcgtgcctctcagaaacgcggccagaagacaagcagggaagtgaaaggtcccaggcacacaccctgcccattgcaggtggctcttacagctctctggtgccagcacgggatccctgaagtgactcagccaggcagacatgagacatggcggagtgtccaaatggatcctttattggtggtagagcaaaaaaacccaaacacgataaacctttcaaaagactttctaaggatgatattggaatgcaccagccctcacatgtgtatgcacatttgccagaatataagagttttgttttaaatacagtcttgttaggattttacgttattgttattatggaaagtgattgtgatgctatttatcttcagggtcactctgggcaaagagaaggtcctcagccatgcccccagcaccttgcacataggtgtctgataaaagtttaagaaagtaaacactttttgagcaccaaatatatatagggcattgttctggtgggtgtgtcacgctcccagaagactgaattcatggtaggatcactcgcaaggccttgtgaaggagtcttacctaaaacgaaagaaatatcagggacttttgttgactatttacaactcagttttacatttaaattcaggcagtgttaatatgccaaggtagggaatgtgcctttttcagagttggccaggagctcctggctgggacacggagaggcaggtgtggcgtaaggcctcactcccggctgggaaggtctctgatcacacagaagcagccctgcccagcctggtcatttgctgtccgcttttctctgtgaccacagcagccctgaacaaccagtatgtgtcttcttctccagatagtgaaaaaggtgtccagataaacccacctaagtgaaatggccatcctctaaactgggtacctcactgcacagcttctaggtagccttccaacttaatctaacttgagcctcacagtaaccctgtaaagttagtagagcttgttcttgtattgtgaccttttttaaaaaaaaggaactgaggttcagaatgattaagggcctggcccccagggttgtccagctccataaggtggagctgggcaagattttgggtttgctgctccctgaagctggattctttcatacgatactctttctcaagaagggggctccctgggatctccaggtgtactgcacttaccctcaatccagccccggagaagcaagtgaaaagggtgggtccctcataggctagaatgtgcagctctttctccaggtgggatgtagcaccccgaagtagagctttctgctctgctcctggaaaaggctagggagctggggctggggctcccctcccatgaccaggcagtggtcaccccatgggacaggcacagctacttacgcgaacacagcaggttggtgtggctggctaactaggacctctcgaaagtctctgtgggggcatgagggagaaaaggccattgggagaattactgcctttactttgggactacttttatgctgataacttgggatttcttgatagtccttcacccctgaaaccccgtatttacttaacaagatttagctcttagttcttcaagtaaaattaaagtctcttgtgtaagagccaacacatgcccagctgcggatgggagctgttcctggacagccttctactgcctgggaagtgatggaacaggaactcagggtgcccttaccccctccccagacctgttccctttctttgactgacagagcaccatccaggcaaaattagagcgccaaatggttttcttctcaatcttaaagcagtatacctttccacaggctcgtctgtgtccctgccactctgagttatccagaaaccaccacctacaaatgaggggactcatctagaagacctctaaggtccccttttggctctgaggggtctctaataatccccacttggaattcagcaccgcaaggaaattatgggtatgtgagccataatatgatgggcagcaggtggcgctgccttccacccatggtgatggatggtttggaaagggaatgttggtgccttttgtgccacaagttaagatgctactgttttaaaggaaaaaaaaaaaaaaaagtactgatcttcaatatgaagacatgagcttttctcgcaggaaattttctttttcacagaactggtgtcaggaatcactgaagggctaaccgtgatagtccttgcaagtaagtcaaggttttatcctgattggaaatagaagacatttccggttgagagaacagattcgttggaagcttaacttttgttgcctcttaacgccaccaaattttagggtaatttgattatgaaagagtgaatttttctggacagaaaagggagagctaccaaattgtttttttctttttaaaaggaagtttaatgtccgttgtatcacaaatcagtgttaaaacaccagaactttagccaaaataaatgtcttacattacaaaggt

SEQ ID NO: 8887 - DNA, 2073 bp, Homo sapiens
ccccgccgccgccatgtcgggctcgttcgagctctcggtgcaggatctcaacgacctgctctcggacggcagcggctgctacagcctcccgagccagccctgcaacgaggtcaccccgcggatctacgtgggcaacgctaagaatgtctaatcagcaggaaagaaccagtgttaacattctgagatgtgaaataggagcctcaagaaagaatatattagcatgcctgtacagccttggaaagcctcaagttggattttcacgatactctgaggacccagttaccaaaatcctaagcttcatggctcagcccaaggatggcatgttgaaaactcaaaactaaccctcctcccattttacagaggaggaaatggtggctcagagtgtgtgagggactacaaggacagggtcaatgtcttgttcatgtctgtggctcaggacatccccaagctgcagaaactaggcatcacccatgtgctgaacgcggctgagggcaggtccttcatgcacgtcaacaccaatgccaacttctacaaggactccggcatcacatacctgggcatcaaggccaacgacacacaggagttcaacctcagcgcttactttgaaagggctgccgacttcattgaccaggctttggctcaaaagaatggccgggtgctcgtccactgccgggaaggttatagccgctccccaacgctagttatcgcctacctcatgatgcggcagaagatggacgtcaagtctgccctgagcatcgtgaggcagaaccgtgagatcggccccaacgatggcttcctggcccagctctgccagctcaatgacagactagccaaggaggggaagttgaaaccctagggcacccccaccacctctgctcgagaggtccgtgggggaggccgtgggcaaaggtgtcccgagctgccatgtttaggaaacacactgtaccctgctcccagcatcacaaggcacttgtctacaagtgtgtcccaacacagtcctgggccactttccccaccctggggagcacataaagaagcttgccaaggggggcgtccttgctccccagttgtcctgtttctgtaacttatgatgtcttttccctgagatgggggctcagagggggaaggcctgtggcctgcatgcttcccgatggcccacggcaggaggtgtgtggaagtgtaaggcctaagatgctcacagaggtccctcatgacctcccttccccaactcccgaatcctctcttgagtgtggacctcaacaccttgagccctagtaaaggaactatgcaaatgcaggccactctccccaccacgtctgtgccctgcactgtccccacagccttccacaccctgtgcataggcagccctctcacgtcttgaggtccgaagctggggtgggggtgtccgtcagttattagtggatggagattcccacagcaaggctgcatttgaatgatttccttaggatgaatggtccctacacaaagaggccttgtgggcaaacctggagaaccctcctaaatccatagagttttcaaaatgtgaatctttggaagccttgagttcagaatctgctgctctggaatatttcccttcgatcttatctcagtcacttcgtttttgagaagagtgatgccttgggcatgcttttttttttttcttttttagaaaacagggagttgaagtccaacctatttaaaaaccccaccatttggagaattacaagggttttgtcctgaattgtagtgttggcaagcccaagccactcgtgctaactgctttttgtctcggttgctattccaagaacagaaggaggaagttggccaattacagcgtgtgtgcatggatgtgtgtggggggcgtgcctctcagaaacgcggccagaagacaagcagggaagtgaaaggtcccaggcacacaccctgcccattgcaggtggctcttacagctctctggtgccagcacgggatccctgaagtgactcagccaggcagacatgagacatggcggagtgtccaaatggatcctttattggtggtagagcaaaaaaacccaaacacgataaacctttc

SEQ ID NO: 8888 - DNA, 5537 bp, Homo sapiens
gctgagcgccggaggagcgtaggcagggcagcgctggcgccagtggcgacaggagccgcgcgaccggcaaaaatacacgggaggccgtcgccgaaaagagtccgcggtcctctctcgtaaacacactctcctccaccggcgcctccccctccgctctgcgcgccgcccggctgggcgcccgaggccgctccgactgctatgtgaccgcgaggctgcgggaggaaggggacagggaagaagaggctctcccgcgggagcccttgaggaccaagtttgcggccacttctgcaggcgtcccttcttagctctcgcccgcccctttctgcagcctaggcggcccgggttctcttctcttcctcgcgcgcccagccgcctcggttcccggcgaccatggtgacgatggaggagctgcgggagatggactgcagtgtgctcaaaaggctgatgaaccgggacgagaatggcggcggcgcgggcggcagcggcagccacggcaccctggggctgccgagcggcggcaagtgcctgctgctggactgcagaccgttcctggcgcacagcgcgggctacatcctaggttcggtcaacgtgcgctgtaacaccatcgtgcggcggcgggctaagggctccgtgagcctggagcagatcctgcccgccgaggaggaggtacgcgcccgcttgcgctccggcctctactcggcggtcatcgtctacgacgagcgcagcccgcgcgccgagagcctccgcgaggacagcaccgtgtcgctggtggtgcaggcgctgcgccgcaacgccgagcgcaccgacatctgcctgctcaaaggcggctatgagaggttttcctccgagtacccagaattctgttctaaaaccaaggccctggcagccatcccacccccggttccccccagtgccacagagcccttggacctgggctgcagctcctgtgggaccccactacacgaccaggggggtcctgtggagatccttcccttcctctacctcggcagtgcctaccatgctgcccggagagacatgctggacgccctgggcatcacggctctgttgaatgtctcctcggactgcccaaaccactttgaaggacactatcagtacaagtgcatcccagtggaagataaccacaaggccgacatcagctcctggttcatggaagccatagagtacatcgatgccgtgaaggactgccgtgggcgcgtgctggtgcactgccaggcgggcatctcgcggtcggccaccatctgcctggcctacctgatgatgaagaaacgggtgaggctggaggaggccttcgagttcgttaagcagcgccgcagcatcatctcgcccaacttcagcttcatggggcagctgctgcagttcgagtcccaggtgctggccacgtcctgtgctgcggaggctgctagcccctcgggacccctgcgggagcggggcaagacccccgccacccccacctcgcagttcgtcttcagctttccggtctccgtgggcgtgcactcggcccccagcagcctgccctacctgcacagccccatcaccacctctcccagctgttagagccgccctgggggccccagaaccagagctggctcccagcaagggtaggacgggccgcatgcgggcagaaagttgggactgagcagctgggagcaggcgaccgagctccttccccatcatttctccttggccaacgacgaggccagccagaatggcaataaggactccgaatacataataaaagcaaacagaacactccaacttagagcaataacggctgccgcagcagccagggaagaccttggtttggtttatgtgtcagtttcacttttccgatagaaatttcttacctcatttttttaagcagtaaggcttgaagtgatgaaacccacagatcctagcaaatgtgcccaaccagctttactaaagggggaggaagggagggcaaagggatgagaagacaagtttcccagaagtgcctggttctgtgtacttgtccctttgttgtcgttgttgtagttaaaggaatttcattttttaaaagaaatcttcgaaggtgtggttttcatttctcagtcaccaacagatgaataattatgcttaataataaagtatttattaagactttcttcagagtatgaaagtacaaaaagtctagttacagtggatttagaatatatttatgttgatgtcaaacagctgagcaccgtagcatgcagatgtcaaggcagttaggaagtaaatggtgtcttgtagatatgtgcaaggtagcatgatgagcaacttgagtttgttgccactgagaagcaggcgggttgggtgggaggaggaagaaagggaagaattaggtttgaattgctttttaaaaaaaaaagaaaagaaaaagacagcatctcactatgttgccaaggctcatcttgagaagcaggcgggttgggtgggaggaggaagaaagggaagaattaggtttgaattgcttttttaaaaaaaaagaaaagaaaaaaaaagacagcatctcactatgttgccaaggctcatctcaagctcttgggctcaagagatcctcccacctcggcctcctgagtagctgggactgcaggtgtgtgtcatcatgaccaatgtgaattgcttttgaagctggttcatgggcatgtaggccaccgaagcaattttagaccacagtaagtcaagcttttttccctccgatgatcactgggtggttgcagcattttttgcataaacctgcctaagacttgtctatcgtctgtgatcaatatgccatattacactaaggtgctcctggaaaattgggtgcagttcaaattttcctacagcaaatcatttggcaaggccagccattggggaaaccagacaactagagataaccctgaaatgaatccttttgtaaattgaagcaccatcttttctttttttgcataaattggaggttttaattttagggcagttacctgaagtgaaatataccaacaatttcttgtgttctttaaattcctagttaggtgaatatttttgaaggtcctcttttgaataaagaggggaatggacaccacatttcaggtcttctcgaagtgtggaagggcaagagagcatcagtgagctgatggtggattgcttacatcggattccattggtatgaatttcccaaactggaaatcaaagcgccagggtggggttggggctgactgctggtgagggggctggccgctggctcccgtgacgtgcgtcatgggcacgcaggcgccattttgaatctatcgtcggcacgtgggtgccattttgaatccttagttgggcctttctaaatggagaatggctttggagggagacacgttttctgtggggagggtttgggggggagggaggagggaacaagctacatgctattttgtttgtagtattgtggaacagtcttgttatggagtgccagcttagaggttgttgcaaacttgtctagaagtgagagcatggttttttttagccctttgagagtctacatctaatgaacattcttgctcacccataaataacgtcaagcctcaatgtcaccgtcacgttgggatactctttctcatctggcatcctagacaggacaaggttggttacctttccttccatgaaccatgaacctgtgacggcatcattcatcctgacttcaccaagctccgcctgtgggtgaggccagagctcccactggcaatttttagaagagccagaggctccctgcttcctctagaaataacagttcagggtgaagcatggagggtttcagttcccagacaatggaaccatttagagacaacacagttggacatttccactttttccttgattcctggaagtccagtgggttctgcagctgaaaaagccctgggtcccagcagcagagagacaggacagaggggatgcttgggcggggagggacggtaacctgcagaacagattccatttttatagaacgagtacacgtttgctaaaacagtcctgctttcccagactggattcccaccacagggacagtcggaactcaggactagctccagcgacatctttcctccgaattcaagccttctatcacaatgtcaaaacagctatttataaagccattttcattgtacttgataacagcacgagtcccaaaacttttagaaataaaataggacattggcttgattgaaaagagggactttttaaaaattgttctttcgtcagaagccttttggatgacttacaatagctctgatgaagataccaccccagcgtcagtccaataggtcagtgagtttcaacaggcatccatccctcccatgaagggattctggtgatgggaagtttctgtaatgacaggaaagcattgaccctcattgattgtcaactttggtattagccatgaaagacaggatgctcattgggtgttctgtagagtgaggaatgctgcctattccctcccagaacgtctgacccaggggtgtgtgttgaggagccctgggggaaatggaccaagttttcccacagagcagtattaggctgaagagcaggtgactggtaggccccagctcccatcattccctcccaaagccattttgttcagttgctcatccacgctggattccagagagttttccaatttgggaagccatgagaaaggtttttaaatcttgggaagatggagagagggacataggatagttgactccaacatgacaggaagaggctggagattgggaattggccatcaaccaagcctgtagtagtaaagccatggtcccgcattggaattacttggggaacttatacagttctgatacccaggctctcctagaccagttcaaccaattctaggtgggggactcaggcatcagtgtgtttcgtagctccccgggtgttttccctgtgcagccgagcttgggaaactgccatgctttttggatgtcaaggcgctgttggaggctgggtgtgacagcacagagccaggttgtcttgtggaaaccacagccacgggtttgccactggctcagcatggcctcactgccagtcccagcctggctgagggacaagatggtttctcttgggagttcctgagtggagcacccttccaggctttttgaaagccagctgatctgtggagccttgttaagggactcaatacggtgtttggatattgatgtttttccttgagactgtcttgtccatcaataaagatggaggatgtctcctctttgaaccccgcttccccaccagtactctctctcccttagagtttatgagttattcaaggaggagacttcttaaagacagcaacgcaattcttgtaacttgtgtaaatagccccatctttcagagtgataccatttctacatttgataatgcctgtattcctgtaggatgtatatagtttaggggattttttttttgtttggttttgttttttagaagtcaatatgtctggttttatttattgcttgaaaaagatcatttgaaaaaaataaatacattttcaacca

SEQ ID NO: 8889 - DNA, 2959 bp, Homo sapiens
gcagttcagacccccccacacccatcaaagagccgctcctcccccccgcaggcgccttcgccgcctccctcccttcctttcctttccgctcctcttccgacctgtccacccgggaggaagggagctggaaagggggcggaaacctctcccctccaaaaagcacaacaaaactgttcagtgcggaggagccgggttcgcccctgccggacagcggggggctttgttccccgcagttgtttcctgcccatttgacctgtcagctgctggggaaacgctgctgttgacctttggttgaactgctaaggcgattttgctgatttttctttctttttccgcgagggctgtcttttgctcctccaaatgagcccagtccccctcccttctccccaaagcgctccaagagaaagtgccaggaaggggcttgtcccggaaggcctggcggctgagcggggccaggtcctggttaggccaccagggtgggcgtccgcgccattgtttgagcttgtcggcgctggtgggagagatgagggcaattcctctgggacgcaagtcccctcgaatggccggggctggccgggatgttccccgcacggcgctgccctcgagtccccccgatggagagcgcgggcgcgccttccttcgctggcgtccaaacccgggaccagctagaacacagcagggctgggactgggttccagccccacgtggagtctggatttgttttgttgtgttttgctttccttcctggaagaaatcccgaggggaccgccctagagcggcagctccaggacctcggcccttgggcttccgggggtgcagccacttaggccccgctcccggggagagagggattattttttaagatttatccccagggcgcgcggcatttccctgtccctcgtgaatcccgttgagagtcctccctccccaacctcctccatttccccagccagaccgattcgagagccctggagattctgggcgaggctagtgactgggtagtacaggcctctagccccaccattgctctctctgtcttcagttccccaggagggcaatggcatcaaacagcacagctctgggggatgtcaatattgcataccttttctacctaaagggaaaatgactcgcttttctgcttgcaaatatggtagtttctgcttacaaatgtaatacaatgcccatgacagccaaggactggaagcataagttgctaggtcttacaggtgattttttacaatgaagcaaactcactatgttagacaccatttacattggatgtctccaactaacaaaagtaactaaagacagatgtaggtgtaaattgagagtgaaatttgaccctttagaccgtcacaacttccttgggcttatcctgggtgcttataggagaggtgggctccacccacaaaaatggactgctcagaaaaatgagggagagagaaagggtggccactttcccgagccaagaaattccttgaaaaaaaatcagaacatctgaaaccagagagccgatttccttaccgggaggcagttcctggctaacgaagaggaagcacgatgggaagaaaagttcactccaacggaagccagtttgctgaacatagcagatcgcccaggaggactgggagagactgcaaaccagttcgagcccccagcatggcgttaggtgtcagccagctggcaggaaggtccaggtgtctgtgttcagagtctcaaggcggctatgagaggttttcctccgagtacccagaattctgttctaaaaccaaggccctggcagccatcccacccccggttccccccagtgccacagagcccttggacctgggctgcagctcctgtgggaccccactacacgaccaggggggtcctgtggagatccttcccttcctctacctcggcagtgcctaccatgctgcccggagagacatgctggacgccctgggcatcacggctctgttgaatgtctcctcggactgcccaaaccactttgaaggacactatcagtacaagtgcatcccagtggaagataaccacaaggccgacatcagctcctggttcatggaagccatagagtacatcgatgccgtgaaggactgccgtgggcgcgtgctggtgcactgccaggcgggcatctcgcggtcggccaccatctgcctggcctacctgatgatgaagaaacgggtgaggctggaggaggccttcgagttcgttaagcagcgccgcagcatcatctcgcccaacttcagcttcatggggcagctgctgcagttcgagtcccaggtgctggccacgtcctgtgctgcggaggctgctagcccctcgggacccctgcgggagcggggcaagacccccgccacccccacctcgcagttcgtcttcagctttccggtctccgtgggcgtgcactcggcccccagcagcctgccctacctgcacagccccatcaccacctctcccagctgttagagccgccctgggggccccagaaccagagctggctcccagcaagggtaggacgggccgcatgcgggcagaaagttgggactgagcagctgggagcaggcgaccgagctccttccccatcatttctccttggccaacgacgaggccagccagaatggcaataaggactccgaatacataataaaagcaaacagaacactccaacttagagcaataacggctgccgcagcagccagggaagaccttggtttggtttatgtgtcagtttcacttttccgatagaaatttcttacctcatttttttaagcagtaaggcttgaagtgatgaaacccacagatcctagcaaatgtgcccaaccagctttactaaagggggaggaagggagggcaaagggatgagaagacaagtttcccagaagtgcctggttctgtgtacttgtccctttgttgtcgttgttgtagttaaaggaatttcattttttaaaagaaa

SEQ ID NO: 8890 - DNA, 2557 bp, Homo sapiens
cttatatgggcagccgcgtcacggacggcactcattcacataaaacgctgcgcggccggcggaatccccggcttctagggcggcgagcggccgggctggctatcgagcgagcggggcgggaacgcggagttgcgccgccgctcgggcgccgggctccgtcgcggccgcagccccgcgggtcgccctcccgtgcctcgcccgcggacaccctggccgtggacaccctggccgtgggcacccgcggggcgcgcggcgcggggccgctggccggcggcggcggcggcatgaaggtcacgtcgctcgacgggcgccagctgcgcaagatgctccgcaaggaggcggcggcgcgctgcgtggtgctcgactgccggccctatctggccttcgctgcctcgaacgtgcgcggctcgctcaacgtcaacctcaactcggtggtgctgcggcgggcccggggcggcgcggtgtcggcgcgctacgtgctgcccgacgaggcggcgcgcgcgcggctcctgcaggagggcggcggcggcgtcgcggccgtggtggtgctggaccagggcagccgccactggcagaagctgcgagaggagagcgccgcgcgtgtcgtcctcacctcgctactcgcttgcctacccgccggcccgcgggtctacttcctcaaagggggatatgagactttctactcggaatatcctgagtgttgcgtggatgtaaaacccatttcacaagagaagattgagagtgagagagccctcatcagccagtgtggaaaaccagtggtaaatgtcagctacaggccagcttatgaccagggtggcccagttgaaatccttcccttcctctaccttggaagtgcctaccatgcatccaagtgcgagttcctcgccaacctgcacatcacagccctgctgaatgtctcccgacggacctccgaggcctgcgcgacccacctacactacaaatggatccctgtggaagacagccacacggctgacattagctcccactttcaagaagcaatagacttcattgactgtgtcagggaaaagggaggcaaggtcctggtccactgtgaggctgggatctcccgttcacccaccatctgcatggcttaccttatgaagaccaagcagttccgcctgaaggaggccttcgattacatcaagcagaggaggagcatggtctcgcccaactttggcttcatgggccagctcctgcagtacgaatctgagatcctgccctccacgcccaacccccagcctccctcctgccaaggggaggcagcaggctcttcactgataggccatttgcagacactgagccctgacatgcagggtgcctactgcacattccctgcctcggtgctggcaccggtgcctacccactcaacagtctcagagctcagcagaagccctgtggcaacggccacatcctgctaaaactgggatggaggaatcggcccagccccaagagcaactgtgatttttgtttttaagactcatggacatttcatacctgtgcaatactgaagacctcattctgtcatgctgccccagtgagatagtgagtggtcaccaggcttgcaaatgaacttcagacggacctcagggtaggttctcgggactgaaggaaggccaagccattacgggagcacagcatgtgctgactactgtacttccagacccctgccctcttgggactgcccagtccttgcacctcagagttcgccttttcatttcaagcataaggcaataaatacctgcagcaacgtgggagaaagaagttgctggaccaggagaaaaggcagttatgaagccaattcattttgaaggaagcacaatttccaccttattttttgaactttggcagtttcaatgtctgtctctgttgcttcggggcataagctgatcaccgtctagttgggaaagtaaccctacagggtttgtagggacatgatcagcatcctgatttgaaccctgaaatgttgtgtagacaccctcttgggtccaatgaggtagttggttgaagtagcaagatgttggcttttctggattttttttgccatgggttcttcactgaccttggactttggcatgattcttagtcatacttgaacttgtctcattccacctcttctcagagcaactcttcctttgggaaaagagttcttcagatcatagaccaaaaaagtcataccttcgaggtggtagcagtagattccaggaggagaagggtacttgctaggtatcctgggtcagtggcggtgcaaactggtttcctcagctgcctgtccttctgtgtgcttatgtctcttgtgacaattgttttcctccctgcccctggaggttgtcttcaagctgtggacttctgggatttgcagattttgcaacgtggtactactttttttttctttttgtctgttagttatttctccaggggaaaaggcaataattttctaagacccgtgtgaatgtgaagaaaagcagtatgttactggttgttgttgttgttcttgttttttatagtgtaaaataaaaatagtaaaaggagaaaagca

SEQ ID NO: 8891 - DNA, 3231 bp, Homo sapiens
gcggctggggcccgcgcggccggggcgccgtcccagggcagggctgcccggccccggccccgggccgcccgcgctccccatgaaaaaccagctccgcggccccccagcgcgggcgcacatgtcgacttcgggggcggcggcggctgggggcacccgggcggggtccgagcccggtgcggggtcggggtccggcgcaggcaccggggcgggcgcggcgacgggggcaggggccatgccctgcaagagcgccgagtggctgcaggaggagctggaggcgcgcggcggcgcgtccttgctgctgctcgactgccggccgcacgagctcttcgagtcgtcgcacatcgagacggccatcaacctggccatcccgggcctcatgttgcgccgcctgcgcaagggcaacctgcccatccgctccatcatccccaaccacgccgacaaggagcgcttcgccacgcgctgcaaggcggccaccgtgctgctctacgacgaggccacggccgagtggcagcccgagcccggcgctcccgcctccgtgctcggcctgctcctacagaagctgcgcgacgacggctgccaggcctactacctccaaggtggtttcaacaagtttcaaacagagtactctgagcactgcgagaccaacgtggacagctcttcctcgccgagcagctcgccacccacctcagtgctgggcctggggggcctgcgcatcagctctgactgctccgacggcgagtcggaccgagagctgcccagcagtgccaccgagtcagacggcagccctgtgccatccagccaaccagccttccctgtccagatcctgccctacctctacctcggctgcgccaaggactccaccaacctggacgtgctcggcaagtatggcatcaagtatatcctcaatgtcacacccaacctacccaacgccttcgagcacggcggcgagttcacctacaagcagatccccatctctgaccactggagccagaacctctcccagttcttccctgaggccatcagcttcattgacgaagcccgctccaagaagtgtggtgtcctggtgcactgcctggcaggcatcagccgctcagtgacggtcactgtggcctatctgatgcagaagatgaacctgtcactcaacgacgcctacgactttgtcaagaggaaaaagtccaacatctcgcccaacttcaacttcatggggcagctgctggactttgagcggacgctggggctaagcagcccgtgcgacaaccacgcgtcgagtgagcagctctacttttccacgcccaccaaccacaacctgttcccactcaatacgctggagtccacgtgaggcctggtgcacggggggcatggcaccaggcccctgctcggctctccacagggctaggtgggagagcccaagcccgccacctctggcctgaggaacccccagatgtcacctgtgcccagaggcccaggctgatcggtgtcggagcgcccctcaccatccttgggggcagggcccgcaggcaaggtctcccactgcagggcttgctggagaggcctcggctcttggacacgtggctttgggcgtccaccagggcctcatcctgtccaggacgctcctttctgctgacagcccagccagtttggctgttttttaaagacacatccacggacctgagtttactttttacttttggcaggtaaatccaagctccctggagcacaaagagtgtttgagctcttcttgatttttcttttttttttttttttttaacaaaaagtgttattttcaggctacatgcaacagtggattgtataacccagtatttcatccctttcctgatcctgcaagagagagaaatgttcagttttgtttttcgttcaatttcaaaaagcaagtatcgtgtttgtttttgtttttgttttttaatggaaaagacagacgccatgttgaccttgaccaaatgcgttttgcacatgtgtgaagcctctgtttcctcagcgggcccttcttgaaggggtggcttactgctcttcaggtattgggacccccagtcgtgccgcctcccacccttggcccagtctgacttagctctgcattcgcctgtgatgactgctgcaagttgtgattggtgggctggatggtggtctttgcattttctgccgtctcatccatccctctggtggtccctgcagacctccctgaggcagaaggtggggaccctggggccctgccgctgtcccccaggaggtgggccgcagggggctgccaggcagtagcattagccctctggggtcagcccctaagaaggcctgggctctgagcccttttatatacttagccactacttctgtctgtctgtctgtctctctctcttcctctccctctctctctttctctctctccctctctctctctttctttctctctccccccctccctctctcttcctttcctctctcttgttgtaactgggagtggaggcccagtggctggggagacattaggtggtggggcccagcccgacctccaggttcttccttctccctagctgttgctttggtctggccactcccagcccccttgtccccttggaagcttgccctgccctcatcttgcccatgccttctactgccaggagacttgcacccatttcaaccctagggcgggggcaagtggggcaaggatggaccagcagaaggggggtaaggctctgttcacttccccctgcctccacagaacgaagccacggattccgttatcttcctccagttttgttccttctccagcctcagttccaccaggtgtcaggactgcatgggggcctggggcaggcagaggagtcaggccagggtccctgacggagcagcactcagcatgtgagtgaggccacagaaaaactctgccccactgcttcttacctcacgggggtggctttcagggattctttagcgcagcagattaaaatcttgccacagtcgagaaattgacaacaagcttccatgctgtacatggttctctttttctctcttttatttttaaaaagaaaacccagaaagatgtaccagatttgtgtaaatgagggtatgccagaaggtggccagttttgctttatgatcttatgaaggaagatttgtgaccctacgtatatatatacacacacatacatatatatatatatcccgaaccaacaacgggactttgtttatattgcaaataaatattattttttcttt

SEQ ID NO: 8892 - DNA, 3340 bp, Homo sapiens
cgcggtgcgcgcggagggccgggcgggcgggcgggacggaggccgggaggccgggaggccggggcggcgggcgcgcagctcggcgggaggcgggcgcccggagacgcggctggggcccgcgcggccggggcgccgtcccagggcagggctgcccggccccggccccgggccgcccgcgctccccatgaaaaaccagctccgcggccccccagcgcgggcgcacatgtcgacttcgggggcggcggcggctgggggcacccgggcggggtccgagcccggtgcggggtcggggtccggcgcaggcaccggggcgggcgcggcgacgggggcaggggccatgccctgcaagagcgccgagtggctgcaggaggagctggaggcgcgcggcggcgcgtccttgctgctgctcgactgccggccgcacgagctcttcgagtcgtcgcacatcgagacggccatcaacctggccatcccgggcctcatgttgcgccgcctgcgcaagggcaacctgcccatccgctccatcatccccaaccacgccgacaaggagcgcttcgccacgcgctgcaaggcggccaccgtgctgctctacgacgaggccacggccgagtggcagcccgagcccggcgctcccgcctccgtgctcggcctgctcctacagaagctgcgcgacgacggctgccaggcctactacctccaaggtggtttcaacaagtttcaaacagagtactctgagcactgcgagaccaacgtggacagctcttcctcgccgagcagctcgccacccacctcagtgctgggcctggggggcctgcgcatcagctctgactgctccgacggcgagtcggaccgagagctgcccagcagtgccaccgagtcagacggcagccctgtgccatccagccaaccagccttccctgtccagatcctgccctacctctacctcggctgcgccaaggactccaccaacctggacgtgctcggcaagtatggcatcaagtatatcctcaatgtcacacccaacctacccaacgccttcgagcacggcggcgagttcacctacaagcagatccccatctctgaccactggagccagaacctctcccagttcttccctgaggccatcagcttcattgacgaagcccgctccaagaagtgtggtgtcctggtgcactgcctggcaggcatcagccgctcagtgacggtcactgtggcctatctgatgcagaagatgaacctgtcactcaacgacgcctacgactttgtcaagaggaaaaagtccaacatctcgcccaacttcaacttcatggggcagctgctggactttgagcggacgctggggctaagcagcccgtgcgacaaccacgcgtcgagtgagcagctctacttttccacgcccaccaaccacaacctgttcccactcaatacgctggagtccacgtgaggcctggtgcacggggggcatggcaccaggcccctgctcggctctccacagggctaggtgggagagcccaagcccgccacctctggcctgaggaacccccagatgtcacctgtgcccagaggcccaggctgatcggtgtcggagcgcccctcaccatccttgggggcagggcccgcaggcaaggtctcccactgcagggcttgctggagaggcctcggctcttggacacgtggctttgggcgtccaccagggcctcatcctgtccaggacgctcctttctgctgacagcccagccagtttggctgttttttaaagacacatccacggacctgagtttactttttacttttggcaggtaaatccaagctccctggagcacaaagagtgtttgagctcttcttgatttttcttttttttttttttttttaacaaaaagtgttattttcaggctacatgcaacagtggattgtataacccagtatttcatccctttcctgatcctgcaagagagagaaatgttcagttttgtttttcgttcaatttcaaaaagcaagtatcgtgtttgtttttgtttttgttttttaatggaaaagacagacgccatgttgaccttgaccaaatgcgttttgcacatgtgtgaagcctctgtttcctcagcgggcccttcttgaaggggtggcttactgctcttcaggtattgggacccccagtcgtgccgcctcccacccttggcccagtctgacttagctctgcattcgcctgtgatgactgctgcaagttgtgattggtgggctggatggtggtctttgcattttctgccgtctcatccatccctctggtggtccctgcagacctccctgaggcagaaggtggggaccctggggccctgccgctgtcccccaggaggtgggccgcagggggctgccaggcagtagcattagccctctggggtcagcccctaagaaggcctgggctctgagcccttttatatacttagccactacttctgtctgtctgtctgtctctctctcttcctctccctctctctctttctctctctccctctctctctctttctttctctctccccccctccctctctcttcctttcctctctcttgttgtaactgggagtggaggcccagtggctggggagacattaggtggtggggcccagcccgacctccaggttcttccttctccctagctgttgctttggtctggccactcccagcccccttgtccccttggaagcttgccctgccctcatcttgcccatgccttctactgccaggagacttgcacccatttcaaccctagggcgggggcaagtggggcaaggatggaccagcagaaggggggtaaggctctgttcacttccccctgcctccacagaacgaagccacggattccgttatcttcctccagttttgttccttctccagcctcagttccaccaggtgtcaggactgcatgggggcctggggcaggcagaggagtcaggccagggtccctgacggagcagcactcagcatgtgagtgaggccacagaaaaactctgccccactgcttcttacctcacgggggtggctttcagggattctttagcgcagcagattaaaatcttgccacagtcgagaaattgacaacaagcttccatgctgtacatggttctctttttctctcttttatttttaaaaagaaaacccagaaagatgtaccagatttgtgtaaatgagggtatgccagaaggtggccagttttgctttatgatcttatgaaggaagatttgtgaccctacgtatatatatacacacacatacatatatatatatatcccgaaccaacaacgggactttgtttatattgcaaataaatattattttttctttaaaa

SEQ ID NO: 8893 - DNA, 4455 bp, Homo sapiens
aggtccagcaccatgtgctaggtcactcccagcgcgaggccacacctgggccgtcggagcagcccctcctcacttcaggggtcaccctccccagcacccattgccccaccatggctggggaccggctcccgaggaaggtgatggatgccaagaagctggccagcctgctgcggggcgggcctggggggccgctggtcatcgacagccgctccttcgtggagtacaacagctggcatgtgctcagctccgtcaacatctgctgctccaagctggtgaagcggcggctgcagcagggcaaggtgaccattgcggagctcatccagccggctgcacgcagccaggtggaggctacggagccacaggacgtggtggtctatgaccagagcacgcgggacgccagcgtgctggccgcagacagcttcctctccatcctgctgagcaagctggacggctgcttcgacagcgtggccatcctcactgggggcttcgccaccttctcctcctgcttccccggcctctgcgagggcaagcctgctgccctgctacccatgagcctctcccagccctgcctgcctgtgcccagcgtgggcctgacccgcatcctgcctcacctctacctgggctcgcagaaggacgtcctaaacaaggatctgatgacgcaaaatggaataagctacgtcctcaacgccagcaactcctgccccaagcctgacttcatctgcgagagccgcttcatgcgggtccccatcaacgacaactactgtgaaaaactgctgccctggctggacaagtccatcgagttcatcgataaagccaagctctccagctgccaagtcatcgtccactgtctggctggcatctcccgctctgccaccatcgccatcgcctacatcatgaagaccatgggcatgtcctccgacgacgcctacaggttcgtgaaggacaggcgcccgtccatctcgcccaacttcaacttcctgggccagctgctggagtacgagcgcagcctgaagctgctggccgccctgcagggcgacccgggcaccccctcagggacgccggagcctccgcccagtcctgccgccggggccccgctgccacggctgccaccacctacctcagagagcgctgccacagggaatgcggctgccagggagggcggcctgagcgcgggcggggagccccccgcgccccccacgcccccggcgaccagcgcactgcagcagggcctgcgcggcctgcacctctcctcggaccgcctgcaggacactaaccgcctcaagcgctccttctccctggacatcaagtctgcctacgcccctagcaggcggcccgacggccccgggccccccgaccccggcgaggccccgaagctctgcaagctggacagcccgtcgggggccgcgctgggcctgtcctcgcccagcccggacagcccggacgccgcgcctgaggcgcgcccacggccccgccggcggccccggccccccgccggctcccccgcgcgctcccccgcgcacagcctcggcctgaacttcggcgatgcggcccggcagactccgcggcacggcctctcggccctgtcggcgcccgggctgcccggccctggccagccggccggccccggggcctgggcaccgccgctcgactccccaggcacgccgtcgcccgacgggccctggtgcttcagccccgagggcgcacagggggcgggcggggtgctgtttgcgcccttcggccgggcgggcgccccgggaccaggcggcggcagcgacctgcggcggcgggaggcagcgagggctgagccccgggacgcgcggaccggctggcccgaggagccggccccggagacgcagttcaagcgccgcagctgccagatggagttcgaggagggcatggtggaggggcgcgcgcgcggcgaggagctggccgccctgggcaagcaggcgagcttctcgggcagcgtggaggtcatcgaggtgtcctgacccctccgctgccctcggccccgccgcccgcagccaggcccgttataaatgtatattatatataatgcaaagaaaggtaaatggttttactgggatttttatcgagaagtaaatatttcgattttttatttatttaagctgttcattctggcaatgatttggcaacagtgcgggtggtcctcgagctctatttttactgtctggtatttaaactgaaacatacgtttctaagcaatacgaggccaccttcagtcgcaagctgggtgccaggcctggggcccctcccagttcccccgccccaggaaacactgctgacctttgcaaaggctgccgagctttcgtgcactttttacataacaaaaaggtgaaaaaaaggaaaaaaaaacttctttgccacaaactgagccgcagaaccccccttctccccccacccacctcccctgctccctcccttctctgcgccggcctagggctctgcaccaaagccataggatggaggagcaggagctggtgtgccccggagaggtgcggccagccctccatcagctccaggcaccaaatcttggtggcaaggagggcaccccgctgcccgttgccccagagctgttctctggcaggggaggacaggcattgggcttcatggtgccagggtgttcagaggggctgagaaatagaacagtgtgtgtaggggcttcgggcagggggttctggaacgtcagatgaggtgcagcccaggggaggacagaggtgttagtgcccccaactcctgccagagccccagtccagccacagagtggctcagaaaggccattcctagagggctgcggccctcccttctcccttgcccatgcccccagagctgcctgccgggcagggtggcaccattgcaggagaggagcttggcctccgggggtcaggcaggaggcgcctggctagccagtgctggctccactgggcaggaagccctggacccccaggtatgaggagggggtggtcttagggttctgttccaggtctgccccgcccccctcccagccatgccccaggcagaacttggaattcaggtgtgcacctgcaggctgaggggctctgtgagcaggtgctgctcacacagggagttcaggcgccagccaagcccctgtgctgctgggataggcctgcttcacttagggagcactgcctcaagacaggtaaagccccctcgtttgcccccacccccatggggccgctcaggagagaaactcccattcacccctttcccagggtgctctctctctaggtggcatgccagcccccaaacacaagtggcttttgggcccaggtgggtcagcctgctgcccctgccccataccccctcgggccattgggacccctgcccttcagatgtcctagggtctaggagtggggccagtcactgtgggaagaggccaggggcttggccggagaggcagcccagggcaggacccagtcctgagtcctggagcagggccagggaggcgcccatcccgccccagccagccgccctctctgctgtttcttctatttgttcttcttttcacccacagctctgtgttcctgtcatccctcctttcagcaaaagtcctgttcccgttccctctgtccccacccactcctgttcccccaagaaaataagctatcgttgtatttgcaatctatggattagaggtttaagtatttattattattggttaattattattaattatgtaaatttgcctcccatatgtctgttgcgttgggtttctgaggagaccctgggtgaggaggatgcactggcttcccgcttctcgccccccacccctgtgctgtccgggagacagtggtctggggccactggttgggcccccttctcccttcccccttccccttgtcccttctgcaggccgttgaggggggctgtctgtctcagtctgtctctgctcccactcttgaggcactggttaccgcaaagtgagcagccagcaggggggcgaaggtcctgtgttggccactgcctcctccagtgctgcaggaggcgggctgaggccccacctggtggctttcacctgacccagccctgagtcctctccaagcctctctccggcccctcccacctggccactgcctcctccagtgctgcgggaggcgggccagggccccacctggtggctttcacctgacccagccctgagtcctctccaagcctctctccggcccctcccacctggccactgcctggcattgggatcgccccaaaatggacccggcccctcctgttatttgctgggaagtccagcggaggagagggtgcaggtcccccgctgagcctccagtctctgtagactgggctgccggcccttcagccccccttggagcccctcccgccacagccgcaccttctgctcccggcccctccctttgtatttggagacaatgtgttgtaataaagcttaaagtggatgttttc

SEQ ID NO: 8894 - DNA, 4480 bp, Homo sapiens
ccgaggcgagcgcgagcgaggtccagcaccatgtgctaggtcactcccagcgcgaggccacacctgggccgtcggagcagcccctcctcacttcaggggtcaccctccccagcacccattgccccaccatggctggggaccggctcccgaggaaggtgatggatgccaagaagctggccagcctgctgcggggcgggcctggggggccgctggtcatcgacagccgctccttcgtggagtacaacagctggcatgtgctcagctccgtcaacatctgctgctccaagctggtgaagcggcggctgcagcagggcaaggtgaccattgcggagctcatccagccggctgcacgcagccaggtggaggctacggagccacaggacgtggtggtctatgaccagagcacgcgggacgccagcgtgctggccgcagacagcttcctctccatcctgctgagcaagctggacggctgcttcgacagcgtggccatcctcactgggggcttcgccaccttctcctcctgcttccccggcctctgcgagggcaagcctgctgccctgctacccatgagcctctcccagccctgcctgcctgtgcccagcgtgggcctgacccgcatcctgcctcacctctacctgggctcgcagaaggacgtcctaaacaaggatctgatgacgcaaaatggaataagctacgtcctcaacgccagcaactcctgccccaagcctgacttcatctgcgagagccgcttcatgcgggtccccatcaacgacaactactgtgaaaaactgctgccctggctggacaagtccatcgagttcatcgataaagccaagctctccagctgccaagtcatcgtccactgtctggctggcatctcccgctctgccaccatcgccatcgcctacatcatgaagaccatgggcatgtcctccgacgacgcctacaggttcgtgaaggacaggcgcccgtccatctcgcccaacttcaacttcctgggccagctgctggagtacgagcgcagcctgaagctgctggccgccctgcagggcgacccgggcaccccctcagggacgccggagcctccgcccagtcctgccgccggggccccgctgccacggctgccaccacctacctcagagagcgctgccacagggaatgcggctgccagggagggcggcctgagcgcgggcggggagccccccgcgccccccacgcccccggcgaccagcgcactgcagcagggcctgcgcggcctgcacctctcctcggaccgcctgcaggacactaaccgcctcaagcgctccttctccctggacatcaagtctgcctacgcccctagcaggcggcccgacggccccgggccccccgaccccggcgaggccccgaagctctgcaagctggacagcccgtcgggggccgcgctgggcctgtcctcgcccagcccggacagcccggacgccgcgcctgaggcgcgcccacggccccgccggcggccccggccccccgccggctcccccgcgcgctcccccgcgcacagcctcggcctgaacttcggcgatgcggcccggcagactccgcggcacggcctctcggccctgtcggcgcccgggctgcccggccctggccagccggccggccccggggcctgggcaccgccgctcgactccccaggcacgccgtcgcccgacgggccctggtgcttcagccccgagggcgcacagggggcgggcggggtgctgtttgcgcccttcggccgggcgggcgccccgggaccaggcggcggcagcgacctgcggcggcgggaggcagcgagggctgagccccgggacgcgcggaccggctggcccgaggagccggccccggagacgcagttcaagcgccgcagctgccagatggagttcgaggagggcatggtggaggggcgcgcgcgcggcgaggagctggccgccctgggcaagcaggcgagcttctcgggcagcgtggaggtcatcgaggtgtcctgacccctccgctgccctcggccccgccgcccgcagccaggcccgttataaatgtatattatatataatgcaaagaaaggtaaatggttttactgggatttttatcgagaagtaaatatttcgattttttatttatttaagctgttcattctggcaatgatttggcaacagtgcgggtggtcctcgagctctatttttactgtctggtatttaaactgaaacatacgtttctaagcaatacgaggccaccttcagtcgcaagctgggtgccaggcctggggcccctcccagttcccccgccccaggaaacactgctgacctttgcaaaggctgccgagctttcgtgcactttttacataacaaaaaggtgaaaaaaaggaaaaaaaaacttctttgccacaaactgagccgcagaaccccccttctccccccacccacctcccctgctccctcccttctctgcgccggcctagggctctgcaccaaagccataggatggaggagcaggagctggtgtgccccggagaggtgcggccagccctccatcagctccaggcaccaaatcttggtggcaaggagggcaccccgctgcccgttgccccagagctgttctctggcaggggaggacaggcattgggcttcatggtgccagggtgttcagaggggctgagaaatagaacagtgtgtgtaggggcttcgggcagggggttctggaacgtcagatgaggtgcagcccaggggaggacagaggtgttagtgcccccaactcctgccagagccccagtccagccacagagtggctcagaaaggccattcctagagggctgcggccctcccttctcccttgcccatgcccccagagctgcctgccgggcagggtggcaccattgcaggagaggagcttggcctccgggggtcaggcaggaggcgcctggctagccagtgctggctccactgggcaggaagccctggacccccaggtatgaggagggggtggtcttagggttctgttccaggtctgccccgcccccctcccagccatgccccaggcagaacttggaattcaggtgtgcacctgcaggctgaggggctctgtgagcaggtgctgctcacacagggagttcaggcgccagccaagcccctgtgctgctgggataggcctgcttcacttagggagcactgcctcaagacaggtaaagccccctcgtttgcccccacccccatggggccgctcaggagagaaactcccattcacccctttcccagggtgctctctctctaggtggcatgccagcccccaaacacaagtggcttttgggcccaggtgggtcagcctgctgcccctgccccataccccctcgggccattgggacccctgcccttcagatgtcctagggtctaggagtggggccagtcactgtgggaagaggccaggggcttggccggagaggcagcccagggcaggacccagtcctgagtcctggagcagggccagggaggcgcccatcccgccccagccagccgccctctctgctgtttcttctatttgttcttcttttcacccacagctctgtgttcctgtcatccctcctttcagcaaaagtcctgttcccgttccctctgtccccacccactcctgttcccccaagaaaataagctatcgttgtatttgcaatctatggattagaggtttaagtatttattattattggttaattattattaattatgtaaatttgcctcccatatgtctgttgcgttgggtttctgaggagaccctgggtgaggaggatgcactggcttcccgcttctcgccccccacccctgtgctgtccgggagacagtggtctggggccactggttgggcccccttctcccttcccccttccccttgtcccttctgcaggccgttgaggggggctgtctgtctcagtctgtctctgctcccactcttgaggcactggttaccgcaaagtgagcagccagcaggggggcgaaggtcctgtgttggccactgcctcctccagtgctgcaggaggcgggctgaggccccacctggtggctttcacctgacccagccctgagtcctctccaagcctctctccggcccctcccacctggccactgcctcctccagtgctgcgggaggcgggccagggccccacctggtggctttcacctgacccagccctgagtcctctccaagcctctctccggcccctcccacctggccactgcctggcattgggatcgccccaaaatggacccggcccctcctgttatttgctgggaagtccagcggaggagagggtgcaggtcccccgctgagcctccagtctctgtagactgggctgccggcccttcagccccccttggagcccctcccgccacagccgcaccttctgctcccggcccctccctttgtatttggagacaatgtgttgtaataaagcttaaagtggatgttttccccacga

SEQ ID NO: 8895 - DNA, 3096 bp, Homo sapiens
aaaaataactcatattgtctctgaggttcttttccagtgaagtgtttagtattgctgctatttggagtacaaagttggagcttttaaagaacctgggagttcaaaagtataaggagaaataaatgaaaagcagaaatattttgaggcaataagtatagactcaaatctatattatgacccacttgtagcaccacttggaattctaccaataagagatttatttgggcaaactataatggttgttggaaattgcaaatcttagtgtgaattattttagtccagttggtttctttctttctcttacctgaaatgaactatactgaggcaataggagctttgtatagtaatttaggagtgtaaaacaacttagggaaaaggattattaagcaggatgattgggatgacatcatgtgaaatttaggaattggaggcattgggaattgagagggtgctaacaaaggaaaacagcttattttagaatttgtctggaggatgtagaattgaagaagttttggtatttcttctgcagcggccccagtgcccttgaccaggaacatctcttggagtcagtagttttcatgaggctgacctaggaacttggccaacatatgcaacattgttctatttaaaatattccttgaattaaattcgatagtatcaatttaaaacataaagttttcactcaactcctttagaagttagattttagcttgtacttgtctttacctcttctgctgattatcagttgacaacactgagattactttcattttcctgtaagtcattatgaatttttctggtcaaccatgagttatcagtggaagcaataagtaggaagtactgtaaaagaattacaataaaataagagaaaccacttggagagcaagagggcttgtggacttgggggagcggttgtgagaaatgtctcagaacttaatttacaaataacattggtagattgacatgttgtctttcctataaagtaactttacctctgtcttaatagtaaactactatgaaagtgaattcgtgttcctcttgatttgtgaactgatgaaaattacaaaatgtggagttttttccccagataaagtaaatggtggaatattcaggtttatttgatacctagaaaatacctgaaattttccgtggtaataggcacattttgaaactgttttttttttctctgacaattgaatatattttatatatagttgattttgattattgaagactaaggaaaatttaagtttgaatgttagaaaatgaattttgcaaatttgaagtaattttattctttatgttttgggattgtagttatgttagatattcctcagttggggtaattgtcttgcatcattatctcttatcataatctgtttttcttcacacagtgttatagttttgccgctggactcttccctcccttcccccaccccatcaggatgatatgagacttgaaagaagacgatgcatacaggaggagagacttcagcatgcaaaccttcatctgttcggcttgcaccgtcattttcattccatgctgctggccttcagatggctggacagatgccccattcacatcagtacagtgaccgtcgccagccaaacataagtgaccaacaggtttctgccttatcatattctgaccagattcagcaacctctaactaaccaggtgatgcctgatattgtcatgttacagaggcggatgccccaaaccttccgtgacccagcaactgctcccctgagaaaactttctgttgacttgatcaaaacatacaagcatattaatgaggtttactatgcaaaaaagaagcgaagacaccaacagggccagggagacgattctagtcataagaaggaacggaaggtttacaatgatggttatgatgatgataactatgattatattgtaaaaaacggagaaaagtggatggatcgttacgaaattgactccttgataggcaaaggttcctttggacaggttgtaaaggcatatgatcgtgtggagcaagaatgggttgccattaaaataataaagaacaagaaggcttttctgaatcaagcacagatagaagtgcgacttcttgagctcatgaacaaacatgacactgaaatgaaatactacatagtgcatttgaaacgccactttatgtttcgaaaccatctctgtttagtttttgaaatgctgtcctacaacctctatgacttgctgagaaacaccaatttccgaggggtctctttgaacctaacacgaaagtttgcgcaacagatgtgcactgcactgcttttccttgcgactccagaacttagtatcattcactgtgatctaaaacctgaaaatatccttctttgtaaccccaaacgcagtgcaatcaagatagttgactttggcagttcttgtcagttggggcagaggatataccagtatattcagagtcgcttttatcggtctccagaggtgctactgggaatgccttatgaccttgccattgatatgtggtccctcgggtgtattttggttgaaatgcacactggagaacctctgttcagtggtgccaatgaggtagatcagatgaataaaatagtggaagttctgggtattccacctgctcatattcttgaccaagcaccaaaagcaagaaagttctttgagaagttgccagatggcacttggaacttaaagaagaccaaagatggaaaacgggagtacaaaccaccaggaacccgtaaacttcataacattcttggagtggaaacaggaggacctggtgggcgacgtgctggggagtcaggtcatacggtcgctgactacttgaagttcaaagacctcattttaaggatgcttgattatgaccccaaaactcgaattcaaccttattatgctctgcagcacagtttcttcaagaaaacagctgatgaaggtacaaatacaagtaatagtgtatctacaagccccgccatggagcagtctcagtcttcgggcaccacctccagtacatcgtcaagctcagtggtggagcagcactggatgccaggtgcctttagaatgaccgtatcatttaccctagaggttcatgacgttcctgtctaa

SEQ ID NO: 8896 - DNA, 5498 bp, Homo sapiens
cgaggctgagactcaccggaggaagcggcgcgagcgccccgccatcgtcccggctgaagtgcagtggcacgatcataggtggtcactacagtctcagattcctgggcttaagcagtcttcccacctcagcctccccagtagctgggattacagtgttatagttttgccgctggactcttccctcccttcccccaccccatcaggatgatatgagacttgaaagaagacgatgcatacaggaggagagacttcagcatgcaaaccttcatctgttcggcttgcaccgtcattttcattccatgctgctggccttcagatggctggacagatgccccattcacatcagtacagtgaccgtcgccagccaaacataagtgaccaacaggtttctgccttatcatattctgaccagattcagcaacctctaactaaccaggtgatgcctgatattgtcatgttacagaggcggatgccccaaaccttccgtgacccagcaactgctcccctgagaaaactttctgttgacttgatcaaaacatacaagcatattaatgaggtttactatgcaaaaaagaagcgaagacaccaacagggccagggagacgattctagtcataagaaggaacggaaggtttacaatgatggttatgatgatgataactatgattatattgtaaaaaacggagaaaagtggatggatcgttacgaaattgactccttgataggcaaaggttcctttggacaggttgtaaaggcatatgatcgtgtggagcaagaatgggttgccattaaaataataaagaacaagaaggcttttctgaatcaagcacagatagaagtgcgacttcttgagctcatgaacaaacatgacactgaaatgaaatactacatagtgcatttgaaacgccactttatgtttcgaaaccatctctgtttagtttttgaaatgctgtcctacaacctctatgacttgctgagaaacaccaatttccgaggggtctctttgaacctaacacgaaagtttgcgcaacagatgtgcactgcactgcttttccttgcgactccagaacttagtatcattcactgtgatctaaaacctgaaaatatccttctttgtaaccccaaacgcagtgcaatcaagatagttgactttggcagttcttgtcagttggggcagaggatataccagtatattcagagtcgcttttatcggtctccagaggtgctactgggaatgccttatgaccttgccattgatatgtggtccctcgggtgtattttggttgaaatgcacactggagaacctctgttcagtggtgccaatgaggtagatcagatgaataaaatagtggaagttctgggtattccacctgctcatattcttgaccaagcaccaaaagcaagaaagttctttgagaagttgccagatggcacttggaacttaaagaagaccaaagatggaaaacgggagtacaaaccaccaggaacccgtaaacttcataacattcttggagtggaaacaggaggacctggtgggcgacgtgctggggagtcaggtcatacggtcgctgactacttgaagttcaaagacctcattttaaggatgcttgattatgaccccaaaactcgaattcaaccttattatgctctgcagcacagtttcttcaagaaaacagctgatgaaggtacaaatacaagtaatagtgtatctacaagccccgccatggagcagtctcagtcttcgggcaccacctccagtacatcgtcaagctcaggtggctcatcggggacaagcaacagtgggagagcccggtcggatccgacgcaccagcatcggcacagtggtgggcacttcacagctgccgtgcaggccatggactgcgagacacacagtccccaggtgagctcgcacgtggttcatttgcttgtgtcacctgccattctcaggtggagcagcactggatgccaggtgcctttagaatgaccgtatcatttaccctagaggttcatgacgttcctgtctaaggaaatgtgcgtcagcaatttcctgctcctcttggttggtcaggcactgaagctcctacacaggtcactgttgaaactcatcctgttcaagaaacaacctttcatgtagcccctcaacagaatgcattgcatcatcaccatggtaacagttcccatcaccatcaccaccaccaccaccatcaccaccaccatggacaacaagccttgggtaaccggaccaggccaagggtctacaattctccaacgaatagctcctctacccaagattctatggaggttggccacagtcaccactccatgacatccctgtcttcctcaacgacttcttcctcgacatcttcctcctctactggtaaccaaggcaatcaggcctaccagaatcgcccagtggctgctaataccttggactttggacagaatggagctatggacgttaatttgaccgtctactccaatccccgccaagagactggcatagctggacatccaacataccaattttctgctaatacaggtcctgcacattacatgactgaaggacatctgacaatgaggcaaggggctgatagagaagagtcccccatgacaggagtttgtgtgcaacagagtcctgtagctagctcgtgactacattgaaacttgagtttgtttcttgtgtgtttttatagaagtggtgttttttttccaaaaacaaagtgcaaagctgcttgaatcaggaggagattaacacactgaaccgctacaagagggcaaagctgattttttttttaacttgaaaagattgcaaagggacattgaagtgtttaaaagagccatgtccaaacccatcttcatggatagctcagaggtatcctctttttgctcccccattttaacttgccacatcccagtcacagtggggtttttttgtctttctattcagcaaaagttaatattcagatgttggtcttggtcatttgccaactaattttaaagtaaaaggcactgcacataatttgcataaagggccccatgagggtgttttttttttttctttttgtcccccccatccccctttttttttgttttgttctgttttgttttgggtgggagggtgggaaatttgggtttttaagtcctctaaacacacttgggcacggaaatgcagtactgtaaggaagagggacctccagcttccacaaacaccatcttcagctgtatgaaagggacggttgtggtgaagtttgtcaggcacagtaagcatgctgagtggcggggatcagaactctcctatctgaacctactgaggagcaaagcagcaattacatgggatcctgtggctctcccgttgcagaggccacaggaagataggatggaacgtgactggtctcctaaccaaggtgcactgagaagcaatcaacgggtcggtcgtggccagtcctggggaggtctgagtggtggtctttgggataacctttggccttatggatttggactcgaaattagaagagcctaccatttcagatgcaatcacttttggacatgcttttgcagacagtccttaatgctgaaaacacagagaatgggtaattcaagaggcctttcttttaaaatagacttttgtgacccactaattgtaaggtattgcaaggtcactttgcgtgtgtcataaagttgacttccttattggttgaaggtcacagaagtagtggtttgctttgatggaaatagctacagctgtgtcccttcctgctttttactttttcttttgctttttctcggcacgtggtatctccaccatttcttctgcacaaagatgtcttctgttcatcctgaacatttttaaaaaatgcagaattttatgtgactgcttttttgcctcacaattatgctgtgaattttacaaaaatttattttcttttttgataatttattgtaccaaagctgtttttatagcacatagatgtctgtaaccaataatgtagcagttctgcactttgacacaaggtgtaactagaccatttttaaatgtcagttgaaaattatggctgtactattgcttaaacaaaactggaactgttgttgaatccatagccaatacatttacagcaatctgtgtactgaacatagtagattgacatctaattcaagattacaacatctgttacattctaagtgtgttcaggcttctgaaggtaaagggacactggatccagaagctatggaaccagcagttgattcttgtattcctgattaacctacttgtaaacttgaaagcaagaccttgattgcaccaacaggtccagagtatgagtgcaagcaaagcagaactctcatgcgtgacctgagcagacaggctggtatttaacaggtgcctcgtgttgagattacgctgccttaatgtaacacagtctggcagttgctaaatttgtgttcccattttaaattgaccaattttggggtgtgacacttttgagcggttgaattgggagaatgaagataagtaatttacctgtccaggatcaaaagaagcctagaaaagaagcagtaatctacctctgccgataacctgtttaagatgactcagcagaacaccgcgtttcattctattggtcaattccatgtggctgactaggtcaattttttttctgaacaaaagcaggtttttatatgtaaacagtgagaaaagaaaggctaaacactatgtaaatgtgaatggaaacttggaaatactcgtttttataaactacaaaaactttttgttgtttatcaggaaatccatatttattttgtaattaactgtcaagcctgtggatgatttttttgaacttggtagttcataaaggtttacagtgaataaaaggatatcatcttgagtatagcaatatcaaaaggaattcagtagttactgctgtttaggaatataaggttaagatatcatatgggtcaggtcattttttttttctgtgctggttgccacatcttagcaagcaccaaaaaactaaagcagtttttaaaccgatatttacgtaaagaaaatcataaaatccaatgcttctgcatactgtgttatgttacagtccagttttgtgtgctttactacacagtttggttacaggacttctgtgcattgtaaacataaacagcatggaaaaggttaaatacctgtgttcagattgtaagatctagtccggacttgctgtgtatattgtaacgttaaatgaaaaaagaacccccctttgtattatagtcatgcggtcttatgtatgataaacagttgaataatttgtcctcagactctttactatgcttttttaaaaattaatttaagaaaaatgtaaacatagtaaaaatcttcctatgcaattaaactggtccaggtctggtaggtatagtatcaaagttgagttaaatgtgtaaaaaggaaactatttgagatacattgacataggcatcagcaatctctgaaagtaaaaattggaggtttaacagat

SEQ ID NO: 8897 - DNA, 6384 bp, Homo sapiens
aaaaataactcatattgtctctgaggttcttttccagtgaagtgtttagtattgctgctatttggagtacaaagttggagcttttaaagaacctgggagttcaaaagtataaggagaaataaatgaaaagcagaaatattttgaggcaataagtatagactcaaatctatattatgacccacttgtagcaccacttggaattctaccaataagagatttatttgggcaaactataatggttgttggaaattgcaaatcttagtgtgaattattttagtccagttggtttctttctttctcttacctgaaatgaactatactgaggcaataggagctttgtatagtaatttaggagtgtaaaacaacttagggaaaaggattattaagcaggatgattgggatgacatcatgtgaaatttaggaattggaggcattgggaattgagagggtgctaacaaaggaaaacagcttattttagaatttgtctggaggatgtagaattgaagaagttttggtatttcttctgcagcggccccagtgcccttgaccaggaacatctcttggagtcagtagttttcatgaggctgacctaggaacttggccaacatatgcaacattgttctatttaaaatattccttgaattaaattcgatagtatcaatttaaaacataaagttttcactcaactcctttagaagttagattttagcttgtacttgtctttacctcttctgctgattatcagttgacaacactgagattactttcattttcctgtaagtcattatgaatttttctggtcaaccatgagttatcagtggaagcaataagtaggaagtactgtaaaagaattacaataaaataagagaaaccacttggagagcaagagggcttgtggacttgggggagcggttgtgagaaatgtctcagaacttaatttacaaataacattggtagattgacatgttgtctttcctataaagtaactttacctctgtcttaatagtaaactactatgaaagtgaattcgtgttcctcttgatttgtgaactgatgaaaattacaaaatgtggagttttttccccagataaagtaaatggtggaatattcaggtttatttgatacctagaaaatacctgaaattttccgtggtaataggcacattttgaaactgttttttttttctctgacaattgaatatattttatatatagttgattttgattattgaagactaaggaaaatttaagtttgaatgttagaaaatgaattttgcaaatttgaagtaattttattctttatgttttgggattgtagttatgttagatattcctcagttggggtaattgtcttgcatcattatctcttatcataatctgtttttcttcacacagtgttatagttttgccgctggactcttccctcccttcccccaccccatcaggatgatatgagacttgaaagaagacgatgcatacaggaggagagacttcagcatgcaaaccttcatctgttcggcttgcaccgtcattttcattccatgctgctggccttcagatggctggacagatgccccattcacatcagtacagtgaccgtcgccagccaaacataagtgaccaacaggtttctgccttatcatattctgaccagattcagcaacctctaactaaccagaggcggatgccccaaaccttccgtgacccagcaactgctcccctgagaaaactttctgttgacttgatcaaaacatacaagcatattaatgaggtttactatgcaaaaaagaagcgaagacaccaacagggccagggagacgattctagtcataagaaggaacggaaggtttacaatgatggttatgatgatgataactatgattatattgtaaaaaacggagaaaagtggatggatcgttacgaaattgactccttgataggcaaaggttcctttggacaggttgtaaaggcatatgatcgtgtggagcaagaatgggttgccattaaaataataaagaacaagaaggcttttctgaatcaagcacagatagaagtgcgacttcttgagctcatgaacaaacatgacactgaaatgaaatactacatagtgcatttgaaacgccactttatgtttcgaaaccatctctgtttagtttttgaaatgctgtcctacaacctctatgacttgctgagaaacaccaatttccgaggggtctctttgaacctaacacgaaagtttgcgcaacagatgtgcactgcactgcttttccttgcgactccagaacttagtatcattcactgtgatctaaaacctgaaaatatccttctttgtaaccccaaacgcagtgcaatcaagatagttgactttggcagttcttgtcagttggggcagaggatataccagtatattcagagtcgcttttatcggtctccagaggtgctactgggaatgccttatgaccttgccattgatatgtggtccctcgggtgtattttggttgaaatgcacactggagaacctctgttcagtggtgccaatgaggtagatcagatgaataaaatagtggaagttctgggtattccacctgctcatattcttgaccaagcaccaaaagcaagaaagttctttgagaagttgccagatggcacttggaacttaaagaagaccaaagatggaaaacgggagtacaaaccaccaggaacccgtaaacttcataacattcttggagtggaaacaggaggacctggtgggcgacgtgctggggagtcaggtcatacggtcgctgactacttgaagttcaaagacctcattttaaggatgcttgattatgaccccaaaactcgaattcaaccttattatgctctgcagcacagtttcttcaagaaaacagctgatgaaggtacaaatacaagtaatagtgtatctacaagccccgccatggagcagtctcagtcttcgggcaccacctccagtacatcgtcaagctcaggtggctcatcggggacaagcaacagtgggagagcccggtcggatccgacgcaccagcatcggcacagtggtgggcacttcacagctgccgtgcaggccatggactgcgagacacacagtccccaggtgcgtcagcaatttcctgctcctcttggttggtcaggcactgaagctcctacacaggtcactgttgaaactcatcctgttcaagaaacaacctttcatgtagcccctcaacagaatgcattgcatcatcaccatggtaacagttcccatcaccatcaccaccaccaccaccatcaccaccaccatggacaacaagccttgggtaaccggaccaggccaagggtctacaattctccaacgaatagctcctctacccaagattctatggaggttggccacagtcaccactccatgacatccctgtcttcctcaacgacttcttcctcgacatcttcctcctctactggtaaccaaggcaatcaggcctaccagaatcgcccagtggctgctaataccttggactttggacagaatggagctatggacgttaatttgaccgtctactccaatccccgccaagagactggcatagctggacatccaacataccaattttctgctaatacaggtcctgcacattacatgactgaaggacatctgacaatgaggcaaggggctgatagagaagagtcccccatgacaggagtttgtgtgcaacagagtcctgtagctagctcgtgactacattgaaacttgagtttgtttcttgtgtgtttttatagaagtggtgttttttttccaaaaacaaagtgcaaagctgcttgaatcaggaggagattaacacactgaaccgctacaagagggcaaagctgattttttttttaacttgaaaagattgcaaagggacattgaagtgtttaaaagagccatgtccaaacccatcttcatggatagctcagaggtatcctctttttgctcccccattttaacttgccacatcccagtcacagtggggtttttttgtctttctattcagcaaaagttaatattcagatgttggtcttggtcatttgccaactaattttaaagtaaaaggcactgcacataatttgcataaagggccccatgagggtgttttttttttttctttttgtcccccccatccccctttttttttgttttgttctgttttgttttgggtgggagggtgggaaatttgggtttttaagtcctctaaacacacttgggcacggaaatgcagtactgtaaggaagagggacctccagcttccacaaacaccatcttcagctgtatgaaagggacggttgtggtgaagtttgtcaggcacagtaagcatgctgagtggcggggatcagaactctcctatctgaacctactgaggagcaaagcagcaattacatgggatcctgtggctctcccgttgcagaggccacaggaagataggatggaacgtgactggtctcctaaccaaggtgcactgagaagcaatcaacgggtcggtcgtggccagtcctggggaggtctgagtggtggtctttgggataacctttggccttatggatttggactcgaaattagaagagcctaccatttcagatgcaatcacttttggacatgcttttgcagacagtccttaatgctgaaaacacagagaatgggtaattcaagaggcctttcttttaaaatagacttttgtgacccactaattgtaaggtattgcaaggtcactttgcgtgtgtcataaagttgacttccttattggttgaaggtcacagaagtagtggtttgctttgatggaaatagctacagctgtgtcccttcctgctttttactttttcttttgctttttctcggcacgtggtatctccaccatttcttctgcacaaagatgtcttctgttcatcctgaacatttttaaaaaatgcagaattttatgtgactgcttttttgcctcacaattatgctgtgaattttacaaaaatttattttcttttttgataatttattgtaccaaagctgtttttatagcacatagatgtctgtaaccaataatgtagcagttctgcactttgacacaaggtgtaactagaccatttttaaatgtcagttgaaaattatggctgtactattgcttaaacaaaactggaactgttgttgaatccatagccaatacatttacagcaatctgtgtactgaacatagtagattgacatctaattcaagattacaacatctgttacattctaagtgtgttcaggcttctgaaggtaaagggacactggatccagaagctatggaaccagcagttgattcttgtattcctgattaacctacttgtaaacttgaaagcaagaccttgattgcaccaacaggtccagagtatgagtgcaagcaaagcagaactctcatgcgtgacctgagcagacaggctggtatttaacaggtgcctcgtgttgagattacgctgccttaatgtaacacagtctggcagttgctaaatttgtgttcccattttaaattgaccaattttggggtgtgacacttttgagcggttgaattgggagaatgaagataagtaatttacctgtccaggatcaaaagaagcctagaaaagaagcagtaatctacctctgccgataacctgtttaagatgactcagcagaacaccgcgtttcattctattggtcaattccatgtggctgactaggtcaattttttttctgaacaaaagcaggtttttatatgtaaacagtgagaaaagaaaggctaaacactatgtaaatgtgaatggaaacttggaaatactcgtttttataaactacaaaaactttttgttgtttatcaggaaatccatatttattttgtaattaactgtcaagcctgtggatgatttttttgaacttggtagttcataaaggtttacagtgaataaaaggatatcatcttgagtatagcaatatcaaaaggaattcagtagttactgctgtttaggaatataaggttaagatatcatatgggtcaggtcattttttttttctgtgctggttgccacatcttagcaagcaccaaaaaactaaagcagtttttaaaccgatatttacgtaaagaaaatcataaaatccaatgcttctgcatactgtgttatgttacagtccagttttgtgtgctttactacacagtttggttacaggacttctgtgcattgtaaacataaacagcatggaaaaggttaaatacctgtgttcagattgtaagatctagtccggacttgctgtgtatattgtaacgttaaatgaaaaaagaacccccctttgtattatagtcatgcggtcttatgtatgataaacagttgaataatttgtcctcaga

SEQ ID NO: 8898 - DNA, 1590 bp, Homo sapiens
atgcatacaggaggagagacttcagcatgcaaaccttcatctgttcggcttgcaccgtcattttcattccatgctgctggccttcagatggctggacagatgccccattcacatcagtacagtgaccgtcgccagccaaacataagtgaccaacaggtttctgccttatcatattctgaccagattcagcaacctctaactaaccaggtgatgcctgatattgtcatgttacagaggcggatgccccaaaccttccgtgacccagcaactgctcccctgagaaaactttctgttgacttgatcaaaacatacaagcatattaatgaggtttactatgcaaaaaagaagcgaagacaccaacagggccagggagacgattctagtcataagaaggaacggaaggtttacaatgatggttatgatgatgataactatgattatattgtaaaaaacggagaaaagtggatggatcgttacgaaattgactccttgataggcaaaggttcctttggacaggttgtaaaggcatatgatcgtgtggagcaagaatgggttgccattaaaataataaagaacaagaaggcttttctgaatcaagcacagatagaagtgcgacttcttgagctcatgaacaaacatgacactgaaatgaaatactacatagtgcatttgaaacgccactttatgtttcgaaaccatctctgtttagtttttgaaatgctgtcctacaacctctatgacttgctgagaaacaccaatttccgaggggtctctttgaacctaacacgaaagtttgcgcaacagatgtgcactgcactgcttttccttgcgactccagaacttagtatcattcactgtgatctaaaacctgaaaatatccttctttgtaaccccaaacgcagtgcaatcaagatagttgactttggcagttcttgtcagttggggcagaggatataccagtatattcagagtcgcttttatcggtctccagaggtgctactgggaatgccttatgaccttgccattgatatgtggtccctcgggtgtattttggttgaaatgcacactggagaacctctgttcagtggtgccaatgaggtagatcagatgaataaaatagtggaagttctgggtattccacctgctcatattcttgaccaagcaccaaaagcaagaaagttctttgagaagttgccagatggcacttggaacttaaagaagaccaaagatggaaaacgggagtacaaaccaccaggaacccgtaaacttcataacattcttggagtggaaacaggaggacctggtgggcgacgtgctggggagtcaggtcatacggtcgctgactacttgaagttcaaagacctcattttaaggatgcttgattatgaccccaaaactcgaattcaaccttattatgctctgcagcacagtttcttcaagaaaacagctgatgaaggtacaaatacaagtaatagtgtatctacaagccccgccatggagcagtctcagtcttcgggcaccacctccagtacatcgtcaagctcaggtgcgtcagcaatttcctgctcctcttggttggtcaggcactga

SEQ ID NO: 8899 - DNA, 2422 bp, Homo sapiens
gttatagttttgccgctggactcttccctcccttcccccaccccatcaggatgatatgagacttgaaagaagacgatgcatacaggaggagagacttcagcatgcaaaccttcatctgttcggcttgcaccgtcattttcattccatgctgctggccttcagatggctggacagatgccccattcacatcagtacagtgaccgtcgccagccaaacataagtgaccaacaggtttctgccttatcatattctgaccagattcagcaacctctaactaaccaggtgatgcctgatattgtcatgttacagaggcggatgccccaaaccttccgtgacccagcaactgctcccctgagaaaactttctgttgacttgatcaaaacatacaagcatattaatgaggtttactatgcaaaaaagaagcgaagacaccaacagggccagggagacgattctagtcataagaaggaacggaaggtttacaatgatggttatgatgatgataactatgattatattgtaaaaaacggagaaaagtggatggatcgttacgaaattgactccttgataggcaaaggttcctttggacaggttgtaaaggcatatgatcgtgtggagcaagaatgggttgccattaaaataataaagaacaagaaggcttttctgaatcaagcacagatagaagtgcgacttcttgagctcatgaacaaacatgacactgaaatgaaatactacatagtgcatttgaaacgccactttatgtttcgaaaccatctctgtttagtttttgaaatgctgtcctacaacctctatgacttgctgagaaacaccaatttccgaggggtctctttgaacctaacacgaaagtttgcgcaacagatgtgcactgcactgcttttccttgcgactccagaacttagtatcattcactgtgatctaaaacctgaaaatatccttctttgtaaccccaaacgcagtgcaatcaagatagttgactttggcagttcttgtcagttggggcagaggatataccagtatattcagagtcgcttttatcggtctccagaggtgctactgggaatgccttatgaccttgccattgatatgtggtccctcgggtgtattttggttgaaatgcacactggagaacctctgttcagtggtgccaatgaggtagatcagatgaataaaatagtggaagttctgggtattccacctgctcatattcttgaccaagcaccaaaagcaagaaagttctttgagaagttgccagatggcacttggaacttaaagaagaccaaagatggaaaacgggagtacaaaccaccaggaacccgtaaacttcataacattcttggagtggaaacaggaggacctggtgggcgacgtgctggggagtcaggtcatacggtcgctgactacttgaagttcaaagacctcattttaaggatgcttgattatgaccccaaaactcgaattcaaccttattatgctctgcagcacagtttcttcaagaaaacagctgatgaaggtacaaatacaagtaatagtgtatctacaagccccgccatggagcagtctcagtcttcgggcaccacctccagtacatcgtcaagctcaggtggctcatcggggacaagcaacagtgggagagcccggtcggatccgacgcaccagcatcggcacagtggtgggcacttcacagctgccgtgcaggccatggactgcgagacacacagtccccaggtgcgtcagcaatttcctgctcctcttggttggtcaggcactgaagctcctacacaggtcactgttgaaactcatcctgttcaagaaacaacctttcatgtagcccctcaacagaatgcattgcatcatcaccatggtaacagttcccatcaccatcaccaccaccaccaccatcaccaccaccatggacaacaagccttgggtaaccggaccaggccaagggtctacaattctccaacgaatagctcctctacccaagattctatggaggttggccacagtcaccactccatgacatccctgtcttcctcaacgacttcttcctcgacatcttcctcctctactggtaaccaaggcaatcaggcctaccagaatcgcccagtggctgctaataccttggactttggacagaatggagctatggacgttaatttgaccgtctactccaatccccgccaagagactggcatagctggacatccaacataccaattttctgctaatacaggtcctgcacattacatgactgaaggacatctgacaatgaggcaaggggctgatagagaagagtcccccatgacaggagtttgtgtgcaacagagtcctgtagctagctcgtgactacattgaaacttgagtttgtttcttgtgtgtttttatagaagtggtgtttttt

SEQ ID NO: 8900 - DNA, 519 bp, Homo sapiens
gctgagactcaccggaggaagcggcgcgagcgccccgccatcgtcccgtgttatagttttgccgctggactcttccctcccttcccccaccccatcaggatgatatgagacttgaaagaagacgatgcatacaggaggagagacttcagcatgcaaaccttcatctgttcggcttgcaccgtcattttcattccatgctgctggccttcagatggctggacagatgccccattcacatcagtacagtgaccgtcgccagccaaacataagtgaccaacaggtttctgccttatcatattctgaccagattcagcaacctctaactaaccaggtgatgcctgatattgtcatgttacagaggcggatgccccaaaccttccgtgacccagcaactgctcccctgagaaaactttctgttgacttgatcaaaacatacaagcatattaatgaggtttactatgcaaaaaagaagcgaagacaccaacagggccagggagacgattctagtcataagaagga

SEQ ID NO: 8901 - DNA, 3225 bp, Homo sapiens
aaaaataactcatattgtctctgaggttcttttccagtgaagtgtttagtattgctgctatttggagtacaaagttggagcttttaaagaacctgggagttcaaaagtataaggagaaataaatgaaaagcagaaatattttgaggcaataagtatagactcaaatctatattatgacccacttgtagcaccacttggaattctaccaataagagatttatttgggcaaactataatggttgttggaaattgcaaatcttagtgtgaattattttagtccagttggtttctttctttctcttacctgaaatgaactatactgaggcaataggagctttgtatagtaatttaggagtgtaaaacaacttagggaaaaggattattaagcaggatgattgggatgacatcatgtgaaatttaggaattggaggcattgggaattgagagggtgctaacaaaggaaaacagcttattttagaatttgtctggaggatgtagaattgaagaagttttggtatttcttctgcagcggccccagtgcccttgaccaggaacatctcttggagtcagtagttttcatgaggctgacctaggaacttggccaacatatgcaacattgttctatttaaaatattccttgaattaaattcgatagtatcaatttaaaacataaagttttcactcaactcctttagaagttagattttagcttgtacttgtctttacctcttctgctgattatcagttgacaacactgagattactttcattttcctgtaagtcattatgaatttttctggtcaaccatgagttatcagtggaagcaataagtaggaagtactgtaaaagaattacaataaaataagagaaaccacttggagagcaagagggcttgtggacttgggggagcggttgtgagaaatgtctcagaacttaatttacaaataacattggtagattgacatgttgtctttcctataaagtaactttacctctgtcttaatagtaaactactatgaaagtgaattcgtgttcctcttgatttgtgaactgatgaaaattacaaaatgtggagttttttccccagataaagtaaatggtggaatattcaggtttatttgatacctagaaaatacctgaaattttccgtggtaataggcacattttgaaactgttttttttttctctgacaattgaatatattttatatatagttgattttgattattgaagactaaggaaaatttaagtttgaatgttagaaaatgaattttgcaaatttgaagtaattttattctttatgttttgggattgtagttatgttagatattcctcagttggggtaattgtcttgcatcattatctcttatcataatctgtttttcttcacacagtgttatagttttgccgctggactcttccctcccttcccccaccccatcaggatgatatgagacttgaaagaagacgatgcatacaggaggagagacttcagcatgcaaaccttcatctgttcggcttgcaccgtcattttcattccatgctgctggccttcagatggctggacagatgccccattcacatcagtacagtgaccgtcgccagccaaacataagtgaccaacaggtttctgccttatcatattctgaccagattcagcaacctctaactaaccaggtgatgcctgatattgtcatgttacagaggcggatgccccaaaccttccgtgacccagcaactgctcccctgagaaaactttctgttgacttgatcaaaacatacaagcatattaatgaggtttactatgcaaaaaagaagcgaagacaccaacagggccagggagacgattctagtcataagaaggaacggaaggtttacaatgatggttatgatgatgataactatgattatattgtaaaaaacggagaaaagtggatggatcgttacgaaattgactccttgataggcaaaggttcctttggacaggttgtaaaggcatatgatcgtgtggagcaagaatgggttgccattaaaataataaagaacaagaaggcttttctgaatcaagcacagatagaagtgcgacttcttgagctcatgaacaaacatgacactgaaatgaaatactacatagtgcatttgaaacgccactttatgtttcgaaaccatctctgtttagtttttgaaatgctgtcctacaacctctatgacttgctgagaaacaccaatttccgaggggtctctttgaacctaacacgaaagtttgcgcaacagatgtgcactgcactgcttttccttgcgactccagaacttagtatcattcactgtgatctaaaacctgaaaatatccttctttgtaaccccaaacgcagtgcaatcaagatagttgactttggcagttcttgtcagttggggcagaggatataccagtatattcagagtcgcttttatcggtctccagaggtgctactgggaatgccttatgaccttgccattgatatgtggtccctcgggtgtattttggttgaaatgcacactggagaacctctgttcagtggtgccaatgaggtagatcagatgaataaaatagtggaagttctgggtattccacctgctcatattcttgaccaagcaccaaaagcaagaaagttctttgagaagttgccagatggcacttggaacttaaagaagaccaaagatggaaaacgggagtacaaaccaccaggaacccgtaaacttcataacattcttggagtggaaacaggaggacctggtgggcgacgtgctggggagtcaggtcatacggtcgctgactacttgaagttcaaagacctcattttaaggatgcttgattatgaccccaaaactcgaattcaaccttattatgctctgcagcacagtttcttcaagaaaacagctgatgaaggtacaaatacaagtaatagtgtatctacaagccccgccatggagcagtctcagtcttcgggcaccacctccagtacatcgtcaagctcaggtggctcatcggggacaagcaacagtgggagagcccggtcggatccgacgcaccagcatcggcacagtggtgggcacttcacagctgccgtgcaggccatggactgcgagacacacagtccccaggtgagctcgcacgtggttcatttgcttgtgtcacctgccattctcaggtggagcagcactggatgccaggtgcctttagaatga

SEQ ID NO: 8902 - DNA, 338 bp, Homo sapiens
gctgagactcaccggaggaagcggcgcgagcgccccgccatcgtcccggatctcaccctgttgcccaggctggagtgcagtggcatgatcagggctcactgcagccttgacttcctggaatcagtgttatagttttgccgctggactcttccctcccttcccccaccccatcaggatgatatgagacttgaaagaagacgatgcatacaggaggagagacttcagcatgcaaaccttcatctgttcggcttgcaccgtcattttcattccatgctgctggccttcagatggctggacagatgccccattcacatcagtacagtgaccgtcgccagcca

SEQ ID NO: 8903 - DNA, 1735 bp, Homo sapiens
agcagttactttttgcattcatttagtggcacctgcttaaccaggagattaaaagccatccacagaccatgattgtgagtgcatttgaaacgccactttatgtttcgaaaccatctctgtttagtttttgaaatgctgtcctacaacctctatgacttgctgagaaacaccaatttccgaggggtctctttgaacctaacacgaaagtttgcgcaacagatgtgcactgcactgcttttccttgcgactccagaacttagtatcattcactgtgatctaaaacctgaaaatatccttctttgtaaccccaaacgcagtgcaatcaagatagttgactttggcagttcttgtcagttggggcagaggatataccagtatattcagagtcgcttttatcggtctccagaggtgctactgggaatgccttatgaccttgccattgatatgtggtccctcgggtgtattttggttgaaatgcacactggagaacctctgttcagtggtgccaatgaggtagatcagatgaataaaatagtggaagttctgggtattccacctgctcatattcttgaccaagcaccaaaagcaagaaagttctttgagaagttgccagatggcacttggaacttaaagaagaccaaagatggaaaacgggagtacaaaccaccaggaacccgtaaacttcataacattcttggagtggaaacaggaggacctggtgggcgacgtgctggggagtcaggtcatacggtcgctgactacttgaagttcaaagacctcattttaaggatgcttgattatgaccccaaaactcgaattcaaccttattatgctctgcagcacagtttcttcaagaaaacagctgatgaaggtacaaatacaagtaatagtgtatctacaagccccgccatggagcagtctcagtcttcgggcaccacctccagtacatcgtcaagctcaggtggctcatcggggacaagcaacagtgggagagcccggtcggatccgacgcaccagcatcggcacagtggtgggcacttcacagctgccgtgcaggccatggactgcgagacacacagtccccaggtgcgtcagcaatttcctgctcctcttggttggtcaggcactgaagctcctacacaggtcactgttgaaactcatcctgttcaagaaacaacctttcatgtagcccctcaacagaatgcattgcatcatcaccatggtaacagttcccatcaccatcaccaccaccaccaccatcaccaccaccatggacaacaagccttgggtaaccggaccaggccaagggtctacaattctccaacgaatagctcctctacccaagattctatggaggttggccacagtcaccactccatgacatccctgtcttcctcaacgacttcttcctcgacatcttcctcctctactggtaaccaaggcaatcaggcctaccagaatcgcccagtggctgctaataccttggactttggacagaatggagctatggacgttaatttgaccgtctactccaatccccgccaagagactggcatagctggacatccaacataccaattttctgctaatacaggtcctgcacattacatgactgaaggacatctgacaatgaggcaaggggctgatagagaagagtcccccatgacaggagtttgtgtgcaacagagtcctgtagctagctcgtgactacattgaaacttgagtttgtttcttg

SEQ ID NO: 8904 - DNA, 2532 bp, Homo sapiens
gggatgggggcggagtccagggcgtgggggggccggtttgttgtggtcgccattttgctggttgcattactgggtaatcggggccctggcttgccgcgtccgccggataccctcagccagtgggcaggtctgagctcgggctccccgagcagtttgagtccccttgcccgctccttcaggtctcagcggcggtggcagccgaggtgcaggatgcaagaaggcgccccccggccgggctcccgctccaggcctcgctcccctgcggccctctgagcccaccatggccgtcccaccgggccatggtcccttctctggcttcccagggccccaggagcacacgcaggtattgcctgatgtgcggctactgcctcggaggctgcccctggccttccgggatgcaacctcagccccgctgcgtaagctctctgtggacctcatcaagacctacaagcacatcaatgaggtatactatgcgaagaagaagcggcgggcccagcaggcgccaccccaggattcgagcaacaagaaggagaagaaggtcctgaaccatggttatgatgacgacaaccatgactacatcgtgcgcagtggcgagcgctggctggagcgctacgaaattgactcgctcattggcaaaggctcctttggccaggtggtgaaagcctatgatcatcagacccaggagcttgtggccatcaagatcatcaagaacaaaaaggctttcctgaaccaggcccagattgagctgcggctgctggagctgatgaaccagcatgacacggagatgaagtactatatagtacacctgaagcggcacttcatgttccggaaccacctgtgcctggtatttgagctgctgtcctacaacctgtacgacctcctgcgcaacacccacttccgcggcgtctcgctgaacctgacccggaagctggcgcagcagctctgcacggcactgctctttctggccacgcctgagctcagcatcattcactgcgacctcaagcccgaaaacatcttgctgtgcaaccccaagcgcagcgccatcaagattgtggacttcggcagctcctgccagcttggccagaggatctaccagtatatccagagccgcttctaccgctcacctgaggtgctcctgggcacaccctacgacctggccattgacatgtggtccctgggctgcatccttgtggagatgcacaccggagagcccctcttcagtggctccaatgaggtcgaccagatgaaccgcattgtggaggtgctgggcatcccaccggccgccatgctggaccaggcgcccaaggctcgcaagtactttgaacggctgcctgggggtggctggaccctacgaaggacgaaagaactcaggaaggattaccagggccccgggacacggcggctgcaggaggtgctgggcgtgcagacgggcgggcccgggggccggcgggcgggggagccgggccacagccccgccgactacctccgcttccaggacctggtgctgcgcatgctggagtatgagcccgccgcccgcatcagccccctgggggctctgcagcacggcttcttccgccgcacggccgacgaggccaccaacacgggcccggcaggcagcagtgcctccacctcgcccgcgcccctcgacacctgcccctcttccagcaccgccagctccatctccagttctggaggctccagtggctcctccagtgacaaccggacctaccgctacagcaaccgatattgtgggggccctgggccccctatcacagactgtgagatgaacagcccccaggtcccaccctcccagccgctgcggccctgggcagggggtgatgtgccccacaagacacatcaagcccctgcctctgcctcgtcactgcctgggaccggggcccagttacccccccagccccgataccttggtcgtcccccatcaccaacctcaccaccacccccggagctgatggatgtgagcctggtgggcggccctgctgactgctccccacctcacccagcgcctgccccccagcacccggctgcctcagccctccggactcggatgactggaggtcgtccacccctcccgcctcctgatgaccctgccactctggggcctcacctgggcctccgtggtgtaccccagagcacagcagccagctcgtgaccctgccccctccctggggcccctcctgaagccataccctcccccatctgggggccctgggctcccatcctcatctctctccttgactggaattgctgctacccagctggggtgggtgaggcctgcactgattggggcctggggcaggggggtcaaggagagggttttggccgctccctccccactaaggactggacccttgggcccctctccccctttttttctatttattgtaccaaagacagtggtggtccggtggagggaagaccccccctcaccccaggaccctaggagggggtgggggcaggtagggggagatggccttgctcctcctcgctgtacccccagtaaagagctttctc

SEQ ID NO: 8905 - DNA, 2448 bp, Homo sapiens
gggatgggggcggagtccagggcgtgggggggccggtttgttgtggtcgccattttgctggttgcattactgggtaatcggggccctggcttgccgcgtccgccggataccctcagccagtgggcaggtctgagctcgggctccccgagcagtttgagtccccttgcccgctccttcaggtctcagcggcggtggcagccgaggtgcaggatgcaagaaggcgccccccggccgggctcccgctccaggcctcgctcccctgcggccctctgagcccaccatggccgtcccaccgggccatggtcccttctctggcttcccagggccccaggagcacacgcaggtattgcctgatgtgcggctactgcctcggaggctgcccctggccttccgggatgcaacctcagccccgctgcgtaagctctctgtggacctcatcaagacctacaagcacatcaatgaggtatactatgcgaagaagaagcggcgggcccagcaggcgccaccccaggattcgagcaacaagaaggagaagaaggtcctgaaccatggttatgatgacgacaaccatgactacatcgtgcgcagtggcgagcgctggctggagcgctacgaaattgactcgctcattggcaaaggctcctttggccaggtggtgaaagcctatgatcatcagacccaggagcttgtggccatcaagatcatcaagaacaaaaaggctttcctgaaccaggcccagattgagctgcggctgctggagctgatgaaccagcatgacacggagatgaagtactatatagtacacctgaagcggcacttcatgttccggaaccacctgtgcctggtatttgagctgctgtcctacaacctgtacgacctcctgcgcaacacccacttccgcggcgtctcgctgaacctgacccggaagctggcgcagcagctctgcacggcactgctctttctggccacgcctgagctcagcatcattcactgcgacctcaagcccgaaaacatcttgctgtgcaaccccaagcgcagcgccatcaagattgtggacttcggcagctcctgccagcttggccagaggatctaccagtatatccagagccgcttctaccgctcacctgaggtgctcctgggcacaccctacgacctggccattgacatgtggtccctgggctgcatccttgtggagatgcacaccggagagcccctcttcagtggctccaatgaggtcgaccagatgaaccgcattgtggaggtgctgggcatcccaccggccgccatgctggaccaggcgcccaaggctcgcaagtactttgaacggctgcctgggggtggctggaccctacgaaggacgaaagaactcaggaaggattaccagggccccgggacacggcggctgcaggaggacctggtgctgcgcatgctggagtatgagcccgccgcccgcatcagccccctgggggctctgcagcacggcttcttccgccgcacggccgacgaggccaccaacacgggcccggcaggcagcagtgcctccacctcgcccgcgcccctcgacacctgcccctcttccagcaccgccagctccatctccagttctggaggctccagtggctcctccagtgacaaccggacctaccgctacagcaaccgatattgtgggggccctgggccccctatcacagactgtgagatgaacagcccccaggtcccaccctcccagccgctgcggccctgggcagggggtgatgtgccccacaagacacatcaagcccctgcctctgcctcgtcactgcctgggaccggggcccagttacccccccagccccgataccttggtcgtcccccatcaccaacctcaccaccacccccggagctgatggatgtgagcctggtgggcggccctgctgactgctccccacctcacccagcgcctgccccccagcacccggctgcctcagccctccggactcggatgactggaggtcgtccacccctcccgcctcctgatgaccctgccactctggggcctcacctgggcctccgtggtgtaccccagagcacagcagccagctcgtgaccctgccccctccctggggcccctcctgaagccataccctcccccatctgggggccctgggctcccatcctcatctctctccttgactggaattgctgctacccagctggggtgggtgaggcctgcactgattggggcctggggcaggggggtcaaggagagggttttggccgctccctccccactaaggactggacccttgggcccctctccccctttttttctatttattgtaccaaagacagtggtggtccggtggagggaagaccccccctcaccccaggaccctaggagggggtgggggcaggtagggggagatggccttgctcctcctcgctgtacccccagtaaagagctttctc

SEQ ID NO: 8906 - DNA, 2412 bp, Homo sapiens
gggatgggggcggagtccagggcgtgggggggccggtttgttgtggtcgccattttgctggttgcattactgggtaatcggggccctggcttgccgcgtccgccggataccctcagccagtgggcaggtctgagctcgggctccccgagcagtttgagtccccttgcccgctccttcaggtctcagcggcggtggcagccgaggtgcaggatgcaagaaggcgccccccggccgggctcccgctccaggcctcgctcccctgcggccctctgagcccaccatggccgtcccaccgggccatggtcccttctctggcttcccagggccccaggagcacacgcaggtattgcctgatgtgcggctactgcctcggaggctgcccctggccttccgggatgcaacctcagccccgctgcgtaagctctctgtggacctcatcaagacctacaagcacatcaatgaggtatactatgcgaagaagaagcggcgggcccagcaggcgccaccccaggattcgagcaacaagaaggagaagaaggtcctgaaccatggttatgatgacgacaaccatgactacatcgtgcgcagtggcgagcgctggctggagcgctacgaaattgactcgctcattggcaaaggctcctttggccaggtggtgaaagcctatgatcatcagacccaggagcttgtggccatcaagatcatcaagaacaaaaaggctttcctgaaccaggcccagattgagctgcggctgctggagctgatgaaccagcatgacacggagatgaagtactatatagtacacctgaagcggcacttcatgttccggaaccacctgtgcctggtatttgagctgctgtcctacaacctgtacgacctcctgcgcaacacccacttccgcggcgtctcgctgaacctgacccggaagctggcgcagcagctctgcacggcactgctctttctggccacgcctgagctcagcatcattcactgcgacctcaagcccgaaaacatcttgctgtgcaaccccaagcgcagcgccatcaagattgtggacttcggcagctcctgccagcttggccagaggatctaccagtatatccagagccgcttctaccgctcacctgaggtgctcctgggcacaccctacgacctggccattgacatgtggtccctgggctgcatccttgtggagatgcacaccggagagcccctcttcagtggctccaatgaggtcgaccagatgaaccgcattgtggaggtgctgggcatcccaccggccgccatgctggaccaggcgcccaaggctcgcaagtactttgaacggctgcctgggggtggctggaccctacgaaggacgaaagaactcaggaaggacctggtgctgcgcatgctggagtatgagcccgccgcccgcatcagccccctgggggctctgcagcacggcttcttccgccgcacggccgacgaggccaccaacacgggcccggcaggcagcagtgcctccacctcgcccgcgcccctcgacacctgcccctcttccagcaccgccagctccatctccagttctggaggctccagtggctcctccagtgacaaccggacctaccgctacagcaaccgatattgtgggggccctgggccccctatcacagactgtgagatgaacagcccccaggtcccaccctcccagccgctgcggccctgggcagggggtgatgtgccccacaagacacatcaagcccctgcctctgcctcgtcactgcctgggaccggggcccagttacccccccagccccgataccttggtcgtcccccatcaccaacctcaccaccacccccggagctgatggatgtgagcctggtgggcggccctgctgactgctccccacctcacccagcgcctgccccccagcacccggctgcctcagccctccggactcggatgactggaggtcgtccacccctcccgcctcctgatgaccctgccactctggggcctcacctgggcctccgtggtgtaccccagagcacagcagccagctcgtgaccctgccccctccctggggcccctcctgaagccataccctcccccatctgggggccctgggctcccatcctcatctctctccttgactggaattgctgctacccagctggggtgggtgaggcctgcactgattggggcctggggcaggggggtcaaggagagggttttggccgctccctccccactaaggactggacccttgggcccctctccccctttttttctatttattgtaccaaagacagtggtggtccggtggagggaagaccccccctcaccccaggaccctaggagggggtgggggcaggtagggggagatggccttgctcctcctcgctgtacccccagtaaagagctttctc

SEQ ID NO: 8907 - DNA, 566 bp, Homo sapiens
ttcctccgtctttctttggaagagggttgtcgctgcccagcggggttggagggggggtctgggtgactttctcccccctgaccctcttttgtctcctcccgcacgtggcttccaggccgaggtggggacagcgccgttcgtcagcttcaggcttccccggggctcggtgcaggggccacccggagcggagtggggactggcccgccctcccccatcgccctgccgcctctccgggccagcaacgctgccgccgcagcccacacgattggcggcagtaagcacacaatgaatgatcacctgcatgtcggcagccacgctcacggacagatccaggttcaacagttgtttgaggataacagtaacaagcggacagtgctcacgacacaaccaaatgggcttacaacagtgggcaaaacgggcttgccagtggtgccagagcggcagctggacagcattcatagacggcaggggagctccacctctctaaagtccatggaaggcatggggaaggtgaaagccacccccatgacacctgaacaagcaatgaagcaatacatgcaaaaact

SEQ ID NO: 8908 - DNA, 8912 bp, Homo sapiens
gtgtgtgagtgcgcgggggcgcgcgcgcgcgggcccgggagaggctcccgagccaggcggtcttcggtcctcgcagcgcttccagctccccgcgcccctatgtgagggagacggggaggcccgcggcgcgcaggggagggcgaggcatgtgcacgggccggagggtgctgcagccgcccgaggaagaggaggacggcggcgaggaggagagcggggggctcgcggcggcgggccccggccgaggggatgcagtggactgtgtgtgtctggctgtagcagacgcgaggcggcgacgaggcgccggggacccgcgcgaggggcggccgggaggcggcggcggcggccgccagaagtagcagcaggaccggcggcggcgacggcagccctgaaatgcattttcctctccagcggccatgttaaccaggaaaccttcggccgccgctcccgccgcctacccgaccggccgaggtggggacagcgccgttcgtcagcttcaggcttccccggggctcggtgcaggggccacccggagcggagtggggactggcccgccctcccccatcgccctgccgcctctccgggccagcaacgctgccgccgcagcccacacgattggcggcagtaagcacacaatgaatgatcacctgcatgtcggcagccacgctcacggacagatccaggttcaacagttgtttgaggataacagtaacaagcggacagtgctcacgacacaaccaaatgggcttacaacagtgggcaaaacgggcttgccagtggtgccagagcggcagctggacagcattcatagacggcaggggagctccacctctctaaagtccatggaaggcatggggaaggtgaaagccacccccatgacacctgaacaagcaatgaagcaatacatgcaaaaactcacagccttcgaacaccatgagattttcagctaccctgaaatatatttcttgggtctaaatgctaagaagcgccagggcatgacaggtgggcccaacaatggtggctatgatgatgaccagggatcatatgtgcaggtgccccacgatcacgtggcttacaggtatgaggtcctcaaggtcattgggaaggggagctttgggcaggtggtcaaggcctacgatcacaaagtccaccagcacgtggccctaaagatggtgcggaatgagaagcgcttccaccggcaagcagcggaggagatccgaatcctggaacacctgcggaagcaggacaaggataacacaatgaatgtcatccatatgctggagaatttcaccttccgcaaccacatctgcatgacgtttgagctgctgagcatgaacctctatgagctcatcaagaagaataaattccagggcttcagtctgcctttggttcgcaagtttgcccactcgattctgcagtgcttggatgctttgcacaaaaacagaataattcactgtgaccttaagcccgagaacattttgttaaagcagcagggtagaagcggtattaaagtaattgattttggctccagttgttacgagcatcagcgtgtctacacgtacatccagtcgcgtttttaccgggctccagaagtgatccttggggccaggtatggcatgcccattgatatgtggagcctgggctgcattttagcagagctcctgacgggttaccccctcttgcctggggaagatgaaggggaccagctggcctgtatgattgaactgttgggcatgccctcacagaaactgctggatgcatccaaacgagccaaaaattttgtgagctccaagggttatccccgttactgcactgtcacgactctctcagatggctctgtggtcctaaacggaggccgttcccggagggggaaactgaggggcccaccggagagcagagagtgggggaacgcgctgaaggggtgtgatgatccccttttccttgacttcttaaaacagtgtttagagtgggatcctgcagtgcgcatgaccccaggccaggctttgcggcacccctggctgaggaggcggttgccaaagcctcccaccggggagaaaacgtcagtgaaaaggataactgagagcaccggtgctatcacatctatatccaagttacctccaccttctagctcagcttccaaactgaggactaatttggcgcagatgacagatgccaatgggaatattcagcagaggacagtgttgccaaaacttgttagctgagctcacgtcccctgatgctggtaacctgaaagatacgacattgctgagccttactgggttgaaaaggagtagctcagacctgtttttatttgctcaataactctactcatttgtatcttttcagcacttaattttaatgtaagaaagttgttcattttgtttttataaaatacatgaggacaatgctttaagtttttatactttcagaaactttttgtgttctaaaagtacaatgagccttactgtatttagtgtggcagaataataacatcagtggcaggccactgattacttcatgactgccacgcatttacagattggtgtcaaagacattcactatgtttttatggttcatgttatatcctccccagggtgacagccccttaaggccctccttttccctccatgctccaggtccatgcacaggtgtagcatgtcctgcttccgtttttcataaattaatctgggtgttgggggtagtgggaggagaacggtcagaatcaaagtgacattctaagaaaaactgtaccttagagattttcctctagtgctcaaacaaatacaaaataagatccccaaggtttaaactgcccagttagcattctgacattctaaaagccggcaaagcagcttttagtggataaatgggaatggaaacgtgtgtgttcctccaaattttctagtatgatcggtgagctgttttgtaaagaagcctcatattacagagttgcttttgcacctaaatttagaattgtattccatgaactgttcctcccttttctctgcttttctcctctctgttcctcttttaataccacacgtctgttgcttgcatttagtttgtcttcttccttcagctgtgtatcccagactgttaatacagaaaagagacatttcagctgtgattatgaccattgtttcatattccaattaaaaaaagaacagcagcctagctacttaaggtggggatttccatagttccaaagaagatttagcagattagagtgagttcacacttttcaggtgccactgtaaggttctctcagcctgggaaactatcaactctttctttaaaaagaaagagggttgaaaatcctctggacgaacagaagtcactttggctgttcagtaaggccaatgttaacaacacgtttagaggaggaaaagttcaacctcaagttaaatggtttgacttattcttcgtatcattagaagaaccccagagatagcattcctctattttattttactttcttttggattgcactgattgtttttgtgggaatgacactttatctggcaaagtaactgagagtttggtaaaagaatattttcttctctgaataataattattttcacagtgaaaatttcagtattttatcactaatgtatgagcaatgatctatatcaatttcaaggcacgtgaaaaaaattttttagtatgtgcaatttaatatagaaagatttctgcctgtttggacaataggttttgggtagtacagattaggataagtaagcttatatatgcacagagattattgtattacctgtaaattgatttacaagtacttaaaagcgtggtccccagtgaggccaagaaagtttccggttaagttctttaataataatcctacagtttatcttaagaaaaaaaaaaaggtttgaaaaaaacactttaatttaggcttcgttggttgatggtggaaaaaaatgctcaggaaatatttcagatatttgccaaaaaaccagtaataaggttaccttattaaaatagtgatatttgctttactatttaaggtgtcactgataaattaatttgtacttctgtgtttagaaattatagcttcttttcccttagtcaaattttttagcatattatacacatttctgtgtaatctgtggaagtgcaataatatgttagtaagttacattttaaataatgctcatgtgacaatactcccaatcaatggcttatagaatttaaagatctgtatattagattttggcttaaaggcatgagaagtataagacttggtttggtggctttgtaagaccaccagcctcttaatgatggttagcttctttaggtcattaaatcaataaaaacatataatgctgttttgctcttctaatgctcctcttccatttccagttatcttcacatttacatttaaatatacaaacctgagcctgccattattaatttccctataaaatgacgatacatgtgaacatttataaatggactaatactgcttgtctttcccccaccgcacaaaactggttcttaagatgccagcaatgaatttgagactatctttatttataaatggaaaccggaaacttttataccaaactataataatgtgcagcactgtagggcttttttttttttccctccaaatacagtgaaatttttttattcacaagagctgccacatctcagcatttagtaatagagctgctttaataaaattctagtttgattgtcatgtcaaaaaaagaaaaatgttgcatctttgtgattttaaaacataaattaatgaaggctctgataggctattaggagttggcttggaaacagtttttggtctcacaggttaccattgtttggggatgtctgagctgttttcagatctaggaatagcacagtgttgtcttgtctttggcagtctcatttggctctgtttcttgcaccaccagcgtgttcattaccacttaaatatattgctacagcagtggaacaacagagtggtgcaagacactgtagattaacggtagaggagaaattgtgcccttagtgttaacaatgtgccttttgttctgaatgccatgttgtagggcatgcattttttggcctctttaactcttcgaattctagtcagtaagaatggaacccatctctgcaaagatacatctgtcttaaatatctagttacaggccttaatagaaaccataaggcatgactcatcttcaggcactgaaaaaagataaccatcaggtagtgttacacaaggacttcctatatttaaggggttaaagatggtctttgttgtatcttaacatcagactgatttttacattttttttttgttatgctaacactagacaaaaatcaactgtatttgtaaaaatttacctcaaaccatttaattttatagtgtgattaatcccagggcatttggtatgaaccaaagtgcattccttttatatgtgcctggctctagtaaggatggccagggatttttacaatttgggtgcaaggcacttaagccacttttaaacttaatgggtggtttggggtcgtgttaaatgactccatcagaatgttagaaaacactttaggcatcagtagcattgggccatattggaatcctaaagtgtgaattattttaaggagagcattcatttttgtaatttttttcatcaaaaatatttctggtaagcagaagactttttaaaaaaactgatctggtctcggtaaaggttttaatattgcccaacataatgctgtaatagcattaaaaaaagtatttgtgaactctgtttcttaggggcttgtacatctctctgctatggacatacataaaattaattgtaattatactcagctcaactgctacagttctgtctaggcagtggcttgggtttttatcgagcaacaacttagacacgtgactgtaatatgctgcaactgtgtgtactgaaaatatgtgaaaatggttgaatgtggactgtgtatatatgtatgtaaaaatttctgtgagatgctgctgtcgccacttaacattaaatatgttctagtggattttaatcctagtggccagttctatgatactgtatgtattatacagctgatgacaggagtaagactgtttagtgaatatctgttaaattttattgttgtggccagagataatttcagaataaaattttaatgtcctaccttacttctctcccctttctaactataatttaactcctgatctatttctggtattatcctttgtcaattagcctggagagggtttagaatgcaaaatggatagctctatatcagggtcttgagaagttaaaataattcattctactagtttgttcatagcaatactttattagttcaatataagtatgcagattccaagtggaaaaacaaaggttttagtaagtagttcttgcttttcccaggatattctattccttcacctgtcagatttttatgttaacttttttatatatagcctctgctgtgttctttattatgctagagcttcatatcttcttttattttaaccttcacaatgatagttaagctgggggagcagaacctgtcaattattccccaccagtcttcattcttttctctgcacaagttctggtaaattattctaatgtgctctaaccagttccacccaatgttttttaatgcttatgagtttgcagtttttgtacttggtggtctctgtggttcacatttttttgtgttgtagtgtctcctgcctcggttggctcagaaaataaggcctaggaactgcaattagctcatgatttgtcaagttcagttagtaccaagctaagagtttacttacagatgacagcaagcagatgctctagtaattcgtcagacattgcagggatattgtgtagtcagatattaccctcttgtggaaagaactacctcacatcattatttatttcccttctgttaccaacagccaaggaattacttagtgtggctccctgcatcaatactgggatatgcttaaacaagggaatgccataagagttcccaattgcctcgtcatagcctgggccatagatttttgttactgctaatcttgcttcttaaagttcacacccagtgcaaaaaacccaatcagcaaactaaccccaaaatccaatatatttagaaatgtaagtgttaagagatgtgcattatgtacaaaattgaaaattggtgctaaagtggcaatgtcaatttaaaatttcttgtccagatctgactgactgactcaggagattatagttcctactcattctctttccttttatcagatctttcaaaagcgctttttaaaattgatcaatgtgcaattctgtttgagtctctacagtcctatcccttttggaatgaacagctacacaaataaatattcttggaacttcgaagttgtcttcaaactagctctagaaaatgtccctagttgacattagtgttggtctgttagaaggggaaattgatttgactgcttcatgttttgaaaagagcattaagagggatttgaggaaggtatatgtggctttctttttttttcttaagtttgaattacacttgatttcctttgggttattaggcagataaacccttgtcattagtaatacttagcactgtccaaaatgaaaaatgactgccagtgtgttgcacatacataagaaaattacatcttactgcgaagtctttggtttgtttccttatttggtttgactttgacttactattttgctatggtcatatccttaatatctgcggtacatttcatatatatatatggggtgggagcataattgccattcccatgtgtctcaaggaagcttaatgaggaaactaatgagttaatattaactcttctgaagaaagctgacattttaggagtattaagtcatctgtcgttaaggagcagcaagaatatattatgattgtatcacatgttccagaagagcattaccccttacatagaaagctccttggagatttcatgatgttggatgaacatcagtttatccttatacatccctatgagctataattatcctcatttgatacttgaggaaactgaagtgacttgctccaaagttgactacaaaaacattgcagtttgaggcttaggttgtaatcaggtaattttggtcttggacagtaagggaaaatccataatacataaaacacaaaagtttagaaagggggggaagttgagctagcaatgggcatttctattatttaagttacatatcagtttccaggaatatttttcaaatgggacaaactaaaaagttgaggactagagcatcgtagtgtctaagtgcacctaataacttaatgcatgtgcacacaccctcagttaatttgtaagagagtgacttctcattgttatttgtggagaggctaattatagtagcttcattctttattttctgtgttcttaaatttttttttacatttgaaagtatgaaaatactatttttgacactttactgatactcagggattaaaagttaaattttactgactgtagcagcaggtaaatctcttaaatttactcaggtttcctatcctttgcctccatatttaagaaaatatagaatgcctgccagggaaatatataaaaataaaaatttcaaatacaattttaaaataccaatttgtaaataaaccaattttacaaactaaaatattgtgtctttccttgctttttatcccaatttatctcccctcctaagtttgaggagttttatatattaaggctatttcttcatttgtaaaaatgaagtatgctatttgcaaagcaaaagcccatgaaaagccccaaatcatttaagtaaagcttactgaattgttttcaattgttttgggagaaatgtaactaattataagcaatttatgtggaccagcagcaaataaatgtatgagtaca

SEQ ID NO: 8909 - DNA, 2209 bp, Homo sapiens
cggtcttcggtcctcgcagcgcttccagctccccgcgcccctatgtgagggagacggggaggcccgcggcgcgcaggggagggcgaggcatgtgcacgggccggagggtgctgcagccgcccgaggaagaggaggacggcggcgaggaggagagcggggggctcgcggcggcgggccccggccgaggggatgcagtggactgtgtgtgtctggctgtagcagacgcgaggcggcgacgaggcgccggggacccgcgcgaggggcggccgggaggcggcggcggcggccgccagaagtagcagcaggaccggcggcggcgacggcagccctgaaatgcattttcctctccagcggccatgttaaccaggaaaccttcggccgccgctcccgccgcctacccgaccgattggcggcagtaagcacacaatgaatgatcacctgcatgtcggcagccacgctcacggacagatccaggttcaacagttgtttgaggataacagtaacaagcggacagtgctcacgacacaaccaaatgggcttacaacagtgggcaaaacgggcttgccagtggtgccagagcggcagctggacagcattcatagacggcaggggagctccacctctctaaagtccatggaaggcatggggaaggtgaaagccacccccatgacacctgaacaagcaatgaagcaatacatgcaaaaactcacagccttcgaacaccatgagattttcagctaccctgaaatatatttcttgggtctaaatgctaagaagcgccagggcatgacaggtgggcccaacaatggtggctatgatgatgaccagggatcatatgtgcaggtgccccacgatcacgtggcttacaggtatgaggtcctcaaggtcattgggaaggggagctttgggcaggtggtcaaggcctacgatcacaaagtccaccagcacgtggccctaaagatggtgcggaatgagaagcgcttccaccggcaagcagcggaggagatccgaatcctggaacacctgcggaagcaggacaaggataacacaatgaatgtcatccatatgctggagaatttcaccttccgcaaccacatctgcatgacgtttgagctgctgagcatgaacctctatgagctcatcaagaagaataaattccagggcttcagtctgcctttggttcgcaagtttgcccactcgattctgcagtgcttggatgctttgcacaaaaacagaataattcactgtgaccttaagcccgagaacattttgttaaagcagcagggtagaagcggtattaaagtaattgattttggctccagttgttacgagcatcagcgtgtctacacgtacatccagtcgcgtttttaccgggctccagaagtgatccttggggccaggtatggcatgcccattgatatgtggagcctgggctgcattttagcagagctcctgacgggttaccccctcttgcctggggaagatgaaggggaccagctggcctgtatgattgaactgttgggcatgccctcacagaaactgctggatgcatccaaacgagccaaaaattttgtgagctccaagggttatccccgttactgcactgtcacgactctctcagatggctctgtggtcctaaacggaggccgttcccggagggggaaactgaggggcccaccggagagcagagagtgggggaacgcgctgaaggggtgtgatgatccccttttccttgacttcttaaaacagtgtttagagtgggatcctgcagtgcgcatgaccccaggccaggctttgcggcacccctggctgaggaggcggttgccaaagcctcccaccggggagaaaacgtcagtgaaaaggataactgagagcaccggtgctatcacatctatatccaagttacctccaccttctagctcagcttccaaactgaggactaatttggcgcagatgacagatgccaatgggaatattcagcagaggacagtgttgccaaaacttgttagctgagctcacgtcccctgatgctggtaacctgaaagatacgacattgctgagccttactgggttgaaaaggagtagctcagacctgtttttatttgctcaataactctactcatttgtatcttttcagcacttaattttaatgtaagaaagttgttcattttgtttttataaaatacatgaggacaatgctttaagtttt

SEQ ID NO: 8910 - DNA, 568 bp, Homo sapiens
gaaaatgcatttatgtttaggggtgcgcatggcaggggaggggtctctgcggcgctttcggccggagggcagcagcgattggcggcagtaagcacacaatgaatgatcacctgcatgtcggcagccacgctcacggacagatccaggttcaacagttgtttgaggataacagtaacaagcggacagtgctcacgacacaaccaaatgggcttacaacagtgggcaaaacgggcttgccagtggtgccagagcggcagctggacagcattcatagacggcaggggagctccacctctctaaagtccatggaaggcatggggaaggtgaaagccacccccatgacacctgaacaagcaatgaagcaatacatgcaaaaactcacagccttcgaacaccatgagattttcagctaccctgaaatatatttcttgggtctaaatgctaagaagcgccagggcatgacaggtgggcccaacaatggtggctatgatgatgaccagggatcatatgtgcaggtgccccacgatcacgtggcttacaggtatgaggtcctcaaggtcattgggaa

SEQ ID NO: 8911 - DNA, 2329 bp, Homo sapiens
ggcgctggcaagcgaagcttgggggtggggaggaggtagagtgagccctcagtaggagggacgagggcaggggtctgactgcctccccgggaccgcccccacctcctctctatcagggccccctccccccatccctgtctcaccgggcgcgggggacggggctagagcggagttagagcaagaagaatttccacccctggattccctctgaaaccctagatcggggtatatgttaagggattacgaaaatctaggactttttgtggggctttttattaaagggggggagcccgggagcaataccttggaaagaagccctgttgcttagagcggataaccaacggctgaactcttggggtttgctgtgaggggtgcggtctagcttcgaatgtacagtggtggagccacagtgttaaagaacagagaagtgatccttaatcatttagaattttgcctccaccatccaccagaaaatgaagtggaaagagaagttgggggatggtgtctatgacaccttcatgatgatagatgaaaccaaatgtcccccctgttcaaatgtactctgcaatccttctgaaccacctccacccagaagactaaatatgaccactgagcagtttacaggagatcatactcagcactttttggatggaggtgagatgaaggtagaacagctgtttcaagaatttggcaacagaaaatccaatactattcagtcagatggcatcagtgactctgaaaaatgctctcctactgtttctcagggtaaaagttcagattgcttgaatacagtaaaatccaacagttcatccaaggcacccaaagtggtgcctctgactccagaacaagccctgaagcaatataaacaccacctcactgcctatgagaaactggaaataattaattatccagaaatttactttgtaggtccaaatgccaagaaaagacatggagttattggtggtcccaataatggagggtatgatgatgcagatggggcctatattcatgtacctcgagaccatctagcttatcgatatgaggtgctgaaaattattggcaaggggagttttgggcaggtggccagggtctatgatcacaaacttcgacagtacgtggccctaaaaatggtgcgcaatgagaagcgctttcatcgtcaagcagctgaggagatccggattttggagcatcttaagaaacaggataaaactggtagtatgaacgttatccacatgctggaaagtttcacattccggaaccatgtttgcatggcctttgaattgctgagcatagacctttatgagctgattaaaaaaaataagtttcagggttttagcgtccagttggtacgcaagtttgcccagtccatcttgcaatctttggatgccctccacaaaaataagattattcactgcgatctgaagccagaaaacattctcctgaaacaccacgggcgcagttcaaccaaggtcattgactttgggtccagctgtttcgagtaccagaagctctacacatatatccagtctcggttctacagagctccagaaatcatcttaggaagccgctacagcacaccaattgacatatggagttttggctgcatccttgcagaacttttaacaggacagcctctcttccctggagaggatgaaggagaccagttggcctgcatgatggagcttctagggatgccaccaccaaaacttctggagcaatccaaacgtgccaagtactttattaattccaagggcataccccgctactgctctgtgactacccaggcagatgggagggttgtgcttgtggggggtcgctcacgtaggggtaaaaagcggggtcccccaggcagcaaagactgggggacagcactgaaagggtgtgatgactacttgtttatagagttcttgaaaaggtgtcttcactgggacccctctgcccgcttgaccccagctcaagcattaagacacccttggattagcaagtctgtccccagacctctcaccaccatagacaaggtgtcagggaaacgggtagttaatcctgcaagtgctttccagggattgggttctaagctgcctccagttgttggaatagccaataagcttaaagctaacttaatgtcagaaaccaatggtagtatacccctatgcagtgtattgccaaaactgattagctagtggacagagatatgcccagagatgcatatgtgtatatttttatgatcttacaaacctgcaaatggaaaaaatgcaagcccattggtggatgtttttgttagagtagactttttttaaacaagacaaaacatttttatatgattataaaa

SEQ ID NO: 8912 - DNA, 2218 bp, Homo sapiens
gcagtgtctggtcgagagtacccgtgggagcgtcgcgccgcggaggcagccgtcccggcgtaggtggcgtggccgaccggacccccaactggcgcctctccccgcgcggggtcccgagctaggagatgggaggcacagctcgtgggcctgggcggaaggatgcggggccgcctggggccgggctcccgccccagcagcggagtggtggagccacagtgttaaagaacagagaagtgatccttaatcatttagaattttgcctccaccatccaccagaaaatgaagtggaaagagaagttgggggatggtgtctatgacaccttcatgatgatagatgaaaccaaatgtcccccctgttcaaatgtactctgcaatccttctgaaccacctccacccagaagactaaatatgaccactgagcagtttacaggagatcatactcagcactttttggatggaggtgagatgaaggtagaacagctgtttcaagaatttggcaacagaaaatccaatactattcagtcagatggcatcagtgactctgaaaaatgctctcctactgtttctcagggtaaaagttcagattgcttgaatacagtaaaatccaacagttcatccaaggcacccaaagtggtgcctctgactccagaacaagccctgaagcaatataaacaccacctcactgcctatgagaaactggaaataattaattatccagaaatttactttgtaggtccaaatgccaagaaaagacatggagttattggtggtcccaataatggagggtatgatgatgcagatggggcctatattcatgtacctcgagaccatctagcttatcgatatgaggtgctgaaaattattggcaaggggagttttgggcaggtggccagggtctatgatcacaaacttcgacagtacgtggccctaaaaatggtgcgcaatgagaagcgctttcatcgtcaagcagctgaggagatccggattttggagcatcttaagaaacaggataaaactggtagtatgaacgttatccacatgctggaaagtttcacattccggaaccatgtttgcatggcctttgaattgctgagcatagacctttatgagctgattaaaaaaaataagtttcagggttttagcgtccagttggtacgcaagtttgcccagtccatcttgcaatctttggatgccctccacaaaaataagattattcactgcgatctgaagccagaaaacattctcctgaaacaccacgggcgcagttcaaccaaggtcattgactttgggtccagctgtttcgagtaccagaagctctacacatatatccagtctcggttctacagagctccagaaatcatcttaggaagccgctacagcacaccaattgacatatggagttttggctgcatccttgcagaacttttaacaggacagcctctcttccctggagaggatgaaggagaccagttggcctgcatgatggagcttctagggatgccaccaccaaaacttctggagcaatccaaacgtgccaagtactttattaattccaagggcataccccgctactgctctgtgactacccaggcagatgggagggttgtgcttgtggggggtcgctcacgtaggggtaaaaagcggggtcccccaggcagcaaagactgggggacagcactgaaagggtgtgatgactacttgtttatagagttcttgaaaaggtgtcttcactgggacccctctgcccgcttgaccccagctcaagcattaagacacccttggattagcaagtctgtccccagacctctcaccaccatagacaaggtgtcagggaaacgggtagttaatcctgcaagtgctttccagggattgggttctaagctgcctccagttgttggaatagccaataagcttaaagctaacttaatgtcagaaaccaatggtagtatacccctatgcagtgtattgccaaaactgattagctagtggacagagatatgcccagagatgcatatgtgtatatttttatgatcttacaaacctgcaaatggaaaaaatgcaagcccattggtggatgtttttgttagagtagactttttttaaacaagacaaaacatttttatatgattataaaagaattcttcaagggctaattacctaaccagcttgtattggccatctggaatatgcattaaatgactttttataggtcaatgca

SEQ ID NO: 8913 - DNA, 2163 bp, Homo sapiens
acttcccagccggggccagtcgggagcgaaagtgcgctgagctgcagtgtctggtcgagagtacccgtgggagcgtcgcgccgcggaggcagccgtcccggcgtaggtggcgtggccgaccggacccccaactggcgcctctccccgcgcggggtcccgagctaggagatgggaggcacagctcgtgggcctgggcggaaggatgcggggccgcctggggccgggctcccgccccagcagcggaggttgggggatggtgtctatgacaccttcatgatgatagatgaaaccaaatgtcccccctgttcaaatgtactctgcaatccttctgaaccacctccacccagaagactaaatatgaccactgagcagtttacaggagatcatactcagcactttttggatggaggtgagatgaaggtagaacagctgtttcaagaatttggcaacagaaaatccaatactattcagtcagatggcatcagtgactctgaaaaatgctctcctactgtttctcagggtaaaagttcagattgcttgaatacagtaaaatccaacagttcatccaaggcacccaaagtggtgcctctgactccagaacaagccctgaagcaatataaacaccacctcactgcctatgagaaactggaaataattaattatccagaaatttactttgtaggtccaaatgccaagaaaagacatggagttattggtggtcccaataatggagggtatgatgatgcagatggggcctatattcatgtacctcgagaccatctagcttatcgatatgaggtgctgaaaattattggcaaggggagttttgggcaggtggccagggtctatgatcacaaacttcgacagtacgtggccctaaaaatggtgcgcaatgagaagcgctttcatcgtcaagcagctgaggagatccggattttggagcatcttaagaaacaggataaaactggtagtatgaacgttatccacatgctggaaagtttcacattccggaaccatgtttgcatggcctttgaattgctgagcatagacctttatgagctgattaaaaaaaataagtttcagggttttagcgtccagttggtacgcaagtttgcccagtccatcttgcaatctttggatgccctccacaaaaataagattattcactgcgatctgaagccagaaaacattctcctgaaacaccacgggcgcagttcaaccaaggtcattgactttgggtccagctgtttcgagtaccagaagctctacacatatatccagtctcggttctacagagctccagaaatcatcttaggaagccgctacagcacaccaattgacatatggagttttggctgcatccttgcagaacttttaacaggacagcctctcttccctggagaggatgaaggagaccagttggcctgcatgatggagcttctagggatgccaccaccaaaacttctggagcaatccaaacgtgccaagtactttattaattccaagggcataccccgctactgctctgtgactacccaggcagatgggagggttgtgcttgtggggggtcgctcacgtaggggtaaaaagcggggtcccccaggcagcaaagactgggggacagcactgaaagggtgtgatgactacttgtttatagagttcttgaaaaggtgtcttcactgggacccctctgcccgcttgaccccagctcaagcattaagacacccttggattagcaagtctgtccccagacctctcaccaccatagacaaggtgtcagggaaacgggtagttaatcctgcaagtgctttccagggattgggttctaagctgcctccagttgttggaatagccaataagcttaaagctaacttaatgtcagaaaccaatggtagtatacccctatgcagtgtattgccaaaactgattagctagtggacagagatatgcccagagatgcatatgtgtatatttttatgatcttacaaacctgcaaatggaaaaaatgcaagcccattggtggatgtttttgttagagtagactttttttaaacaagacaaaacatttttatatgattataaaagaattcttcaagggctaattacctaaccagcttgtattggccatctggaatatgcattaaatgactttttataggtcaa

SEQ ID NO: 8914 - DNA, 870 bp, Homo sapiens
agcggaggtaacggcgccacggggtaacgggctggaggcgccacagggagcggctggcgctgtggtggagccacagtgttaaagaacagagaagtgatccttaatcatttagaattttgcctccaccatccaccagaaaatgaagtggaaagagaagttgggggatggtgtctatgacaccttcatgatgatagatgaaaccaaatgtcccccctgttcaaatgtactctgcaatccttctgaaccacctccacccagaagactaaatatgaccactgagcagtttacaggagatcatactcagcactttttggatggaggtgagatgaaggtagaacagctgtttcaagaatttggcaacagaaaatccaatactattcagtcagatggcatcagtgactctgaaaaatgctctcctactgtttctcagggtaaaagttcagattgcttgaatacagtaaaatccaacagttcatccaaggcacccaaagtggtgcctctgactccagaacaagccctgaagcaatataaacaccacctcactgcctatgagaaactggaaataattaattatccagaaatttactttgtaggtccaaatgccaagaaaagacatggagttattggtggtcccaataatggagggtatgatgatgcagatggggcctatattcatgtacctcgagaccatctagcttatcgatatgaggtgctgaaaattattggcaaggggagttttgggcaggtggccagggtctatgatcacaaacttcgacagtacgtggccctaaaaatggtgcgcaatgagaagcgctttcatcgtcaagcagctgaggagatccggattttggagcatcttaagaaacagga

SEQ ID NO: 8915 - DNA, 1816 bp, Homo sapiens
ccttctacagaacaccagtgttacttcactcccctttgtggacaccaaggggaagaagaatacggtaagcttcccacacattagcaagaaagtcctgctgaagtcatccctgctgtatcaggagaatcaagctcacaatcagatgccggcctcagagctcaaggcttcagaaatacctttccaccctagcattaaaacccaggatcccaaggcagaggagaagtcaccaaagaagcaaaaggtgactctgacagcggcagaggccctaaagctttttaagaaccagctgtctccatatgaacaaagtgaaatcctgggctacgcggagctgtggttcctgggtcttgaagccaagaagctcgacacggctcctgagaaatttagcaagacgagttttgatgatgagcatggcttctatctgaaggtcctgcatgatcacattgcctaccgctatgaagttctggagacaatcgggaaggggtcctttggacaggtggccaagtgcttggatcacaaaaacaatgagctggtggccctgaaaatcatcaggaacaagaagaggtttcaccagcaggccctgatggagctgaagatcctggaagctctcagaaagaaggacaaagacaacacctacaatgtggtgcatatgaaggactttttctactttcgcaatcacttctgcatcacctttgagctcctgggaatcaacttgtatgagttgatgaagaataacaactttcaaggcttcagtctgtccatagttcggcgcttcactctctctgttttgaagtgcttgcagatgctttcggtagagaaaatcattcactgtgatctcaagcccgaaaatatagtgctataccaaaagggccaagcctctgttaaagtcattgactttggatcaagctgttatgaacaccagaaagtatacacgtacatccaaagccggttctaccgatccccagaagtgatcctgggccacccctacgacgtggccattgacatgtggagcctgggctgcatcacggcggagttgtacacgggctaccccctgttccccggggagaatgaggtggagcagctggcctgcatcatggaggtgctgggtctgccgccagccggcttcattcagacagcctccaggagacagacattctttgattccaaaggttttcctaaaaatataaccaacaacagggggaaaaaaagatacccagattccaaggacctcacgatggtgctgaaaacctatgacaccagcttcctggactttctcagaaggtgtttggtatgggaaccttctcttcgcatgaccccggaccaggccctcaagcatgcttggattcatcagtctcggaacctcaagccacagcccaggccccagaccctgaggaaatccaattcctttttcccctctgagacaaggaaggacaaggttcaaggctgtcatcactcgagcagaaaagcagatgagatcaccaaagagactacagagaaaacaaaagatagccccacgaagcatgttcagcattcaggtgatcagcaggactgtctccagcacggagctgacactgttcagctgcctcaactggtagacgctcccaagaagtcagaggcagctgtcggggcggaggtgtccatgacctccccaggacagagcaaaaacttctccctcaagaacacaaacgttttaccccctattgtatgacctttgctgagggtatgtcctgctcctttccaccagtgatttgtattaagacagcacttatattgtacaatacttcagactgttttttttaaatacataaaactttatgtt

SEQ ID NO: 8916 - DNA, 1794 bp, Homo sapiens
agtgtgagctgttgaaagcctgcagctaaacaccagtgttacttcactcccctttgtggacaccaaggggaagaagaatacggtaagcttcccacacattagcaagaaagtcctgctgaagtcatccctgctgtatcaggagaatcaagctcacaatcagatgccggcctcagagctcaaggcttcagaaatacctttccaccctagcattaaaacccaggatcccaaggcagaggagaagtcaccaaagaagcaaaaggtgactctgacagcggcagaggccctaaagctttttaagaaccagctgtctccatatgaacaaagtgaaatcctgggctacgcggagctgtggttcctgggtcttgaagccaagaagctcgacacggctcctgagaaatttagcaagacgagttttgatgatgagcatggcttctatctgaaggtcctgcatgatcacattgcctaccgctatgaagttctggagacaatcgggaaggggtcctttggacaggtggccaagtgcttggatcacaaaaacaatgagctggtggccctgaaaatcatcaggaacaagaagaggtttcaccagcaggccctgatggagctgaagatcctggaagctctcagaaagaaggacaaagacaacacctacaatgtggtgcatatgaaggactttttctactttcgcaatcacttctgcatcacctttgagctcctgggaatcaacttgtatgagttgatgaagaataacaactttcaaggcttcagtctgtccatagttcggcgcttcactctctctgttttgaagtgcttgcagatgctttcggtagagaaaatcattcactgtgatctcaagcccgaaaatatagtgctataccaaaagggccaagcctctgttaaagtcattgactttggatcaagctgttatgaacaccagaaagtatacacgtacatccaaagccggttctaccgatccccagaagtgatcctgggccacccctacgacgtggccattgacatgtggagcctgggctgcatcacggcggagttgtacacgggctaccccctgttccccggggagaatgaggtggagcagctggcctgcatcatggaggtgctgggtctgccgccagccggcttcattcagacagcctccaggagacagacattctttgattccaaaggttttcctaaaaatataaccaacaacagggggaaaaaaagatacccagattccaaggacctcacgatggtgctgaaaacctatgacaccagcttcctggactttctcagaaggtgtttggtatgggaaccttctcttcgcatgaccccggaccaggccctcaagcatgcttggattcatcagtctcggaacctcaagccacagcccaggccccagaccctgaggaaatccaattcctttttcccctctgagacaaggaaggacaaggttcaaggctgtcatcactcgagcagaaaagcagatgagatcaccaaagagactacagagaaaacaaaagatagccccacgaagcatgttcagcattcaggtgatcagcaggactgtctccagcacggagctgacactgttcagctgcctcaactggtagacgctcccaagaagtcagaggcagctgtcggggcggaggtgtccatgacctccccaggacagagcaaaaacttctccctcaagaacacaaacgttttaccccctattgtatgacctttgctgagggtatgtcctgctcctttccaccagtgatttgtattaagacagcacttatattgtacaat

SEQ ID NO: 8917 - DNA, 1747 bp, Homo sapiens
cacattagcaagaaagtcctgctgaagtcatccctgctgtatcaggagaatcaagctcacaatcagatgccggcctcagagctcaaggcttcagaaatacctttccaccctagcattaaaacccaggatcccaaggcagaggagaagtcaccaaagaagcaaaaggtgactctgacagcggcagaggccctaaagctttttaagaaccagctgtctccatatgaacaaagtgaaatcctgggctacgcggagctgtggttcctgggtcttgaagccaagaagctcgacacggctcctgagaaatttagcaagacgagttttgatgatgagcatggcttctatctgaaggtcctgcatgatcacattgcctaccgctatgaagttctggagacaatcgggaaggggtcctttggacaggtggccaagtgcttggatcacaaaaacaatgagctggtggccctgaaaatcatcaggaacaagaagaggtttcaccagcaggccctgatggagctgaagatcctggaagctctcagaaagaaggacaaagacaacacctacaatgtggtgcatatgaaggactttttctactttcgcaatcacttctgcatcacctttgagctcctgggaatcaacttgtatgagttgatgaagaataacaactttcaaggcttcagtctgtccatagttcggcgcttcactctctctgttttgaagtgcttgcagatgctttcggtagagaaaatcattcactgtgatctcaagcccgaaaatatagtgctataccaaaagggccaagcctctgttaaagtcattgactttggatcaagctgttatgaacaccagaaagtatacacgtacatccaaagccggttctaccgatccccagaagtgatcctgggccacccctacgacgtggccattgacatgtggagcctgggctgcatcacggcggagttgtacacgggctaccccctgttccccggggagaatgaggtggagcagctggcctgcatcatggaggtgctgggtctgccgccagccggcttcattcagacagcctccaggagacagacattctttgattccaaaggttttcctaaaaatataaccaacaacagggggaaaaaaagatacccagattccaaggacctcacgatggtgctgaaaacctatgacaccagcttcctggactttctcagaaggtgtttggtatgggaaccttctcttcgcatgaccccggaccaggccctcaagcatgcttggattcatcagtctcggaacctcaagccacagcccaggccccagaccctgaggaaatccaattcctttttcccctctgagacaaggaaggacaaggttcaaggctgtcatcactcgagcagaaaagatgagatcaccaaagagactacagagaaaacaaaagatagccccacgaagcatgttcagcattcaggtgatcagcaggactgtctccagcacggagctgacactgttcagctgcctcaactggtagacgctcccaagaagtcagaggcagctgtcggggcggaggtgtccatgacctccccaggacagagcaaaaacttctccctcaagaacacaaacgttttaccccctattgtatgacctttgctgagggtatgtcctgctcctttccaccagtgatttgtattaagacagcacttatattgtacaatacttcagactgttttttttaaatacataaaactttatgttaaaaaactct

SEQ ID NO: 8918 - DNA, 1056 bp, Homo sapiens
attgacatgtggagcctgggctgcatcacggcggagttgtacacgggctaccccctgttccccggggagaatgaggtggagcagctggcctgcatcatggagattccaaaggttttcctaaaaatataaccaacaacagggggaaaaaaagatacccagattccaaggacctcacgatggtgctgaaaacctatgacaccagcttcctggactttctcagaaggtgtttggtatgggaaccttctcttcgcatgaccccggaccaggccctcaagcatgcttggattcatcagtctcggaacctcaagccacagcccaggccccagaccctgaggaaatccaattcctttttcccctctgagacaaggaaggacaaggttcaaggctgtcatcactcgagcagaaaagcagatgagatcaccaaagagactacagagaaaacaaaagatagccccacgaagcatgttcagcattcaggtgatcagcaggactgtctccagcacggagctgacactgttcagctgcctcaactggtagacgctcccaagaagtcagaggcagctgtcggggcggaggtgtccatgacctccccaggacagagcaaaaacttctccctcaagaacacaaacgttttaccccctattgtatgacctttgctgagggtatgtcctgctcctttccaccagtgatttgtattaagacagcacttatattgtacaatacttcagactgttttttttaaatacataaaactttatgttaaaaaactctattaacatggccaattggcatgactcctcttatgagggatgggggaggatgtccttgcacttaaactcattccatatgcatctgtgtgtgtagagggggcgggtagttttgaactctcagtgttacagcatcattaatggaactccaaacaaaagaaattttttttcttcttgcccatgactgccaacctatgtcaggatttttgtttgaaaatgatagaagctgaattcaaaagcagtttaaacaacggaagacacttattgacttacataattggggcatcag

SEQ ID NO: 8919 - DNA, 2006 bp, Homo sapiens
cccccagtagaaatatgaatagaaatcaccctgtgggcaatggtcccattttaaaatatgctgtcccattgtcccctagagcctactttaacttgtcagaccatgtattccacttcatatgcaagaggcatgcactgagcccataggtggctaggcaaacacccaatagctccctgaaatggcttcattatgcagcctcgacagccaccccaaccctcccactctcacactgaaacacccagacctagagatagctagacacacccagacacccgccaagcccctcacatacagatatgtgcacaatgatacacagcaaacgtacacagagttcagtacacacaaagagctcacgcccacgtgcacacacccctcagttgggacagagttgaccaccaccacctttctcccaaacacatggcttttgaactgcctttccttggatccagttcaaggggatggaggagcagtgagagtcagccgcccttccactccaatttcccagcacctcccttatctctgcctcacaagtcacccagcccccctctcttccttccttgtgcttgaagaatctctccttgctggaaagccccctgttttctcaatctccctttccacttcggtaaaatctctacttgctggaaagccccctgttttctcaatctccctttccacttcggtaaaatgcccactttctggtccccacctttttcctgagtgtagtcccaaccagccaaatccaacctcaaaacaggaagacccaaggccagtgacccccataggcctgaggcttgtgcaggcagtgggcgtggggtaaggcttcctgatgccccctgtccctgcccagaacctgatggccctcattagtccttggctcttatcttggaagcacaggcgctgacagccgtcccagcccttctgtctgcgggcctgaaccaaacggtgccatggggaactgtctgcacagggcggagctctccccctcaactgagaactcaagtcagctggacttcgaagatgtatggaattcttcctatggtgtgaatgattccttcccagatggagactatggtgccaacctggaagcagctgccccctgccactcctgtaacctgctggatgactctgcactgcccttcttcatcctcaccagtgtcctgggtatcctagctagcagcactgtcctcttcatgcttttcagacctctcttccgctggcagctctgccctggctggcctgtcctggcacagctggctgtgggcagtgccctcttcagcattgtggtgcccgtcttggccccagggctaggtagcactcgcagctctgccctgtgtagcctgggctactgtgtctggtatggctcagcctttgcccaggctttgctgctagggtgccatgcctccctgggccacagactgggtgcaggccaggtcccaggcctcaccctggggctcactgtgggaatttggggagtggctgccctactgacactgcctgtcaccctggccagtggtgcttctggtggactctgcaccctgatatacagcacggagctgaaggctttgcaggccacacacactgtagcctgtcttgccatctttgtcttgttgccattgggtttgtttggagccaaggggctgaagaaggcattgggtatggggccaggcccctggatgaatatcctgtgggcctggtttattttctggtggcctcatggggtggttctaggactggatttcctggtgaggtccaagctgttgctgttgtcaacatgtctggcccagcaggctctggacctgctgctgaacctggcagaagccctggcaattttgcactgtgtggctacgcccctgctcctcgccctattctgccaccaggccacccgcaccctcttgccctctctgcccctccctgaaggatggtcttctcatctggacacccttggaagcaaatcctagttctcttcccacctgtcaacctgaattaaagtctacactgcctttgtg

SEQ ID NO: 8920 - DNA, 1088 bp, Homo sapiens
gagactcttccggtgtaactctgatggcctcctctgggtatgtcctccaggcggagctctccccctcaactgagaactcaagtcagctggacttcgaagatgtatggaattcttcctatggtgtgaatgattccttcccagatggagactatggtgccaacctggaagcagctgccccctgccactcctgtaacctgctggatgactctgcactgcccttcttcatcctcaccagtgtcctgggtatcctagctagcagcactgtcctcttcatgcttttcagacctctcttccgctggcagctctgccctggctggcctgtcctggcacagctggctgtgggcagtgccctcttcagcattgtggtgcccgtcttggccccagggctaggtagcactcgcagctctgccctgtgtagcctgggctactgtgtctggtatggctcagcctttgcccaggctttgctgctagggtgccatgcctccctgggccacagactgggtgcaggccaggtcccaggcctcaccctggggctcactgtgggaatttggggagtggctgccctactgacactgcctgtcaccctggccagtggtgcttctggtggactctgcaccctgatatacagcacggagctgaaggctttgcaggccacacacactgtagcctgtcttgccatctttgtcttgttgccattgggtttgtttggagccaaggggctgaagaaggcattgggtatggggccaggcccctggatgaatatcctgtgggcctggtttattttctggtggcctcatggggtggttctaggactggatttcctggtgaggtccaagctgttgctgttgtcaacatgtctggcccagcaggctctggacctgctgctgaacctggcagaagccctggcaattttgcactgtgtggctacgcccctgctcctcgccctattctgccaccaggccacccgcaccctcttgccctctctgcccctccctgaaggatggtcttctcatctggacacccttggaagcaaatcctagttctcttcccacctgtcaacctgaattaaagtctacactgcctttgtg

SEQ ID NO: 8921 - DNA, 1905 bp, Homo sapiens
caagggagagaagtgtgttcacttccttttgctaagcccttcctttccagagagtgtcttggggggcatctgactgcttccccccaccctctgccaggcattgctggagaatgttaagacggcgatggagatgccatcaaccccaccctgcagagcatcacccagacacccgccaagcccctcacatacagatatgtgcacaatgatacacagcaaacgtacacagagttcagtacacacaaagagctcacgcccacgtgcacacacccctcagttgggacagagttgaccaccaccacctttctcccaaacacatggcttttgaactgcctttccttggatccagttcaaggggatggaggagcagtgagagtcagccgcccttccactccaatttcccagcacctcccttatctctgcctcacaagtcacccagcccccctctcttccttccttgtgcttgaagaatctctccttgctggaaagccccctgttttctcaatctccctttccacttcggtaaaatctctacttgctggaaagccccctgttttctcaatctccctttccacttcggtaaaatgcccactttctggtccccacctttttcctgagtgtagtcccaaccagccaaatccaacctcaaaacaggaagacccaaggccagtgacccccataggcctgaggcttgtgcaggcagtgggcgtggggtaaggcttcctgatgccccctgtccctgcccagaacctgatggccctcattagtccttggctcttatcttggaagcacaggcgctgacagccgtcccagcccttctgtctgcgggcctgaaccaaacggtgccatggggaactgtctgcacagggcggagctctccccctcaactgagaactcaagtcagctggacttcgaagatgtatggaattcttcctatggtgtgaatgattccttcccagatggagactatggtgccaacctggaagcagctgccccctgccactcctgtaacctgctggatgactctgcactgcccttcttcatcctcaccagtgtcctgggtatcctagctagcagcactgtcctcttcatgcttttcagacctctcttccgctggcagctctgccctggctggcctgtcctggcacagctggctgtgggcagtgccctcttcagcattgtggtgcccgtcttggccccagggctaggtagcactcgcagctctgccctgtgtagcctgggctactgtgtctggtatggctcagcctttgcccaggctttgctgctagggtgccatgcctccctgggccacagactgggtgcaggccaggtcccaggcctcaccctggggctcactgtgggaatttggggagtggctgccctactgacactgcctgtcaccctggccagtggtgcttctggtggactctgcaccctgatatacagcacggagctgaaggctttgcaggccacacacactgtagcctgtcttgccatctttgtcttgttgccattgggtttgtttggagccaaggggctgaagaaggcattgggtatggggccaggcccctggatgaatatcctgtgggcctggtttattttctggtggcctcatggggtggttctaggactggatttcctggtgaggtccaagctgttgctgttgtcaacatgtctggcccagcaggctctggacctgctgctgaacctggcagaagccctggcaattttgcactgtgtggctacgcccctgctcctcgccctattctgccaccaggccacccgcaccctcttgccctctctgcccctccctgaaggatggtcttctcatctggacacccttggaagcaaatcctagttctcttcccacctgtcaacctgaattaaagtctacactgcctttgtgaa

SEQ ID NO: 8922 - DNA, 550 bp, Homo sapiens
gtcccagcccttctgtctgcgggcctgaaccaaacggtgccatggggaactgtctgcacagggagactcttccggtgtaactctgatggcctcctctgggtatgtcctccaggcggagctctccccctcaactgagaactcaagtcagctggacttcgaagatgtatggaattcttcctatggtgtgaatgattccttcccagatggagactatggtgccaacctggaagcagctgccccctgccactcctgtaacctgctggatgactctgcactgcccttcttcatcctcaccagtgtcctgggtatcctagctagcagcactgtcctcttcatgcttttcagacctctcttccgctggcagctctgccctggctggcctgtcctggcacagctggctgtgggcagtgccctcttcagcattgtggtgcccgtcttggccccagggctaggtagcactcgcagctctgccctgtgtagcctgggctactgtgtctggtatggctcagcctttgcccaggctttgctgctagggtgccatgcctccctg

SEQ ID NO: 8923 - DNA, 1902 bp, Homo sapiens
caagggagagaagtgtgttcacttccttttgctaagcccttcctttccagagagtgtcttggggggcatctgactgcttccccccaccctctgccaggcattgctggagaatgttaagacggcgatggagatgccatcaaccccaccctgcagagcatcaccagacacccgccaagcccctcacatacagatatgtgcacaatgatacacagcaaacgtacacagagttcagtacacacaaagagctcacgcccacgtgcacacacccctcagttgggacagagttgaccaccaccacctttctcccaaacacatggcttttgaactgcctttccttggatccagttcaaggggatggaggagcagtgagagtcagccgcccttccactccaatttcccagcacctcccttatctctgcctcacaagtcacccagcccccctctcttccttccttgtgcttgaagaatctctccttgctggaaagccccctgttttctcaatctccctttccacttcggtaaaatctctacttgctggaaagccccctgttttctcaatctccctttccacttcggtaaaatgcccactttctggtccccacctttttcctgagtgtagtcccaaccagccaaatccaacctcaaaacaggaagacccaaggccagtgacccccataggcctgaggcttgtgcaggcagtgggcgtggggtaaggcttcctgatgccccctgtccctgcccagaacctgatggccctcattagtccttggctcttatcttggaagcacaggcgctgacagccgtcccagcccttctgtctgcgggcctgaaccaaacggtgccatggggaactgtctgcacagggcggagctctccccctcaactgagaactcaagtcagctggacttcgaagatgtatggaattcttcctatggtgtgaatgattccttcccagatggagactatggtgccaacctggaagcagctgccccctgccactcctgtaacctgctggatgactctgcactgcccttcttcatcctcaccagtgtcctgggtatcctagctagcagcactgtcctcttcatgcttttcagacctctcttccgctggcagctctgccctggctggcctgtcctggcacagctggctgtgggcagtgccctcttcagcattgtggtgcccgtcttggccccagggctaggtagcactcgcagctctgccctgtgtagcctgggctactgtgtctggtatggctcagcctttgcccaggctttgctgctagggtgccatgcctccctgggccacagactgggtgcaggccaggtcccaggcctcaccctggggctcactgtgggaatttggggagtggctgccctactgacactgcctgtcaccctggccagtggtgcttctggtggactctgcaccctgatatacagcacggagctgaaggctttgcaggccacacacactgtagcctgtcttgccatctttgtcttgttgccattgggtttgtttggagccaaggggctgaagaaggcattgggtatggggccaggcccctggatgaatatcctgtgggcctggtttattttctggtggcctcatggggtggttctaggactggatttcctggtgaggtccaagctgttgctgttgtcaacatgtctggcccagcaggctctggacctgctgctgaacctggcagaagccctggcaattttgcactgtgtggctacgcccctgctcctcgccctattctgccaccaggccacccgcaccctcttgccctctctgcccctccctgaaggatggtcttctcatctggacacccttggaagcaaatcctagttctcttcccacctgtcaacctgaattaaagtctacactgcctttgtg

SEQ ID NO: 8924 - DNA, 2610 bp, Homo sapiens
acgtgaccacctggctggcgcgcgcgcctgggggtctggtccctagccgcgttctcggtcgcttccctcttctctcgccgcctcctggcctccgcaccgacgcggcccgggctggagccgagccggggccgagctgcaggccggaccggagccggatctgtacccgctgagacgtggaaacatggaggcctgagccggtgtgcgccacctgggctgcggcggcgacagcgacttctcctgacccctctgccaccctcccatccgtccgcgggtccgtggagctggagcagatcccccagccggctgagacaggttgtcttttggaaatgcaggtttaaggacaaattatctgcttaagctagaagatgggatcgaatagcagcagaatcggcgatcttcctaaaaatgagtacttgaaaaagttatcaggcacggaatctatctctgagaatgacccgttctggaatcagcttctctcattttctttccctgcaccaactagcagtagtgagttgaaactcttggaggaagcaaccatttcagtctgcaggtcattagttgaaaacaatcctcgaacaggaaatcttggtgcactaattaaggtcttcctttctagaaccaaagaactaaaactttcagcagaatgtcagaaccacatcttcatttggcagacacacaatgctttgtttattatttgctgtttgctgaaagtgttcatctgtcagatgtcagaggaggaattacaacttcattttacttatgaagaaaaatctcctggcaattacagttctgactcagaagatcttttggaagaattgctgtgctgtttgatgcagttgatcactgatattccactcttagatattacatatgaaatatcagtagaagctatatcaacaatggttgttttcctttcctgccaactcttccacaaagaagttttgcgacagagcatcagccacaagtatttgatgcgaggtccatgtcttccatacaccagcaaacttgtgaagaccttattatataactttatcagacaagaaaagccacctcctccaggggcccatgttttccctcagcagtcggatgggggaggactgctttatggacttgcatcaggagtagcaacaggactctggactgtcttcacactaggtggtgtgggcagcaaagcggctgcctctccagagctttcttcccctctggccaaccagagtctcctgcttctgctggtgttggccaatctgacagatgcctcagatgcgccaaacccctacagacaagccattatgtccttcaagaacacacaagatagcagtcctttcccctcatcaattccacatgccttccagatcaactttaatagtttgtacacagctctttgtgaacagcagacatctgatcaagcaactctcctcttgtataccttgctccatcaaaatagtaatattagaacatacatgttggctcgcacagatatggaaaatcttgttttaccaattcttgagattctgtatcatgttgaagaaaggaattcacaccatgtgtatatggcccttataatattgttgatccttacggaagatgatggcttcaacagatccattcatgaagtgatactaaaaaatattacttggtattcagaacgagttttaactgaaatctccttggggagtctcctgatcctggtggtaataagaaccattcaatacaacatgactaggacacgagacaagtaccttcacacaaattgtttggcagctttagcaaatatgtcggcacagtttcgttctctccatcagtatgctgcccagaggatcatcagtttattttctttgctgtctaaaaaacacaacaaagttctggaacaagccacacagtccttgagaggttcgctgagttctaatgatgttcctctaccagattatgcacaagacctaaatgtcattgaagaagtgattcgaatgatgttagagatcatcaactcctgcctgacaaattcccttcaccacaacccaaacttggtatacgccctgctttacaaacgcgatctctttgaacaatttcgaactcatccttcatttcaggatataatgcaaaatattgatctggtgatctccttctttagctcaaggttgctgcaagctggagctgagctgtcagtggaacgggtcctggaaatcattaagcaaggcgtcgttgcgctgcccaaagacagactgaagaaatttccagaattgaaattcaaatatgtggaagaggagcagcccgaggagttttttatcccctatgtctggtctcttgtctacaactcagcagtcggcctgtactggaatccacaggacatccagctgttcaccatggattccgactgagggcaggatgctctcccacccggacccctccagccaagcagcccttcaagttcttttatttctgggtaacagaagtagacagacaggttacttggtgtatcttctgttaaagaggattgcacgagtgtgttttcctcacacactttgatttggagaattggtgctagttggcaatagataactcagcgtagatagtattgcaaaaaggggaggaaatacacaacaataataaatg

SEQ ID NO: 8925 - DNA, 2793 bp, Homo sapiens
acgtgaccacctggctggcgcgcgcgcctgggggtctggtccctagccgcgttctcggtcgcttccctcttctctcgccgcctcctggcctccgcaccgacgcggcccgggctggagccgagccggggccgagctgcaggccggaccggagccggatctgtacccgctgagacgtggaaacatggaggcctgagccggtgtgcgccacctgggctgcggcggcgacagcgacttctcctgacccctctgccaccctcccatccgtccgcgggtccgtggagctggagcagatcccccagccggctgagacaggttgtcttttggaaatgcaggtttaaggacaaattatctgcttaagctagaagatgggatcgaatagcagcagaatcggcgatcttcctaaaaatgagtacttgaaaaagttatcaggcacggaatctatctctgagaatgacccgttctggaatcagcttctctcattttctttccctgcaccaactagcagtagtgagttgaaactcttggaggaagcaaccatttcagtctgcaggtcattagttgaaaacaatcctcgaacaggaaatcttggtgcactaattaaggtcttcctttctagaaccaaagaactaaaactttcagcagaatgtcagaaccacatcttcatttggcagacacacaatgctttgtttattatttgctgtttgctgaaagtgttcatctgtcagatgtcagaggaggaattacaacttcattttacttatgaagaaaaatctcctggcaattacagttctgactcagaagatcttttggaagaattgctgtgctgtttgatgcagttgatcactgatattccactcttagatattacatatgaaatatcagtagaagctatatcaacaatggttgttttcctttcctgccaactcttccacaaagaagttttgcgacagagcatcagccacaagtatttgatgcgaggtccatgtcttccatacaccagcaaacttgtgaagaccttattatataactttatcagacaagaaaagccacctcctccaggggcccatgttttccctcagcagtcggatgggggaggactgctttatggacttgcatcaggagtagcaacaggactctggactgtcttcacactaggtggtgtgggcagcaaagcggctgcctctccagagctttcttcccctctggccaaccagagtctcctgcttctgctggtgttggccaatctgacagatgcctcagatgcgccaaacccctacagacaagccattatgtccttcaagaacacacaagatagcagtcctttcccctcatcaattccacatgccttccagatcaactttaatagtttgtacacagctctttgtgaacagcagacatctgatcaagcaactctcctcttgtataccttgctccatcaaaatagtaatattagaacatacatgttggctcgcacagatatggaaaatcttgttttaccaattcttgagattctgtatcatgttgaagaaaggaattcacaccatgtgtatatggcccttataatattgttgatccttacggaagatgatggcttcaacagatccattcatgaagtgatactaaaaaatattacttggtattcagaacgagttttaactgaaatctccttggggagtctcctgatcctggtggtaataagaaccattcaatacaacatgactaggacacgagacaagtaccttcacacaaattgtttggcagctttagcaaatatgtcggcacagtttcgttctctccatcagtatgctgcccagaggatcatcagttatacctgccgccacttgcggagatatgtttatgtgttggacaaactgtatttcccccactctcactgttctacgcttcagcattgcttctcgaccctcagtgacaatggagaggaactcttgtctttaacttgctctcacattctcagatcctatgcttccagtttattttctttgctgtctaaaaaacacaacaaagttctggaacaagccacacagtccttgagaggttcgctgagttctaatgatgttcctctaccagattatgcacaagacctaaatgtcattgaagaagtgattcgaatgatgttagagatcatcaactcctgcctgacaaattcccttcaccacaacccaaacttggtatacgccctgctttacaaacgcgatctctttgaacaatttcgaactcatccttcatttcaggatataatgcaaaatattgatctggtgatctccttctttagctcaaggttgctgcaagctggagctgagctgtcagtggaacgggtcctggaaatcattaagcaaggcgtcgttgcgctgcccaaagacagactgaagaaatttccagaattgaaattcaaatatgtggaagaggagcagcccgaggagttttttatcccctatgtctggtctcttgtctacaactcagcagtcggcctgtactggaatccacaggacatccagctgttcaccatggattccgactgagggcaggatgctctcccacccggacccctccagccaagcagcccttcaagttcttttatttctgggtaacagaagtagacagacaggttacttggtgtatcttctgttaaagaggattgcacgagtgtgttttcctcacacactttgatttggagaattggtgctagttggcaatagataactcagcgtagatagtattgcaaaaaggggaggaaatacacaacaataataaatgtaaaaacctgctattcaa

SEQ ID NO: 8926 - DNA, 2058 bp, Homo sapiens
acgtgaccacctggctggcgcgcgcgcctgggggtctggtccctagccgcgttctcggtcgcttccctcttctctcgccgcctcctggcctccgcaccgacgcggcccgggctggagccgagccggggccgagctgcaggccggaccggagccggatctgtacccgctgagacgtggaaacatggaggcctgagccggtgtgcgccacctgggctgcggcggcgacagcgacttctcctgacccctctgccaccctcccatccgtccgcgggtccgtggagctggagcagatcccccagccggctgagacaggttgtcttttggaaatgcaggtttaaggacaaattatctgcttaagctagaagatgggatcgaatagcagcagaatcggcgatcttcctaaaaatgagtacttgaaaaagttatcaggcacggaatctatctctgagaatgacccgttctggaatcagcttctctcattttctttccctgcaccaactagcagtagtgagttgaaactcttggaggaagcaaccatttcagtctgcaggtcattagcaggactctggactgtcttcacactaggtggtgtgggcagcaaagcggctgcctctccagagctttcttcccctctggccaaccagagtctcctgcttctgctggtgttggccaatctgacagatgcctcagatgcgccaaacccctacagacaagccattatgtccttcaagaacacacaagatagcagtcctttcccctcatcaattccacatgccttccagatcaactttaatagtttgtacacagctctttgtgaacagcagacatctgatcaagcaactctcctcttgtataccttgctccatcaaaatagtaatattagaacatacatgttggctcgcacagatatggaaaatcttgttttaccaattcttgagattctgtatcatgttgaagaaaggaattcacaccatgtgtatatggcccttataatattgttgatccttacggaagatgatggcttcaacagatccattcatgaagtgatactaaaaaatattacttggtattcagaacgagttttaactgaaatctccttggggagtctcctgatcctggtggtaataagaaccattcaatacaacatgactaggacacgagacaagtaccttcacacaaattgtttggcagctttagcaaatatgtcggcacagtttcgttctctccatcagtatgctgcccagaggatcatcagtttattttctttgctgtctaaaaaacacaacaaagttctggaacaagccacacagtccttgagaggttcgctgagttctaatgatgttcctctaccagattatgcacaagacctaaatgtcattgaagaagtgattcgaatgatgttagagatcatcaactcctgcctgacaaattcccttcaccacaacccaaacttggtatacgccctgctttacaaacgcgatctctttgaacaatttcgaactcatccttcatttcaggatataatgcaaaatattgatctggtgatctccttctttagctcaaggttgctgcaagctggagctgagctgtcagtggaacgggtcctggaaatcattaagcaaggcgtcgttgcgctgcccaaagacagactgaagaaatttccagaattgaaattcaaatatgtggaagaggagcagcccgaggagttttttatcccctatgtctggtctcttgtctacaactcagcagtcggcctgtactggaatccacaggacatccagctgttcaccatggattccgactgagggcaggatgctctcccacccggacccctccagccaagcagcccttcaagttcttttatttctgggtaacagaagtagacagacaggttacttggtgtatcttctgttaaagaggattgcacgagtgtgttttcctcacacactttgatttggagaattggtgctagttggcaatagataactcagcgtagatagtattgcaaaaaggggaggaaatacacaacaataataaatgtaaaaacctgctattcaa

SEQ ID NO: 8927 - DNA, 4500 bp, Homo sapiens
agaggctagcacggttcctgacaagtctagagcagcactagcgcagagtgagactcatcagctggcaagcaggattctgtgtctctgggttcaggaatcctcaggcagcagaggggacttgctcctcagcccccatcactgcccccacccctacccgtgtaggccaccgagtgaggcccatggactggggagggctgtgcctgacgactcctgtgtccctctatgagggcccagcgccctgaccctcctgcctaggtttctaccttttctctctgtctttggccagctgggggagggggtagaggccgggtgagcaacatggcacagagcaagaggcacgtgtacagccggacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcggggactgaagcctaagaaggcaccgacagcccgaaagaccacaactcggcgacccaagcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtgaagaacagcagcgaggagccatccctgggcaggctccagggtctgtgccaggcccagggctggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcctgccccgttcagcttcactcccaccctttcagcgtcctgccccttcaccttgacccgggttcccccactcccattccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttcagtgc

SEQ ID NO: 8928 - DNA, 4492 bp, Homo sapiens
agcacggttcctgacaagtctagagcagcactagcgcagagtgagactcatcagctggcaagcaggattctgtgtctctgggttcaggaatcctcaggcagcagaggggacttgctcctcagcccccatcactgcccccacccctacccgtgtaggccaccgagtgaggcccatggactggggagggctgtgcctgacgactcctgtgtccctctatgagggcccagcgccctgaccctcctgcctaggtttctaccttttctctctgtctttggccagctgggggagggggtagaggccgggtgagcaacatggcacagagcaagaggcacgtgtacagccggacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcggggactgaagcctaagaaggcaccgacagcccgaaaggggaggcgggtgaggacgaagcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtgaagaacagcagcgaggagccatccctgggcaggctccagggtctgtgccaggcccagggctggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcctgccccgttcagcttcactcccaccctttcagcgtcctgccccttcaccttgacccgggttcccccactcccattccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttcagtg

SEQ ID NO: 8929 - DNA, 4479 bp, Homo sapiens
agaggctagcacggttcctgacaagtctagagcagcactagcgcagagtgagactcatcagctggcaagcaggattctgtgtctctgggttcaggaatcctcaggcagcagaggggacttgctcctcagcccccatcactgcccccacccctacccgtgtaggccaccgagtgaggcccatggactggggagggctgtgcctgacgactcctgtgtccctctatgagggcccagcgccctgaccctcctgcctaggtttctaccttttctctctgtctttggccagctgggggagggggtagaggccgggtgagcaacatggcacagagcaagaggcacgtgtacagccggacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactggcaccgacagcccgaaagaccacaactcggcgacccaagcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtgaagaacagcagcgaggagccatccctgggcaggctccagggtctgtgccaggcccagggctggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcctgccccgttcagcttcactcccaccctttcagcgtcctgccccttcaccttgacccgggttcccccactcccattccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttcagtgc

SEQ ID NO: 8930 - DNA, 4162 bp, Homo sapiens
agtggctccacccccatggagcagaggagggtgggtgcatgacgtcaggtggagctggtgctgcggccactgaggctgccatcagcctaagctggtgaactgggccaggcaccgctccggtgcctgccggagcctggcgatccagctgcacgtctgcgggggcctctgtgtcagagcggcggccgtttgcaggctgggaagctgccgcaccgggaggctgagactgcattgttgggatttgatgcactaatctcctgtctccgccgcctttccctctgttcggtctcttgccctccctcccttcgtctgtccttcctccgtgtgtttgtctatcctcctctgtccctcctctttcctctccttgctttctttggttttctgcaatgatgagacaggcaccgacagcccgaaagaccacaactcggcgacccaagcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtgaagaacagcagcgaggagccatccctgggcaggctccagggtctgtgccaggcccagggctggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcctgccccgttcagcttcactcccaccctttcagcgtcctgccccttcaccttgacccgggttcccccactcccattccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttcagtg

SEQ ID NO: 8931 - DNA, 4202 bp, Homo sapiens
ccggccccgcagggtcttgggcgtcggtcgtcggtggggtcggagctgggcgcggagcccctcacagtgcagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcggggactgaagcctaagaaggcaccgacagcccgaaagaccacaactcggcgacccaagcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtggagccatccctgggcaggctccagggtctgtgccaggcccagggctggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcctgccccgttcagcttcactcccaccctttcagcgtcctgccccttcaccttgacccgggttcccccactcccattccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttca

SEQ ID NO: 8932 - DNA, 4229 bp, Homo sapiens
ggccggccccgcagggtcttgggcgtcggtcgtcggtggggtcggagctgggcgcggagcccctcacagtgcagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcaggtgggcctggatggctgggtagaaggtgtggggagagttagtgaccagtgtggggcttttacttctgcccttggctcctgcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtggagccatccctgggcaggctccagggtctgtgccaggcccagggctggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcctgccccgttcagcttcactcccaccctttcagcgtcctgccccttcaccttgacccgggttcccccactcccattccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttcagt

SEQ ID NO: 8933 - DNA, 565 bp, Homo sapiens
acttgatgcttatgggcctgctgaggccttacatcctgggggagaggggaacagtgatgacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcggggactgaagcctaagaaggcaccgacagcccgaaagaccacaactcggcgacccaagcccacgcgcccagccagtactggggtggctggggccagtagctccctgggcccctctggctcagcgtcagcaggtgagctgagcag

SEQ ID NO: 8934 - DNA, 4365 bp, Homo sapiens
acagtgcgcgtgcgcttatcctgtcccaggtgtccagctttgtgcctgattgatgtaatcccggctgcggtcggtgcgcagttttcagtcagggctggactgcgggaaaagagggttcactcgacccagaacgcctctgggcctctgggccgaagggttctgggcggtcctggaagggtctggcggcgagtcgggcagcccacgagggcggggagggcggggccggccccgcagggtcttgggcgtcggtcgtcggtggggtcggagctgggcgcggagcccctcacagtgcagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtggagccatccctgggcaggctccagggtctgtgccaggcccagggctggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcctgccccgttcagcttcactcccaccctttcagcgtcctgccccttcaccttgacccgggttcccccactcccattccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttcag

SEQ ID NO: 8935 - DNA, 4145 bp, Homo sapiens
agtggctccacccccatggagcagaggagggtgggtgcatgacgtcaggtggagctggtgctgcggccactgaggctgccatcagcctaagctggtgaactgggccaggcaccgctccggtgcctgccggagcctggcgatccagctgcacgtctgcgggggcctctgtgtcagagcggcggccgtttgcaggctgggaagctgccgcaccgggaggctgagactgcattgttgggatttgatgcactaatctcctgtctccgccgcctttccctctgttcggtctcttgccctccctcccttcgtctgtccttcctccgtgtgtttgtctatcctcctctgtccctcctctttcctctccttgctttctttggttttctgcaatgatgagacaggcaccgacagcccgaaagaccacaactcggcgacccaagcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtggagccatccctgggcaggctccagggtctgtgccaggcccagggctggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcctgccccgttcagcttcactcccaccctttcagcgtcctgccccttcaccttgacccgggttcccccactcccattccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttcag

SEQ ID NO: 8936 - DNA, 4024 bp, Homo sapiens
atcagctggcaagcaggattctgtgtctctgggttcaggaatcctcaggcagcagaggggacttgctcctcagcccccatcactgcccccacccctacccgtgtaggccaccgagtgaggcccatggactggggagggctgtgcctgacgactcctgtgtccctctatgagggcccagcgccctgaccctcctgcctaggtttctaccttttctctctgtctttggccagctgggggagggggtagaggccgggtgagcaacatggcacagagcaagaggcacgtgtacagccggacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtggagccatccctgggcaggctccagggtctgtgccaggcccagggctggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaa

SEQ ID NO: 8937 - DNA, 1677 bp, Homo sapiens
aacccagcctctcccctacccgaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcgtttgcacaagagctggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcagaatcccctttctgcaggtctacagggagcctgtctcatggagactgtagagctgttgcaagcaaaggtgagcgccctagaccttgcagttttggatcaagtggaggctcggctacagagtgtcctgggaaaggtgaacgagattgccaagcataaagcctctgtagaagatgcagatacacaaagcaaggtgcaccagctatatgaaactatacagcgctggagccccattgcctccaccctccctgagctggtgcagagacttgtcaccatcaagcagctgcacgagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggtttcccctttactataactctagcatccccatcccatttgacactgggggcaagggttcttcttgcatgtggggtttatacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaatgctgttgtactctg

SEQ ID NO: 8938 - DNA, 1515 bp, Homo sapiens
atgtatgcacagggaacagaggattcaaggactcttgaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcagaatcccctttctgcaggtctacagggagcctgtctcatggagactgtagagctgttgcaagcaaaggtgagcgccctagaccttgcagttttggatcaagtggaggctcggctacagagtgtcctgggaaaggtgaacgagattgccaagcataaagcctctgtagaagatgcagatacacaaagcaaggtgcaccagctatatgaaactatacagcgctggagccccattgcctccaccctccctgagctggtgcagagacttgtcaccatcaagcagctgcacgagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggtttcccctttactataactctagcatccccatcccatttgacactgggggcaagggttcttcttgcatgtggggtttatacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaatgctgttgtactctg

SEQ ID NO: 8939 - DNA, 1439 bp, Homo sapiens
gaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcgatgccccagatcttcaagacactgctggagtaggtgctactggaggactagagtgtgctcccgggccacagccttggagaggctccagaggatgccagcgccaggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcagaatcccctttctgcaggtctacagggagcctgtctcatggagactgtagagctgttgcaagcaaaggtgagcgccctagaccttgcagttttggatcaagtggaggctcggctacagagtgtcctgggaaaggtgaacgagattgccaagcataaagcctctgtagaagatgcagatacacaaagcaaggtgcaccagctatatgaaactatacagcgctggagccccattgcctccaccctccctgagctggtgcagagacttgtcaccatcaagcagctgcacgagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggttt

SEQ ID NO: 8940 - DNA, 1745 bp, Homo sapiens
gctactgctgtcgcgagacttcctgctcatctgccgctccctttgccgccgccttagcccgggacccgaacccagcctctcccctacccgaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcgactgttcaacatctagaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcagaatcccctttctgcaggtctacagggagcctgtctcatggagactgtagagctgttgcaagcaaaggtgagcgccctagaccttgcagttttggatcaagtggaggctcggctacagagtgtcctgggaaaggtgaacgagattgccaagcataaagcctctgtagaagatgcagatacacaaagcaaggtgcaccagctatatgaaactatacagcgctggagccccattgcctccaccctccctgagctggtgcagagacttgtcaccatcaagcagctgcacgagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggtttcccctttactataactctagcatccccatcccatttgacactgggggcaagggttcttcttgcatgtggggtttatacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaatgctgttgtactctg

SEQ ID NO: 8941 - DNA, 2061 bp, Homo sapiens
aatcctaggcggcgtcccctggccattacctcattccctggcctcgttctccccaatcccggcctctccaggggtgtggcagcagggctgttctcgcgacttttgctttacccttctgctgtgctactgctgtcgcgagacttcctgctcatctgccgctccctttgccgccgccttagcccgggacccgaacccagcctctcccctacccgaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcagaatcccctttctgcaggtctacagggagcctgtctcatggagactgtagagctgttgcaagcaaaggtgagcgccctagaccttgcagttttggatcaagtggaggctcggctacagagtgtcctgggaaaggtgaacgagattgccaagcataaagcctctgtagaagatgcagatacacaaagcaaggtgcaccagctatatgaaactatacagcgctggagccccattgcctccaccctccctgagctggtgcagagacttgtcaccatcaagcagctgcacgagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggtttcccctttactataactctagcatccccatcccatttgacactgggggcaagggttcttcttgcatgtggggtttatacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaatgctgttgtactctgtgtggcctctgctgtgtttcctggggaggaagcagcactaggatatagatattcattcgtcataacaggcaatctaagccactctatactacaagagatggatttaaattgtaacctgttcttaccaaagaactaaataaaaaatgagtacagagccagagccagagtttcaaaatattctcatctgttaaattaagagtgtctcccat

SEQ ID NO: 8942 - DNA, 808 bp, Homo sapiens
tgggtcggtagtagcgatggcgggtctgactgacttgcagcggctacaggcccgagtggaagagctggagcgctgggtgtacgggccgggcggggcgcgcggctcacggaaggtggctgacggcctggtcaaggtgcaggtggctttggggaacatttccagcaagagggagagggtgaagattctctacaaaaagattgaagatctgatcaagtacctggatcctgagtacatcgaccgcattgccatacctgatgcctctaagctgcaattcatcctagcagaggagcagtttatcctttcccaggttgcactcctggagcaggtgaatgccttggtgcccatgctggacagtgctcacatcaaagccgttcctgagcatgctgcccgcctgcagcgcttggcccagatccacattcagcagcaggaccagtgtgtggaaatcactgaggagtccaaggctctcctggaggaatacaacaagactacaatgcttctctccaagcaattcgtgcagtgggatgagctactttgccagctagaggccgccacgcaagtgaagccagcagaggagtgatagctgctccccatcccaaagtgggcctgggcagtcaggctccagggccctatgccaacctgcctttgttacaaggcagaggaagctttgtatttattggcttcaaggcccacctctctgtactctgggctctaaagttggaggtcaggttacctgaggtttgcaatttgcaacacccaccctccccccaatcagtgttcttatttcagtgacaataaaccatagagatga

SEQ ID NO: 8943 - DNA, 899 bp, Homo sapiens
ggtagtagcgatggcgggtctgactgacttgcagcggctacaggcccgagtggaagagctggagcgctgggtgtacgggccgggcggggcgcgcggctcacggaaggtggctgacggcctggtcaaggtgcaggtggctttggggaacatttccagcaagagggagagggtgaagattctctacaaaaagattgaagatctgatcaagtacctggatcctgagtacatcgaccgcattgccatacctgatgcctctaagctgcaattcatcctagcagaggagcagtttatcctttcccaggttgcactcctggagcaggtgaatgccttggtgcccatgctggacagtgctcacatcaaagccgttcctgagcatgctgcccgcctgcagcgcttggcccagatccacattcagcagcaggctccatggggagtgggagtccgtgatgaggcaggaagtttagtggaagatgtgggctttgcccagttcctttctgtgctacactttggccctacaggaccagtgtgtggaaatcactgaggagtccaaggctctcctggaggaatacaacaagactacaatgcttctctccaagcaattcgtgcagtgggatgagctactttgccagctagaggccgccacgcaagtgaagccagcagaggagtgatagctgctccccatcccaaagtgggcctgggcagtcaggctccagggccctatgccaacctgcctttgttacaaggcagaggaagctttgtatttattggcttcaaggcccacctctctgtactctgggctctaaagttggaggtcaggttacctgaggtttgcaatttgcaacacccaccctccccccaatcagtgttcttatttcagtgacaataaaccatagagatga

SEQ ID NO: 8944 - DNA, 482 bp, Homo sapiens
atggcgggtctgactgacttgcagcggctacaggcccgagtggaagagctggagcgctgggtgtacgggccgggcggggcgcgcggctcacggaaggtggctgacggcctggtcaaggtgcaggtggctttggggaacatttccagcaagagggagagggtgaagattctctacaaaaagattgaagatctgatcaagtacctggatcctgagtacatcgaccgcattgccatacctgatgcctctaagctgcaattcatcctagcaggtaatgctggactacatgtgtacatgcatctgaggatgtgggtcgtcggggaggttaagcacagagatggcctctccatccagtcttctggtggatacaagccctggatgctgctctctggaattgtggcctggttctgggttgaggatcctatggatcctctagtagacattgagtacagtatacctctgcaccagctgcaggccatggtgcc

SEQ ID NO: 8945 - DNA, 677 bp, Homo sapiens
gtgggtcggtagtagcgatggcgggtctgactgacttgcagcggctacaggcccgagtggaagagctggagcgctgggtgtacgggccgggcggggcgcgcggctcacggaaggtggctgacggcctggtcaaggtgcaggtggctttggggaacatttccagcaagagggagagggtgaagattctctacaaaaagattgaagatctgatcaagtacctggatcctgagtacatcgaccgcattgccatacctgatgcctctaagctgcaattcatcctagcagagaggagcagtttatcctttcccaggttgcactcctggagcaggtgaatgccttggtgcccatgctggacagtgctcacatcaaagccgttcctgagcatgctgcccgcctgcagcgcttggcccagatccacattcagcagcaggtatgggaggggagatgactagaagcgaagatggaggtggcgcagcacctcatcccaactcatgccacctggggaagcagcttcaggcctttctgttgtaacctcagcagaaactttggggtttatcctttatcttgcatatgccccagggaggtaaagggacttgcctaggttcatgtacaaactttctgcttccagagcaggactttattgggacaccataaggttgaggctgggaggtacccaa

SEQ ID NO: 8946 - DNA, 742 bp, Homo sapiens
ggctgtttcctggccgaggtgggtcggtagtagcgatggcgggtctgactgacttgcagcggctacaggcccgagtggaagagctggagcgctgggtgtacgggccgggcggggcgcgcggctcacggaaggtggctgacggcctggtcaaggtgcaggtggctttggggaacatttccagcaagagggagagggtgaagattctctacaaaaagattgaagatctgatcaagtacctggatcctgagtacatcgaccgcattgccatacctgatgcctctaagctgcaattcatcctagcagccgttcctgagcatgctgcccgcctgcagcgcttggcccagatccacattcagcagcaggaccagtgtgtggaaatcactgaggagtccaaggctctcctggaggaatacaacaagactacaatgcttctctccaagcaattcgtgcagtgggatgagctactttgccagctagaggccgccacgcaagtgaagccagcagaggagtgatagctgctccccatcccaaagtgggcctgggcagtcaggctccagggccctatgccaacctgcctttgttacaaggcagaggaagctttgtatttattggcttcaaggcccacctctctgtactctgggctctaaagttggaggtcaggttacctgaggtttgcaatttgcaacacccaccctccccccaatcagtgttcttatttcagtgacaataaaccatagagatg

SEQ ID NO: 8947 - DNA, 687 bp, Homo sapiens
cagcggctacaggcccgagtggaagagctggagcgctgggtgtacgggccgggcggggcgcgcggctcacggaaggtggctgacggcctggtcaaggtgcaggtggctttggggaacatttccagcaagagggagagggtgaagattctctacaaaaagattgaagatctgatcaagtacctggatcctgagtacatcgaccgcattgccatacctgatgcctctaagctgcaattcatcctagcagccgttcctgagcatgctgcccgcctgcagcgcttggcccagatccacattcagcagcaggaccagtgtgtggaaatcactgaggagtccaaggctctcctggaggaatacaacaagactacaatgcttctctccaagcaattcgtgcagtgggatgagctactttgccagctagaggccgccacgcaagtgaagccagcagaggagtgatagctgctccccatcccaaagtgggcctgggcagtcaggctccagggccctatgccaacctgcctttgttacaaggcagaggaagctttgtatttattggcttcaaggcccacctctctgtactctgggctctaaagttggaggtcaggttacctgaggtttgcaatttgcaacacccaccctccccccaatcagtgttcttatttcagtgacaataaaccatagagatga

SEQ ID NO: 8948 - DNA, 3877 bp, Homo sapiens
gactgacgtcccgccctctggctgtttcctggccgaggtgggtcggtagtagcgatggcgggtctgactgacttgcagcggctacaggcccgagtggaagagctggagcgctgggtgtacgggccgggcggggcgcgcggctcacggaaggtggctgacggcctggtcaaggtgcaggtggctttggggaacatttccagcaagagggagagggtgaagattctctacaaaaagattgaagatctgatcaagtacctggatcctgagtacatcgaccgcattgccatacctgatgcctctaagctgcaattcatcctagcaggtaatgctggactacatgtgtacatgcatctgaggatgtgggtcgtcggggaggttaagcacagagatggcctctccatccagtcttctggtggatacaagccctggatgctgctctctggaattgtggcctggttctgggttgaggatcctatggatcctctagtagacattgagtacagtatacctctgcaccagctgcaggccatggtgccagccacagtgggagctagtccagtgttctatcaatagtttgcctcttggattttccttcagaaccttcctcacttctgctcactagacagaggagcttctaggaaagggtaggggcagagagcattgccattaaagaacagagagagtattggcatgagtttcaacatctttctttcatgtgagaaagctctgcagtgtcagagttctaggcaggaactattgccttggcaatgtctgctaatcagtcagccattctataagctagggttttttgagcttcgttattcatccaaaagatgtataatgatcatctactctgatccaggttctttcctaagtgaggaagcatacagtggtgaaccagaaagtccctgccctcatgggcacagccagagctaggggagacagggtccctgcttcagggacctgagcttataacccagatgggagatcagtctcccaggagactgatcagtgcaatgcagcactgaggactgggtaaggatgggccactcctgctaaaagggctgtcagagttcccaaagggctcttggtcaattgccatcgctcaagcaccaagtttagatattctcctgcactgactcttgagtccagcctctccatccctccctgtggcactgcctcaggaattgtgcatccacttgcatatgaatggttgcacagtctcctaaatcatactcttgaccctaatctttcccttcctgcatgtggttcagtctcaccctcacaaaaacatgttcccaacatgtcactttgcctactttggaacctcagtgtatcctgccttgctaggataaagtcctaattccatagtctgccattcaaagcctttcagtcggccgggtctaccctcccatccaactctgtttcctgtgctctccctactccagttcagctaattgaattctttctcctctactaattgacaggcattcctgcctctaagcatttgcacgtaacagtcctctctcttgaatacccttcccactctatggatttcagtgcattgaaatcccgtgtgcatacagggcctagcccagatcctgctctcctcactggactcttccattactgtcccagctctcctccagcatataattgtctatgcctctgagagccactgagcagaacctgcctggcgtagtctgccacatatctcttttagaccttcctggggacccttgggtgtggggatccaagtctgaagtattttgtattttgtggcctaggaggtgctccctgagtttgttgataggaggctagaagaagaggtcttgaagttaaaccttggagaaaggtgggatttggagaaattgagaggctcattaggctcagatgggtcagacctgaggcatccaggagagttgggggcaggatggaaatgtgcacctagagaagggggcagtggacagagtcactgtccaaagctctaggacctagccatctcccttgccaggtcctcaggcccttacatgggctgattagcaatgcccaggtttgcttcactgcaactatcttgtccatttttgctttagaggagcagtttatcctttcccaggttgcactcctggagcaggtgaatgccttggtgcccatgctggacagtgctcacatcaaaggtatctctctggggttatagcttcactactctggttggggaggtaggtggatggatgggcaagactttcctgtgtttcaggttgtgtggattcgggttgggtctgttccttatcttttttttttttttttggacagagtcgtactctgtcacccaggctggagtgcagtggcatgatcttgactcactgcaaccgctgcctcctggttcaaacaaacttcccaccttgcctcccaagtagctaggattacaggtgtgtgccaccacacctggctatttttagtagagacggggtttcaccatgttgtccaggctggtctcaaactcctggccccatgtgatccacctgcctcggcctctcagagtgctgggattacaggcgtgagctactgtgcctggcctgttccttatctttatcctcaccctgaggtacttgccacatccaccaattaaaattaccaggatagagagcccagttttaggacctcaggcaatttgggcctgagaacactagcctaagctctagcagtccccagctctggggattccttctgccttctacctacccccaagcatctcttcttcaaggtgctgcagaacccagattttactatcagagtctctgccaggtccatgaatgtatgtgaattctttctgctgcactgctgagagcagtccctgggcctggactttgacaagcagatagtggctttaattgaatccagatatccatcttgtctgtctgtggaggtatttttcccagctccccctccctacccctgatcagctgcccgctgagtatctgacagccttaagctttgagcccagcatggtggccaagccttggcgtgttggattccagcttagggacctggcatccatcttcagactccctgttccctaagccaggcagacctgcccccgctgggctgagagcaaagggacaggtcctataatagccaaagctctctttacctggtcctgcttatagcactggggtgggggtagggagcaacactgggaaccccaaggttttgtcttctcctcgggacatgtatcttcccctcccctatgggtcctggagtaagactggagtgggcagggagccccactgccacctccagctgcagcagtcgatgaagtctggcgtttgtttagcttctccactcaatactctaatcctgccaaagacctaatagactattgagcagtcccgggggagggcacaagcatcatccagcagtgtgtgttgtgttttacagccgttcctgagcatgctgcccgcctgcagcgcttggcccagatccacattcagcagcaggaccagtgtgtggaaatcactgaggagtccaaggctctcctggaggaatacaacaagactacaatgcttctctccaagcaattcgtgcagtgggatgagctactttgccagctagaggccgccacgcaagtgaagccagcagaggagtgatagctgctccccatcccaaagtgggcctgggcagtcaggctccagggccctatgccaacctgcctttgttacaaggcagaggaagctttgtatttattggcttcaaggcccacctctctgtactctgggctctaaagttggaggtcaggttacctgaggtttgcaatttgcaacacccaccctccccccaatcagtgttcttatttcagtgacaataaaccatagagatg

SEQ ID NO: 8949 - DNA, 3430 bp, Homo sapiens
gaggccgcctaaaggagagccgcgctgtcgatgagtcccagtgggccacctggagcggaagtggaggagcggccggaagtagccggaatctctgaaagactgaccgactgactctgacaggatccggggctgagggaaggaggcggcggccatggagttgggcgagctgctctacaacaagtctgagtacatcgagacggcatctgggaacaaagtcagtcgccagtcagtgttgtgtggaagccagaacatcgttctcaatggcaagaccattgtgatgaatgactgtattatccgaggggatctggcaaatgtaagagttggacgtcattgtgttgtgaaaagtcgtagtgtcataaggccaccattcaagaagttcagcaaaggtgttgcattctttcctttacatattggagaccatgtctttattgaggaagattgtgtggtcaacgcagcacagattggttcctatgttcatgttgggaagaactgtgtgattgggcgccgatgtgtgttgaaagactgctgcaaaattcttgacaacacagtattacctccagaaactgtggttccaccattcactgtcttctcaggctgcccaggactcttctcaggggagctcccggagtgcactcaggagctgatgattgacgtcaccaagagctactaccagaagtttttgcccctgacgcaagtctagcatctctgcctcatgtcttgaatctgcttgagctctaagatgaacctggggacaaagtgagccagtcagcacctacaaagagcttttgtgtctttgacatctaccaccctcctccttttaaaaaatttctttagaatttctcaatcttcaaggctctaagtgcttaagaattcactaacagacagaccatctggaggagctgtcttcaaatgctgtgcttacaccttatctatgaacagtcactttgtaccattatctgtggaacacagaatcatctgttcccaacactccagccccttggtcctgtggatggctggatcccgcctgaaacggacctgcagagcagcagcacccttccggtgtggaggctatgtagctggtgcgctgctcacggccattcactgcccatgctgagcgcctctcacacaggtaatgcccagcttttctgctgctaacacatttggccagttgttgcagttgctcatcatcttgggaaaggtgtttgtgacttttcagagcccagattcctgttgtctattaaaacttgaagggaggggtgaatagtgtttctctcttcttcccaaaatgaccttagctgtcctaggatagttagtaaaagactttttagcattttgacctagggcctttggctttcactaaaagtggggacctcagtatcccagattgtaattttgccaagtgttagatttgagtctctcatgtggatgcattagtcaggtggttactccttgcttcaaggtacttaccttatttcattgaagacaccgcatttgtgaactcttgcttcctggcctagaaccattcagcctaccctgtatttgccataaactccacaattcacaccaaaatgtctgtacttagagctaattcgcatatatacaggaagggctcttagaatcagtttgtgggcacagagcctcaggagtaaatgaagttactagggctgttcttaccatctccttctggccaaatagcacaacatttcctcgttctgctctgacctcttagcttagaaggaagattcagaagtgaggggctaagaaggttgtccttgcctaatgctctgatctgtaagtgaatagggcagaacagttcagccttgaggttagaatttagcaggagctatcctgacttaatatccagttgtggggtttgcaaaacaaaacagctgtatgtaatcattgccactagttccatctagaactcctttctagtttgttatttttaaaatgtttatacataaaaccaccaaaatacatagcttcgacaagatggaagtttatttctctctcccataacagtgcagtgatagtcagctggtccaggccaggcaaggggctggtccatgatgtcatcaggcacccaggttcctactgtcttgccatgtggccacagttagcaacaaaggaggctgtaaatttagtttctacttgggcagccaaaactctgaggaaggagattctgctagtaaaaaggagtgggggaagaatggccattgggagacaacaagcagactcaaccaggcctctttgttggcttcctttcctcctgctgcacatgagccttcgccgtgcatttggagccatgacagctgatagctccagacctgcatcctcctagcttgggggctctgaatgaaaggtttcttcccttccagttcgaatttggaaactcccaaagttctcaatggtttgttgtgagttccatgtcctcttggatcagtcactgtggccatgcatgtttggccacatgattaatccagtctgggtcatgaccttttcttcatccaaaacaaggtgatgggaagacaaaaacaatagctactacaaacaataggagtttataattatgtgctgatgtattcgaagatgtgttgacagtcgtgagtgtgtatcctaggaaaggcgagctggactctgtctccatggtggctctcaccccagggacctaggaacagcctgtcaccacacaattacttttataaccctggagatgaaaatctccttgtcctcaaaatacttccagaagaacaaccagatgggaaggaccttggttgggactctttccagttcacttggggcagagggaatttaatggctcacgtagctgaaaaggatgggctagattgggcttcaggctgcatcccaggactccaaacagggatctgtctctttggctctcagctctgctttcatttgagttggctttattcttgggcttcacagtgtggccccacagcaccagttattgataaaaagagctcccctttgctgacagaactgctggatttggttctcattggtccagacgaggaaggtatccagcctcaagtcatcattgtggccaggaagatggaatacaccaaatggacaggcctggcatgtacccacagagactgagagttggtgctggtggttgtggtggcagatgatattacctgaagaagggacgaatgggtgctgggcaggacaaagcatcagctgtccagttcaggcctctcctctttccctggtgtcttcattttcctccgtctccctgctgtcccttaccctctgcccaatctctcattactcctggtcttgggagttgccttctgaggatactccactgggggtacctgagcctggattagagggcagggggaggatattgcctagccaaagtgggtgttcaataaagaaccatttggagatggtcttctgtctggaa

SEQ ID NO: 8950 - DNA, 523 bp, Homo sapiens
aggaggcggcggccatggagttgggcgagctgctctacaacaagtctgagtacatcgagacggcatctgggaacaaagtcagtcgccagtcagtgttgtgtggaagccagaacatcgttctcaatggcaagaactttgtcatttctgttttcctgagcccatatatcagatgtcacagtgcctgcagggatagaaagagatcagatgagtcagtaagactgagtgtgaacaatagagagtggtggggcctggtgaattggagaatgtgaccaatctaagcccaagctggttgttactgtgtgggaatacaggcccacgtggcaacaatcagctttccagagcgtctgattctttttcaaaagcaactggaaatctcactttttaaaatgcaagatgttccactactcaaatagtaatgtttaattttaaatgatttgttaaaatgccacgtgtccttcctgtaggagatagctaaaaaaaattaaaagaaataaataataaaaatgctgcatgagccaaacaa

SEQ ID NO: 8951 - DNA, 1127 bp, Homo sapiens
caaccctgccaggctctccaatcgcatgtggaattatcgctctacccaggcggtggtgtcgatctacgttccaattggggccgtaccatggcggagaagactcaaaagagtgtgaagattgctcctggagcagttgtatgtgtagaaagtgaaatcagaggagatgtaactatcggacctcggacagtgatccaccctaaagcaagaattattgcggaagccgggccaatagtgattggcgaagggaacctaatagaagaacaggcccttatcataaatgcttacccagataatatcactcctgacactgaagatccagaaccaaaacctatgatcattggcaccaataatgtgtttgaagttggctgttattcccaagccatgaagatgggagataataatgtcattgaatcaaaagcatatgtaggcagaaatgtaatattgacaagtggctgcatcattggggcttgttgcaacctaaatacatttgaagtcatccctgagaatacggtgatctatggtgcagactgccttcgtcgggtgcagactgagcgaccgcagccccagacactacagctggatttcttgatgaaaatcttgccaaattaccaccacctaaagaagactatgaaaggaagctcaactccagtaaagaactaagaacagtgtataacatgaagataacattttgtctttgaccactgtcttttgaatgggcccacagtgtttatgtactcttaacaactcacagaataatacatgttcactttattttgtaaaattgggttgagaggaaactaatggagtttcattgtaactgtcctttgtaatttatataaatgtattattttcctatatccttggttcttttctgataatttacagatttagcttttcttttgttatataaactgctagccacaaattttagttatgtaaaaggctacccttgacaagaaaagacatactgtcatgtatttatattctagcatagactaaactgaataaaaatgctgataacaggacctttagtaagcatactttaatcagtttttctccttgaattaatcttttctcttaatttttattatgtactagttgtattaaagctaatgtgtttacttttt

SEQ ID NO: 8952 - DNA, 3247 bp, Homo sapiens
agtctgggcgcgcggctgcagcggcggagccggagtcggagccgggagcgctagcggcagccggatcgcagcctgcggggcccgccgcagccatgggcaaccgcggcatggaagatctcatcccgctggtcaaccggctgcaagacgccttctctgccatcggccagaacgcggacctcgacctgccgcagatcgctgtggtgggcggccagagcgccggcaagagctcggtgctcgagaatttcgtaggcagggacttcttgcctcgaggatctggcattgtcacccgacgtcccctggtcttgcagctggtcaatgcaaccacagaatatgccgagttcctgcactgcaagggaaagaaattcaccgacttcgaggaggtgcgccttgagatcgaggccgagaccgacagggtcaccggcaccaacaagggcatctcgccggtgcctatcaacctccgcgtctactcgccgcacgtgctgaacctgaccctggtggacctgcccggaatgaccaaggtcccggtgggggaccaacctcccgacatcgagttccagatccgagacatgcttatgcagtttgtcaccaaggagaactgcctcatcctggccgtgtcccccgccaactctgacctggccaattctgacgccctcaaggtcgccaaggaggtggacccccagggccagcgcaccatcggggtcatcaccaagctggacctgatggacgagggcacagatgcccgtgatgtgctggagaacaagctgctccccctgcgcagaggctacattggagtggtgaaccggagccagaaggacattgatggcaagaaggacattaccgccgccttggctgctgaacgaaagttcttcctctcccatccatcttatcgccacttggctgaccgtatgggcacgccctacctgcagaaggtcctcaatcagcaactgacgaaccacatccgggacacactgccggggctgcggaacaagctgcagagccagctactgtccattgagaaggaggtggaggaatacaagaacttccgccctgatgacccagctcgcaagaccaaggccctgctgcagatggtccagcagttcgccgtagactttgagaagcgcattgagggctcaggagatcagatcgacacctacgaactgtcagggggagcccgcattaaccgaatcttccacgagcgcttccctttcgagctggtcaagatggagtttgatgagaaggaactccgaagggagatcagctatgctatcaagaatatccatggcattagaacggggctgtttaccccagacatggcctttgagaccattgtgaaaaagcaggtgaagaagatccgagaaccgtgtctcaagtgtgtggacatggttatctcggagctaatcagcaccgttagacagtgcaccaagaagctccagcagtacccgcggctacgggaggagatggagcgcatcgtgaccacccacatccgggagcgcgagggccgcactaaggagcaggtcatgcttctcatcgatatcgagctggcttacatgaacaccaaccatgaggacttcataggctttgccaatgctcagcagaggagcaaccagatgaacaagaagaagacttcagggaaccaggatgagattctggtcatccgcaagggctggctgactatcaataatattggcatcatgaaagggggctccaaggagtactggtttgtgctgactgctgagaatctgtcctggtacaaggatgatgaggagaaagagaagaaatacatgctgtctgtggacaacctcaagctgcgggacgtggagaagggctttatgtcgagcaagcatatctttgccctctttaacacggagcagaggaatgtctacaaggattatcggcagctggagctagcctgtgagacacaggaggaggtggacagctggaaggcctccttcctgagggctggcgtgtaccctgagcgtgttggggacaaagagaaagccagcgagaccgaggagaatggctccgacagcttcatgcattccatggacccacagctggaacggcaagtggagaccatccggaatcttgtggactcatacatggccattgtcaacaagaccgtgagggacctcatgcccaagaccatcatgcacctcatgattaacaataccaaggagttcatcttctcggagctgctggccaacctgtactcgtgtggggaccagaacacgctgatggaggagtcggcggagcaggcacagcggcgcgacgagatgctgcgcatgtaccacgcactgaaggaggcgctcagcatcatcggcgacatcaacacgaccaccgtcagcacgcccatgcccccgcccgtggacgactcctggctgcaggtgcagagcgtaccggccggacgcaggtcgcccacgtccagccccacgccgcagcgccgagcccccgccgtgcccccagcccggcccgggtcgcggggccctgctcctgggcctccgcctgctgggtccgccctggggggggcgccccccgtgccctccaggccgggggcttcccctgaccctttcggccctccccctcaggtgccctcgcgccccaaccgcgccccgcccggggtccccagaatcactatcagtgacccctgaggagcgtcagccatgccgatcgggtcaggcaagtccatcccgtcctgagagccccaggccccccttcgacctctaaacagatccctcctcttctcggagacctccctttccaagcctgcctggacggctgttctgtgacttgacagtggctcccccagccccaaagccagcccccttcatctgtgacttaatctgttgtagtggtgagctgatacattcaggtgtgaccgttggtgaaaacttgtgccccttctgtggtatgcccttgccctgttctataaatatctataaatactcatatatatacacacctacacatggccaaccgcctcgcctctagcgctgggaatcagtcactgtgctatccttgtggagtcttgtggcccaactaccagagaacgctgtcccccgacatcccactccaaagtgtgccacctccagtgagcctccttgtcatgcccggcctgtggacagccagcccccgccatccctcccaccccctaccaagcatgggggtgctgtgcaggcagccgtgtggcctgacagtttctaccagtcctgctgtccctcggctgagaataaaacccatttctggatga

SEQ ID NO: 8953 - DNA, 3221 bp, Homo sapiens
agtctgggcgcgcggctgcagcggcggagccggagtcggagccgggagcgctagcggcagccggatcgcagcctgcggggcccgccgcagccatgggcaaccgcggcatggaagatctcatcccgctggtcaaccggctgcaagacgccttctctgccatcggccagaacgcggacctcgacctgccgcagatcgctgtggtgggcggccagagcgccggcaagagctcggtgctcgagaatttcgtaggcagggacttcttgcctcgaggatctggcattgtcacccgacgtcccctggtcttgcagctggtcaatgcaaccacagaatatgccgagttcctgcactgcaagggaaagaaattcaccgacttcgaggaggtgcgccttgagatcgaggccgagaccgacagggtcaccggcaccaacaagggcatctcgccggtgcctatcaacctccgcgtctactcgccgcacgtgctgaacctgaccctggtggacctgcccggaatgaccaaggtcccggtgggggaccaacctcccgacatcgagttccagatccgagacatgcttatgcagtttgtcaccaaggagaactgcctcatcctggccgtgtcccccgccaactctgacctggccaattctgacgccctcaaggtcgccaaggaggtggacccccagggccagcgcaccatcggggtcatcaccaagctggacctgatggacgagggcacagatgcccgtgatgtgctggagaacaagctgctccccctgcgcagaggctacattggagtggtgaaccggagccagaaggacattgatggcaagaaggacattaccgccgccttggctgctgaacgaaagttcttcctctcccatccatcttatcgccacttggctgaccgtatgggcacgccctacctgcagaaggtcctcaatcagcaactgacgaaccacatccgggacacactgccggggctgcggaacaagctgcagagccagctactgtccattgagaaggaggtggaggaatacaagaacttccgccctgatgacccagctcgcaagaccaaggccctgctgcagatggtccagcagttcgccgtagactttgagaagcgcattgagggctcaggagatcagatcgacacctacgaactgtcagggggagcccgcattaaccgaatcttccacgagcgcttccctttcgagctggtcaagatggagtttgatgagaaggaactccgaagggagatcagctatgctatcaagaatatccatggcattagaacggggctgtttaccccagacatggcctttgagaccattgtgaaaaagcaggtgaagaagatccgagaaccgtgtctcaagtgtgtggacatggttatctcggagctaatcagcaccgttagacagtgcaccaagaagctccagcagtacccgcggctacgggaggagatggagcgcatcgtgaccacccacatccgggagcgcgagggccgcactaaggagcaggtcatgcttctcatcgatatcgagctggcttacatgaacaccaaccatgaggacttcataggctttgccaatgctcagcagaggagcaaccagatgaacaagaagaagacttcagggaaccaggatgagattctggtcatccgcaagggctggctgactatcaataatattggcatcatgaaagggggctccaaggagtactggtttgtgctgactgctgagaatctgtcctggtacaaggatgatgaggagaaagagaagaaatacatgctgtctgtggacaacctcaagctgcgggacgtggagaagggctttatgtcgagcaagcatatctttgccctctttaacacggagcagaggaatgtctacaaggattatcggcagctggagctagcctgtgagacacaggaggaggtggacagctggaaggcctccttcctgagggctggcgtgtaccctgagcgtgttggggacaaagagaaagccagcgagaccgaggagaatggctccgacagcttcatgcattccatggacccacagctggaacggcaagtggagaccatccggaatcttgtggactcatacatggccattgtcaacaagaccgtgagggacctcatgcccaagaccatcatgcacctcatgattaacaataccaaggagttcatcttctcggagctgctggccaacctgtactcgtgtggggaccagaacacgctgatggaggagtcggcggagcaggcacagcggcgcgacgagatgctgcgcatgtaccacgcactgaaggaggcgctcagcatcatcggcgacatcaacacgaccaccgtcagcacgcccatgcccccgcccgtggacgactcctggctgcaggtgcagagcgtaccggccggacgcaggtcgcccacgtccagccccacgccgcagcgccgagcccccgccgtgcccccagcccggcccgggtcgcggggccctgctcctgggcctccgcctgctgggtccgccctggggggggcgccccccgtgccctccaggccgggggcttcccctgaccctttcggccctccccctcaggtgccctcgcgccccaaccgcgccccgcccggggtccccagccgatcgggtcaggcaagtccatcccgtcctgagagccccaggccccccttcgacctctaaacagatccctcctcttctcggagacctccctttccaagcctgcctggacggctgttctgtgacttgacagtggctcccccagccccaaagccagcccccttcatctgtgacttaatctgttgtagtggtgagctgatacattcaggtgtgaccgttggtgaaaacttgtgccccttctgtggtatgcccttgccctgttctataaatatctataaatactcatatatatacacacctacacatggccaaccgcctcgcctctagcgctgggaatcagtcactgtgctatccttgtggagtcttgtggcccaactaccagagaacgctgtcccccgacatcccactccaaagtgtgccacctccagtgagcctccttgtcatgcccggcctgtggacagccagcccccgccatccctcccaccccctaccaagcatgggggtgctgtgcaggcagccgtgtggcctgacagtttctaccagtcctgctgtccctcggctgagaataaaacccatttctggatgatggggaatgtc

SEQ ID NO: 8954 - DNA, 2096 bp, Homo sapiens
agtctgggcgcgcggctgcagcggcggagccggagtcggagccgggagcgctagcggcagccggatcgcagcctgcggggcccgccgcagccatgggcaaccgcggcatggaagatctcatcccgctggtcaaccggctgcaagacgccttctctgccatcggccagaacgcggacctcgacctgccgcagatcgctgtggtgggcggccagagcgccggcaagagctcggtgctcgagaatttcgtaggcagggacttcttgcctcgaggatctggcattgtcacccgacgtcccctggtcttgcagctggtcaatgcaaccacagaatatgccgagttcctgcactgcaagggaaagaaattcaccgacttcgaggaggtgcgccttgagatcgaggccgagaccgacagggtcaccggcaccaacaagggcatctcgccggtgcctatcaacctccgcgtctactcgccgcacgtgctgaacctgaccctggtggacctgcccggaatgaccaaggtcccggtgggggaccaacctcccgacatcgagttccagatccgagacatgcttatgcagtttgtcaccaaggagaactgcctcatcctggccgtgtcccccgccaactctgacctggccaattctgacgccctcaaggtcgccaaggaggtggacccccagggccagcgcaccatcggggtcatcaccaagctggacctgatggacgagggcacagatgcccgtgatgtgctggagaacaagctgctccccctgcgcagaggctacattggagtggtgaaccggagccagaaggacattgatggcaagaaggacattaccgccgccttggctgctgaacgaaagttcttcctctcccatccatcttatcgccacttggctgaccgtatgggcacgccctacctgcagaaggtcctcaatcagcaactgacgaaccacatccgggacacactgccggggctgcggaacaagctgcagagccagctactgtccattgagaaggaggtggaggaatacaagaacttccgccctgatgacccagctcgcaagaccaaggccctgctgcagatggtccagcagttcgccgtagactttgagaagcgcattgagggctcaggagatcagatcgacacctacgaactgtcagggggagcccgcattaaccgaatcttccacgagcgcttccctttcgagctggtcaagatggagtttgatgagaaggaactccgaagggagatcagctatgctatcaagaatatccatggcattagaacggggctgtttaccccagacatggcctttgagaccattgtgaaaaagcaggtgaagaagatccgagaaccgtgtctcaagtgtgtggacatggttatctcggagctaatcagcaccgttagacagtgcaccaagaagctccagcagtacccgcggctacgggaggagatggagcgcatcgtgaccacccacatccgggagcgcgagggccgcactaaggagcaggtcatgcttctcatcgatatcgagctggcttacatgaacaccaaccatgaggacttcataggctttgccaatgctcagcagaggagcaaccagatgaacaagaagaagacttcagggaaccagatcaccctccaggtcatccgcaagggctggctgactatcaataatattggcatcatgaaagggggctccaaggagtactggtttgtgctgactgctgagaatctgtcctggtacaaggatgatgaggagaaagagaagaaatacatgctgtctgtggacaacctcaagctgcgggacgtggagaagggctttatgtcgagcaagcatatctttgccctctttaacacggagcagaggaatgtctacaaggattatcggcagctggagctagcctgtgagacacaggaggaggtggacagctggaaggcctccttcctgagggctggcgtgtaccctgagcgtgttggggacaaagagaaagtgagtgtgcccttctcttgcctcctgccaggcatctgcagcctggcaccagctccagccaggttttcaagcaagggacctggagatgttcttttctaa

SEQ ID NO: 8955 - DNA, 3211 bp, Homo sapiens
gagccgggagcgctagcggcagccggatcgcagcctgcggggcccgccgcagccatgggcaaccgcggcatggaagatctcatcccgctggtcaaccggctgcaagacgccttctctgccatcggccagaacgcggacctcgacctgccgcagatcgctgtggtgggcggccagagcgccggcaagagctcggtgctcgagaatttcgtaggcagggacttcttgcctcgaggatctggcattgtcacccgacgtcccctggtcttgcagctggtcaatgcaaccacagaatatgccgagttcctgcactgcaagggaaagaaattcaccgacttcgaggaggtgcgccttgagatcgaggccgagaccgacagggtcaccggcaccaacaagggcatctcgccggtgcctatcaacctccgcgtctactcgccgcacgtgctgaacctgaccctggtggacctgcccggaatgaccaaggtcccggtgggggaccaacctcccgacatcgagttccagatccgagacatgcttatgcagtttgtcaccaaggagaactgcctcatcctggccgtgtcccccgccaactctgacctggccaattctgacgccctcaaggtcgccaaggaggtggacccccagggccagcgcaccatcggggtcatcaccaagctggacctgatggacgagggcacagatgcccgtgatgtgctggagaacaagctgctccccctgcgcagaggctacattggagtggtgaaccggagccagaaggacattgatggcaagaaggacattaccgccgccttggctgctgaacgaaagttcttcctctcccatccatcttatcgccacttggctgaccgtatgggcacgccctacctgcagaaggtcctcaatcagcaactgacgaaccacatccgggacacactgccggggctgcggaacaagctgcagagccagctactgtccattgagaaggaggtggaggaatacaagaacttccgccctgatgacccagctcgcaagaccaaggccctgctgcagatggtccagcagttcgccgtagactttgagaagcgcattgagggctcaggagatcagatcgacacctacgaactgtcagggggagcccgcattaaccgaatcttccacgagcgcttccctttcgagctggtcaagatggagtttgatgagaaggaactccgaagggagatcagctatgctatcaagaatatccatggcattaggacgggcctcttcacacctgacctcgcttttgaagccacagtgaaaaagcaggtgcagaagctcaaagagcccagtatcaagtgtgtggatatggtagtcagtgagctcacagccaccatcagaaagtgtagcgaaaagctccagcagtacccgcggctacgggaggagatggagcgcatcgtgaccacccacatccgggagcgcgagggccgcactaaggagcaggtcatgcttctcatcgatatcgagctggcttacatgaacaccaaccatgaggacttcataggctttgccaatgctcagcagaggagcaaccagatgaacaagaagaagacttcagggaaccaggatgagattctggtcatccgcaagggctggctgactatcaataatattggcatcatgaaagggggctccaaggagtactggtttgtgctgactgctgagaatctgtcctggtacaaggatgatgaggagaaagagaagaaatacatgctgtctgtggacaacctcaagctgcgggacgtggagaagggctttatgtcgagcaagcatatctttgccctctttaacacggagcagaggaatgtctacaaggattatcggcagctggagctagcctgtgagacacaggaggaggtggacagctggaaggcctccttcctgagggctggcgtgtaccctgagcgtgttggggacaaagagaaagccagcgagaccgaggagaatggctccgacagcttcatgcattccatggacccacagctggaacggcaagtggagaccatccggaatcttgtggactcatacatggccattgtcaacaagaccgtgagggacctcatgcccaagaccatcatgcacctcatgattaacaataccaaggagttcatcttctcggagctgctggccaacctgtactcgtgtggggaccagaacacgctgatggaggagtcggcggagcaggcacagcggcgcgacgagatgctgcgcatgtaccacgcactgaaggaggcgctcagcatcatcggcgacatcaacacgaccaccgtcagcacgcccatgcccccgcccgtggacgactcctggctgcaggtgcagagcgtaccggccggacgcaggtcgcccacgtccagccccacgccgcagcgccgagcccccgccgtgcccccagcccggcccgggtcgcggggccctgctcctgggcctccgcctgctgggtccgccctggggggggcgccccccgtgccctccaggccgggggcttcccctgaccctttcggccctccccctcaggtgccctcgcgccccaaccgcgccccgcccggggtccccagaatcactatcagtgacccctgaggagcgtcagccatgccgatcgggtcaggcaagtccatcccgtcctgagagccccaggccccccttcgacctctaaacagatccctcctcttctcggagacctccctttccaagcctgcctggacggctgttctgtgacttgacagtggctcccccagccccaaagccagcccccttcatctgtgacttaatctgttgtagtggtgagctgatacattcaggtgtgaccgttggtgaaaacttgtgccccttctgtggtatgcccttgccctgttctataaatatctataaatactcatatatatacacacctacacatggccaaccgcctcgcctctagcgctgggaatcagtcactgtgctatccttgtggagtcttgtggcccaactaccagagaacgctgtcccccgacatcccactccaaagtgtgccacctccagtgagcctccttgtcatgcccggcctgtggacagccagcccccgccatccctcccaccccctaccaagcatgggggtgctgtgcaggcagccgtgtggcctgacagtttctaccagtcctgctgtccctcggctgagaataaaacccatttctggatgatg

SEQ ID NO: 8956 - DNA, 2817 bp, Homo sapiens
agtctgggcgcgcggctgcagcggcggagccggagtcggagccgggagcgctagcggcagccggatcgcagcctgcggggcccgccgcagccatgggcaaccgcggcatggaagatctcatcccgctggtcaaccggctgcaagacgccttctctgccatcggccagaacgcggacctcgacctgccgcagatcgctgtggtgggcggccagagcgccggcaagagctcggtgctcgagaatttcgtaggcagggacttcttgcctcgaggatctggcattgtcacccgacgtcccctggtcttgcagctggtcaatgcaaccacagaatatgccgagttcctgcactgcaagggaaagaaattcaccgacttcgaggaggtgcgccttgagatcgaggccgagaccgacagggtcaccggcaccaacaagggcatctcgccggtgcctatcaacctccgcgtctactcgccgcacgtgctgaacctgaccctggtggacctgcccggaatgaccaaggtcccggtgggggaccaacctcccgacatcgagttccagatccgagacatgcttatgcagtttgtcaccaaggagaactgcctcatcctggccgtgtcccccgccaactctgacctggccaattctgacgccctcaaggtcgccaaggaggtggacccccagggccagcgcaccatcggggtcatcaccaagctggacctgatggacgagggcacagatgcccgtgatgtgctggagaacaagctgctccccctgcgcagaggctacattggagtggtgaaccggagccagaaggacattgatggcaagaaggacattaccgccgccttggctgctgaacgaaagttcttcctctcccatccatcttatcgccacttggctgaccgtatgggcacgccctacctgcagaaggtcctcaatcagcaactgacgaaccacatccgggacacactgccggggctgcggaacaagctgcagagccagctactgtccattgagaaggaggtggaggaatacaagaacttccgccctgatgacccagctcgcaagaccaaggccctgctgcagatggtccagcagttcgccgtagactttgagaagcgcattgagggctcaggagatcagatcgacacctacgaactgtcagggggagcccgcattaaccgaatcttccacgagcgcttccctttcgagctggtcaagatggagtttgatgagaaggaactccgaagggagatcagctatgctatcaagaatatccatggcattaggacgggcctcttcacacctgacctcgcttttgaagccacagtgaaaaagcaggtgcagaagctcaaagagcccagtatcaagtgtgtggatatggtagtcagtgagctcacagccaccatcagaaagtgtagcgaaaagctccagcagtacccgcggctacgggaggagatggagcgcatcgtgaccacccacatccgggagcgcgagggccgcactaaggagcaggtcatgcttctcatcgatatcgagctggcttacatgaacaccaaccatgaggacttcataggctttgccaatgctcagcagaggagcaaccagatgaacaagaagaagacttcagggaaccaggatgagattctggtcatccgcaagggctggctgactatcaataatattggcatcatgaaagggggctccaaggagtactggtttgtgctgactgctgagaatctgtcctggtacaaggatgatgaggagaaagagaagaaatacatgctgtctgtggacaacctcaagctgcgggacgtggagaagggctttatgtcgagcaagcatatctttgccctctttaacacggagcagaggaatgtctacaaggattatcggcagctggagctagcctgtgagacacaggaggaggtggacagctggaaggcctccttcctgagggctggcgtgtaccctgagcgtgttggggacaaagagaaagccagcgagaccgaggagaatggctccgacagcttcatgcattccatggacccacagctggaacggcaagtggagaccatccggaatcttgtggactcatacatggccattgtcaacaagaccgtgagggacctcatgcccaagaccatcatgcacctcatgattaacaataccaaggagttcatcttctcggagctgctggccaacctgtactcgtgtggggaccagaacacgctgatggaggagtcggcggagcaggcacagcggcgcgacgagatgctgcgcatgtaccacgcactgaaggaggcgctcagcatcatcggcgacatcaacacgaccaccgtcagcacgcccatgcccccgcccgtggacgactcctggctgcaggtgcagagcgtaccggccggacgcaggtcgcccacgtccagccccacgccgcagcgccgagcccccgccgtgcccccagcccggcccgggtcgcggggccctgctcctgggcctccgcctgctgggtccgccctggggggggcgccccccgtgccctccaggccgggggcttcccctgaccctttcggccctccccctcaggtgccctcgcgccccaaccgcgccccgcccggggtccccagaatcactatcagtgacccctgaggagcgtcagccatggaagggcccagcctcacctacgagacctgcagccccccgaccagctgaggctcccctcttagacttataagtctatggccactggcatccggctgcctgccctccctgcctcccccagggtcccttcagagggtcctgggttttctgaacaccc

SEQ ID NO: 8957 - DNA, 3143 bp, Homo sapiens
gcagcctgcggggcccgccgcagccatgggcaaccgcggcatggaagatctcatcccgctggtcaaccggctgcaagacgccttctctgccatcggccagaacgcggacctcgacctgccgcagatcgctgtggtgggcggccagagcgccggcaagagctcggtgctcgagaatttcgtaggcagggacttcttgcctcgaggatctggcattgtcacccgacgtcccctggtcttgcagctggtcaatgcaaccacagaatatgccgagttcctgcactgcaagggaaagaaattcaccgacttcgaggaggtgcgccttgagatcgaggccgagaccgacagggtcaccggcaccaacaagggcatctcgccggtgcctatcaacctccgcgtctactcgccgcacgtgctgaacctgaccctggtggacctgcccggaatgaccaaggtcccggtgggggaccaacctcccgacatcgagttccagatccgagacatgcttatgcagtttgtcaccaaggagaactgcctcatcctggccgtgtcccccgccaactctgacctggccaattctgacgccctcaaggtcgccaaggaggtggacccccagggccagcgcaccatcggggtcatcaccaagctggacctgatggacgagggcacagatgcccgtgatgtgctggagaacaagctgctccccctgcgcagaggctacattggagtggtgaaccggagccagaaggacattgatggcaagaaggacattaccgccgccttggctgctgaacgaaagttcttcctctcccatccatcttatcgccacttggctgaccgtatgggcacgccctacctgcagaaggtcctcaatcagcaactgacgaaccacatccgggacacactgccggggctgcggaacaagctgcagagccagctactgtccattgagaaggaggtggaggaatacaagaacttccgccctgatgacccagctcgcaagaccaaggccctgctgcagatggtccagcagttcgccgtagactttgagaagcgcattgagggctcaggagatcagatcgacacctacgaactgtcagggggagcccgcattaaccgaatcttccacgagcgcttccctttcgagctggtcaagatggagtttgatgagaaggaactccgaagggagatcagctatgctatcaagaatatccatggcattaggacgggcctcttcacacctgacctcgcttttgaagccacagtgaaaaagcaggtgcagaagctcaaagagcccagtatcaagtgtgtggatatggtagtcagtgagctcacagccaccatcagaaagtgtagcgaaaagctccagcagtacccgcggctacgggaggagatggagcgcatcgtgaccacccacatccgggagcgcgagggccgcactaaggagcaggtcatgcttctcatcgatatcgagctggcttacatgaacaccaaccatgaggacttcataggctttgccaatgctcagcagaggagcaaccagatgaacaagaagaagacttcagggaaccaggatgagattctggtcatccgcaagggctggctgactatcaataatattggcatcatgaaagggggctccaaggagtactggtttgtgctgactgctgagaatctgtcctggtacaaggatgatgaggagaaagagaagaaatacatgctgtctgtggacaacctcaagctgcgggacgtggagaagggctttatgtcgagcaagcatatctttgccctctttaacacggagcagaggaatgtctacaaggattatcggcagctggagctagcctgtgagacacaggaggaggtggacagctggaaggcctccttcctgagggctggcgtgtaccctgagcgtgttggggacaaagagaaagccagcgagaccgaggagaatggctccgacagcttcatgcattccatggacccacagctggaacggcaagtggagaccatccggaatcttgtggactcatacatggccattgtcaacaagaccgtgagggacctcatgcccaagaccatcatgcacctcatgattaacaataccaaggagttcatcttctcggagctgctggccaacctgtactcgtgtggggaccagaacacgctgatggaggagtcggcggagcaggcacagcggcgcgacgagatgctgcgcatgtaccacgcactgaaggaggcgctcagcatcatcggcgacatcaacacgaccaccgtcagcacgcccatgcccccgcccgtggacgactcctggctgcaggtgcagagcgtaccggccggacgcaggtcgcccacgtccagccccacgccgcagcgccgagcccccgccgtgcccccagcccggcccgggtcgcggggccctgctcctgggcctccgcctgctgggtccgccctggggggggcgccccccgtgccctccaggccgggggcttcccctgaccctttcggccctccccctcaggtgccctcgcgccccaaccgcgccccgcccggggtccccagccgatcgggtcaggcaagtccatcccgtcctgagagccccaggccccccttcgacctctaaacagatccctcctcttctcggagacctccctttccaagcctgcctggacggctgttctgtgacttgacagtggctcccccagccccaaagccagcccccttcatctgtgacttaatctgttgtagtggtgagctgatacattcaggtgtgaccgttggtgaaaacttgtgccccttctgtggtatgcccttgccctgttctataaatatctataaatactcatatatatacacacctacacatggccaaccgcctcgcctctagcgctgggaatcagtcactgtgctatccttgtggagtcttgtggcccaactaccagagaacgctgtcccccgacatcccactccaaagtgtgccacctccagtgagcctccttgtcatgcccggcctgtggacagccagcccccgccatccctcccaccccctaccaagcatgggggtgctgtgcaggcagccgtgtggcctgacagtttctaccagtcctgctgtccctcggctgagaataaaacccatttctggatga

SEQ ID NO: 8958 - DNA, 4103 bp, Homo sapiens
taatagagacggggtttctccatgttggtcaggctggtctcgaactcccgacctcaggtgatctgcccacctcggcctcccaatgtactgggattacaggtgcaagccaccgcaaccggccacttttgccttttgattggtttagtggatcataattatttttttccttataggcaaaactcacctttgcctatctttgtgtatatattttttcctcccctcgagttttctaaggttatcaagtcactcctgccagaagtttaatgagtgttaataagtgaactctcattactgccagccctgctgggattagacttgccatctctgagtgaaatgaagagtttaatgttgggcatgggatgtgctgctcagttctctcaacaactctaggagggaaggtgtcattactaccccattttccacatggagaaactgaggcccagagaggtctggtcatttttctaaggagagtcagcggacagcggctggctttgaacccagggctgaatggctccaggggctgtgtccctgactgctaacccggtgggctccaggctgatcgccccctcagccaagggctgagaggggaacgttccttttgaaaagctggcggaacatcctggaaatgttcagaggcagccagaatggaaaaagatgctcaaaggggacagaacttctcaaaggggtggaggctgccctgccatgggtgacacgtggaaaacttgagacatgtgacatccaggcggttagtgggagaattggtcatgctctttggcaaattgcgccctcctcctccctccttctccctgctcctccaaactctaccctgggagggagcacttgggaccacctcagaggaggcctggtggctgtgacccagtcccaaatgtctgcccagacttggagactgcaaagagcgggagcccttccttgagcctcaggagcagtggggttcacagggcccctctagtcaccgtttttaagcccctggtctcagactgcccctccctcaggtctcctgagcttagccacatcatccacgcccttggcacagccacgggatgatgggtgtgatgcgggcatccctcgtgttggcatcctggaccgatatccagggccctgctttctccccatcctcctgcctctcccatgcccctcctcaaaactccttggcctccatcctgccctcagaatcaccacctgtgactcaggcacaccaatccctgggcctcttcctccactgggggacccacctgaagggcctgacccagccacgggaagaaggacgaggagcgctcccagctttgccccatcgtgctgcctgggccccaggtggccaccgcgtggagagggtgggcccacaggactggagcccctgggggtgggctcccaccatcagaaatgcactgagtctcctccccggaagagctgatcatgggccagagggctgaggaccctgtgccactcaccctggcatccatccttcattcattccctcattctccaacacgccctcttccagcactggccatgggcctggccctgccccagccctgcctcggggacagttgccacccagttgattggaggaggtggagtgggagaggagtggagagaggcccctaactcagctctcaagcagtcggggcaggctttctggaggagctgaagtccggcagaaccttgtagtcaagtgaatcacctgggctgtgcccagagcccgactgagctgagggcacgattcgcaggcagagggggacgggtttggagcaacttccccttcagcctcccttcataagaactggggggaaagaggtgctgctgagctcctaccccaaaggagtggggtcgagacagtgtggctggccagagccgggcagatgtggctggggatggtggtgccgggcaggggcatgcaagggagacagagctgaatggattccaccaagagggccagggcccagccaggccccgcggggtactgctcatgctgctggcccccgccttgcatgtcccccagccctcgcatgcttttgcttgtgtttcctgcatgtcctctggtgtgactgctggttttcccctgaaccccctccccagctctgacaaggagcattgcctgtcccagcctgactcaggaggccaactggcaccttgggccctgtcctcccccgattcctcctggataggaatccagaggctgtcccctgcctgattccccatctagctgtccctccacgcctttaggaaggcacagggtagccctgagtatgagggaacaccttgggagctaacggtccccagaggccttaacctaaccagtctgcggggcaggctcattcccatggcctttctcccacgggaaccacccctctgccctgaagttgcccaggtaggccagtgaagagggcccggaaccaggaagacccttgaatcaccatttggaacccacacttgggggaaaggggtggccgtggcttggtgccatcagcgtcctgggaccctaggtctctcttccccgcgttgtgggcattctgtgtgtgcctcccaccctgcgccgcggatccctggactcgtggggtgtgggtgctccctgcccgtgccctctgtgtacgtggctttctgccctcctgcccttccccagctccagcagtacccgcggctacgggaggagatggagcgcatcgtgaccacccacatccgggagcgcgagggccgcactaaggagcaggtcatgcttctcatcgatatcgagctggcttacatgaacaccaaccatgaggacttcataggctttgccaatgctcagcagaggagcaaccagatgaacaagaagaagacttcagggaaccaggatgagattctggtcatccgcaagggctggctgactatcaataatattggcatcatgaaagggggctccaaggagtactggtttgtgctgactgctgagaatctgtcctggtacaaggatgatgaggagaaagagaagaaatacatgctgtctgtggacaacctcaagctgcgggacgtggagaagggctttatgtcgagcaagcatatctttgccctctttaacacggagcagaggaatgtctacaaggattatcggcagctggagctagcctgtgagacacaggaggaggtggacagctggaaggcctccttcctgagggctggcgtgtaccctgagcgtgttggggacaaagagaaagccagcgagaccgaggagaatggctccgacagcttcatgcattccatggacccacagctggaacggcaagtggagaccatccggaatcttgtggactcatacatggccattgtcaacaagaccgtgagggacctcatgcccaagaccatcatgcacctcatgattaacaataccaaggagttcatcttctcggagctgctggccaacctgtactcgtgtggggaccagaacacgctgatggaggagtcggcggagcaggcacagcggcgcgacgagatgctgcgcatgtaccacgcactgaaggaggcgctcagcatcatcggcgacatcaacacgaccaccgtcagcacgcccatgcccccgcccgtggacgactcctggctgcaggtgcagagcgtaccggccggacgcaggtcgcccacgtccagccccacgccgcagcgccgagcccccgccgtgcccccagcccggcccgggtcgcggggccctgctcctgggcctccgcctgctgggtccgccctggggggggcgccccccgtgccctccaggccgggggcttcccctgaccctttcggccctccccctcaggtgccctcgcgccccaaccgcgccccgcccggggtccccagaatcactatcagtgacccctgaggagcgtcagccatgcaggaagggcccagcctcacctacgagacctgcagccccccgacatcccactccaaagtgtgccacctccagtgagcctccttgtcatgcccggcctgtggacagccagcccccgccatccctcccaccccctaccaagcatgggggtgctgtgcaggcagccgtgtggcctgacagtttctaccagtcctgctgtccctcggctgagaataaaacccatttctgg

SEQ ID NO: 8959 - DNA, 1886 bp, Homo sapiens
gcatggcctgccgggagggggcaggtagccggcgggcccggtccaatgggtgccggcttccgaggagagggcggaggagaggaggaaggaggcgaactgtgggccccggccccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaaggttgcatctggaggtggtggggttggagatggtgttcaagaaccaaccacaggcaactggagaggaatgctgaaaacttcaaaagctgaagagttattagcagaaaaaaaaaaaaaaaaaaaaaaaaag

SEQ ID NO: 8960 - DNA, 3101 bp, Homo sapiens
gggccccggccccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaaggttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtgccagttcctgttgcacgaaaactatctgctcgggaacagcgagattgtgaggttattgaacgactcattaaatcatattttctcattgtcagaaagaatattcaagacagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattccaaattgcagaacacatcacacatttaatccaaataataaatggctgtttctaaagtttcccagtatatataaaatacatcaagtctgtcttgtgacagtttcatctgaacttaacttaaaaacaactgttaatgttctagttgtgcaaagcagtttgcctgtggataagatgacctgtgtaataatctttgttagtagtcttaaagctgctgccatagtcctccaagaagaaagcaccaagacaacatttcatatgactataatgcatgtactatataagctgatctggctttgaaagatgtgagttggcaagttcctcacatagagtcattgtattccacctgtccttcaatttagttttttctgagcttctttgcagcctttgatgtgtttttaagaaagctgaatgcacaagaggatctgtgacactgacatggctgtggtgtgcatactgtgtagttacatagcccttccaattctgggtccatttgcactagcaaattaaaatatgctttgattcatacttaaacctgaaagcaggaatgcctacattaattcctacattaaaaacagccatctacccttgattatctagaaagacttggtaatgatggtcagttccttttagatttcagaaaatcaaatgatgacctaaatttcccttaatttgcaaatacagtagtaattaaggtacatctctaaagtggagcacttacaccaggctctaagattcactttgaggtggaacttaaaaccagtgtactgtatgtatgcattggtaatagctacttt

SEQ ID NO: 8961 - DNA, 4618 bp, Homo sapiens
gcatggcctgccgggagggggcaggtagccggcgggcccggtccaatgggtgccggcttccgaggagagggcggaggagaggaggaaggaggcgaactgtgggccccggccccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatgaccctgctacatggaaaaactcaagacacctttctaaaggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaagtcttctaaagttccaagtgctttggcacctgcctcccaggagccctcccccgctgcttctgctgaggctgatggcaaggttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtgccagttcctgttgcacgaaaactatctgctcgggaacagcgagattgtgaggttattgaacgactcattaaatcatattttctcattgtcagaaagaatattcaagacagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattccaaattgcagaacacatcacacatttaatccaaataataaatggctgtttctaaagtttcccagtatatataaaatacatcaagtctgtcttgtgacagtttcatctgaacttaacttaaaaacaactgttaatgttctagttgtgcaaagcagtttgcctgtggataagatgacctgtgtaataatctttgttagtagtcttaaagctgctgccatagtcctccaagaagaaagcaccaagacaacatttcatatgactataatgcatgtactatataagctgatctggctttgaaagatgtgagttggcaagttcctcacatagagtcattgtattccacctgtccttcaatttagttttttctgagcttctttgcagcctttgatgtgtttttaagaaagctgaatgcacaagaggatctgtgacactgacatggctgtggtgtgcatactgtgtagttacatagcccttccaattctgggtccatttgcactagcaaattaaaatatgctttgattcatacttaaacctgaaagcaggaatgcctacattaattcctacattaaaaacagccatctacccttgattatctagaaagacttggtaatgatggtcagttccttttagatttcagaaaatcaaatgatgacctaaatttcccttaatttgcaaatacagtagtaattaaggtacatctctaaagtggagcacttacaccaggctctaagattcactttgaggtggaacttaaaaccagtgtactgtatgtatgcattggtaatagctacttttgcttcatagcttcataccaacaaaatatatttattagaatagtatgaaagtactggaggagctgaaagaaaaacacccaaggctgggcgtggtggcacacgcctgtaatcccagcactttgggaggccgaggcaggtggatcacctgaggttgggagttggagaccagcttgaccaacatggagaaaccccgtctctactaaaaatacaaaattggccgggcgtggtggcgcatgcctgtaatcccagctactcgggagggtgaggcaggagaattgcttgaccctgggaggtggaggttgtggtgagctaagatcgtgccattgcactccagccttggcaacaagagcgaaactccgtctcaaaaaaaaaaaataaaacaacacccagatagatacacatactccttcagacttacagacctaagctgcatttatggggtagtgatgaggtttagaacatatacatattttgttaaaattccccagatgattcttggtatgaacgactatattataaattttaagatgtacttagaaatccttaagacatctagccccgtctctaatagacaacacatttatattgcagatattacttttttttcagtttatgaccaggtatttatgaaggactattggcagggaaaatatgaatatgttaactttagcttatggcatcaatttactaaggaacaacaggctcaccaactgatgtcaaacataaaaacccccacatcagtctgatacgatatggtactactttgaatctgttactagtaccatcttgacagaggatacatgctcccaaaacgtttgttaccacacttaaaaatcactgccatcattaagcatcagtttcaaaattatagccattcatgatttactttttccagatgactatcattattctagtcctttgaatttgtaaggggaaaaaaaacaaaaacaaaaacttacgatgcacttttctccagcacatcagatttcaaattgaaaattaaagacatgctatggtaatgcacttgctagtactacacactttgtacaacaaaaaacagaggcaagaaacaacggaaagagaaaagccttcctttgttggcccttaaactgagtcaagatctgaaatgtagagatgatctctgacgatacctgtatgttcttattgtgtaaataaaattgctggtatgaaatgacactaaagtttgtcaaaaaatgaattcttaacttttctcccagagaaagggagacaaaaggagctttttaatacctaatctactttggaacataaccgtatagag

SEQ ID NO: 8962 - DNA, 2097 bp, Homo sapiens
attgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatgaccctgctacatggaaaaactcaagacacctttctaaaggggtggaagcagaagaatggggtaaatttcttcacaccaaaaataaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaagtcttctaaagttccaagtgctttggcacctgcctcccaggagccctcccccgctgcttctgctgaggctgatggcaagttaattcaggacagcagaagagaaactaaaaatgttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtgccagttcctgttgcacgaaaactatctgctcgggaacagcgagattgtgaggttattgaacgactcattaaatcatattttctcattgtcagaaagaatattcaagacagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattccaaattgcagaacacatcacacatttaatccaaataataaatggctgtttctaaagtttcccagtatatataaaatacatcaagtctgtcttgtgacag

SEQ ID NO: 8963 - DNA, 4439 bp, Homo sapiens
agcgcatggcctgccgggagggggcaggtagccggcgggcccggtccaatgggtgccggcttccgaggagagggcggaggagaggaggaaggaggcgaactgtgggccccggccccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaagttaattcaggacagcagaagagaaactaaaaatgttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtgccagttcctgttgcacgaaaactatctgctcgggaacagcgagattgtgaggttattgaacgactcattaaatcatattttctcattgtcagaaagaatattcaagacagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattccaaattgcagaacacatcacacatttaatccaaataataaatggctgtttctaaagtttcccagtatatataaaatacatcaagtctgtcttgtgacagtttcatctgaacttaacttaaaaacaactgttaatgttctagttgtgcaaagcagtttgcctgtggataagatgacctgtgtaataatctttgttagtagtcttaaagctgctgccatagtcctccaagaagaaagcaccaagacaacatttcatatgactataatgcatgtactatataagctgatctggctttgaaagatgtgagttggcaagttcctcacatagagtcattgtattccacctgtccttcaatttagttttttctgagcttctttgcagcctttgatgtgtttttaagaaagctgaatgcacaagaggatctgtgacactgacatggctgtggtgtgcatactgtgtagttacatagcccttccaattctgggtccatttgcactagcaaattaaaatatgctttgattcatacttaaacctgaaagcaggaatgcctacattaattcctacattaaaaacagccatctacccttgattatctagaaagacttggtaatgatggtcagttccttttagatttcagaaaatcaaatgatgacctaaatttcccttaatttgcaaatacagtagtaattaaggtacatctctaaagtggagcacttacaccaggctctaagattcactttgaggtggaacttaaaaccagtgtactgtatgtatgcattggtaatagctacttttgcttcatagcttcataccaacaaaatatatttattagaatagtatgaaagtactggaggagctgaaagaaaaacacccaaggctgggcgtggtggcacacgcctgtaatcccagcactttgggaggccgaggcaggtggatcacctgaggttgggagttggagaccagcttgaccaacatggagaaaccccgtctctactaaaaatacaaaattggccgggcgtggtggcgcatgcctgtaatcccagctactcgggagggtgaggcaggagaattgcttgaccctgggaggtggaggttgtggtgagctaagatcgtgccattgcactccagccttggcaacaagagcgaaactccgtctcaaaaaaaaaaaataaaacaacacccagatagatacacatactccttcagacttacagacctaagctgcatttatggggtagtgatgaggtttagaacatatacatattttgttaaaattccccagatgattcttggtatgaacgactatattataaattttaagatgtacttagaaatccttaagacatctagccccgtctctaatagacaacacatttatattgcagatattacttttttttcagtttatgaccaggtatttatgaaggactattggcagggaaaatatgaatatgttaactttagcttatggcatcaatttactaaggaacaacaggctcaccaactgatgtcaaacataaaaacccccacatcagtctgatacgatatggtactactttgaatctgttactagtaccatcttgacagaggatacatgctcccaaaacgtttgttaccacacttaaaaatcactgccatcattaagcatcagtttcaaaattatagccattcatgatttactttttccagatgactatcattattctagtcctttgaatttgtaaggggaaaaaaaacaaaaacaaaaacttacgatgcacttttctccagcacatcagatttcaaattgaaaattaaagacatgctatggtaatgcacttgctagtactacacactttgtacaacaaaaaacagaggcaagaaacaacggaaagagaaaagccttcctttgttggcccttaaactgagtcaagatctgaaatgtagagatgatctctgacgatacctgtatgttcttattgtgtaaataaaattgctggtatgaaatgacactaaa

SEQ ID NO: 8964 - DNA, 2393 bp, Homo sapiens
attgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaagtcttctaaagttccaagtgctttggcacctgcctcccaggagccctcccccgctgcttctgctgaggctgatggcaaggttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtgccagttcctgttgcacgaaaactatctgctcgggaacagcgagattgtgaggttattgaacgactcattaaatcatattttctcattgtcagaaagaatattcaagacagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattccaaattgcagaacacatcacacat

SEQ ID NO: 8965 - DNA, 2487 bp, Homo sapiens
ggaggcgaactgtgggccccggccccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaagtcttctaaagttccaagtgctttggcacctgcctcccaggagccctcccccgctgcttctgctgaggctgatggcaagttaattcaggacagcagaagagaaactaaaaatgttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtgccagttcctgttgcacgaaaactatctgctcgggaacagcgagattgtgaggttattgaacgactcattaaatcatattttctcattgtcagaaagaatattcaagacagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattccaaattgcagaacacatcacacatttaatccaaataataaatggctgtttctaaa

SEQ ID NO: 8966 - DNA, 2699 bp, Homo sapiens
gaaggaggcgaactgtgggccccggccccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatgaccctgctacatggaaaaactcaagacacctttctaaaggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaagtcttctaaagttccaagtgctttggcacctgcctcccaggagccctcccccgctgcttctgctgaggctgatggcaagttaattcaggacagcagaagagaaactaaaaatgttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtgccagttcctgttgcacgaaaactatctgctcgggaacagcgagattgtgaggttattgaacgactcattaaatcatattttctcattgtcagaaagaatattcaagacagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattccaaattgcagaacacatcacacatttaatccaaataataaatggctgtttctaaagtttcccagtatatataaaatacatcaagtctgtcttgtgacagtttcatctgaacttaacttaaaaacaactgttaatgttctagttgtgcaaagcagtttgcctgtggataagatgacctgtgtaataatctttgttagtagtcttaaagctgctgccatagtcctcc

SEQ ID NO: 8967 - DNA, 3633 bp, Homo sapiens
gagaaccggatgaggcggcgaccgtgaggccgagccgggagcgggcgtcttgccgaggcccgggcgggcggggagcaacggctacagacgccgcggggccaggtcgttgagggtcggcggcgggcgaggagcgcagggcgctcgggccgggggccgccggcgccatgggcaaccgcgggatggaagagctgatcccgctggtcaacaaactgcaggacgccttcagctccatcggccagagctgccacctggacctgccgcagatcgctgtagtgggcggccagagcgccggcaagagctcggtgctggagaacttcgtgggccgggacttccttccccgcggttcaggaatcgtcacccggcggcctctcattctgcagctcatcttctcaaaaacagaacatgccgagtttttgcactgcaagtccaaaaagtttacagactttgatgaagtccggcaggagattgaagcagagaccgacagggtcacggggaccaacaaaggcatctccccagtgcccatcaaccttcgagtctactcgccacacgtgttgaacttgaccctcatcgacctcccgggtatcaccaaggtgcctgtgggcgaccagcctccagacatcgagtaccagatcaaggacatgatcctgcagttcatcagccgggagagcagcctcattctggctgtcacgcccgccaacatggacctggccaactccgacgccctcaagctggccaaggaagtcgatccccaaggcctacggaccatcggtgtcatcaccaagcttgacctgatggacgagggcaccgacgccagggacgtcttggagaacaagttgctcccgttgagaagaggctacattggcgtggtgaaccgcagccagaaggatattgagggcaagaaggacatccgtgcagcactggcagctgagaggaagttcttcctctcccacccggcctaccggcacatggccgaccgcatgggcacgccacatctgcagaagacgctgaatcagcaactgaccaaccacatccgggagtcgctgccggccctacgtagcaaactacagagccagctgctgtccctggagaaggaggtggaggagtacaagaactttcggcccgacgaccccacccgcaaaaccaaagccctgctgcagatggtccagcagtttggggtggattttgagaagaggatcgagggctcaggagatcaggtggacactctggagctctccgggggcgcccgaatcaatcgcatcttccacgagcggttcccatttgagctggtgaagatggagtttgacgagaaggacttacgacgggagatcagctatgccattaagaacatccatggagtcaggacggggctcttcacccccgacatggcctttgaagccattgtgaaaaaacagattgtaaaactcaaagagccgagtttgaagtgtgttgatctcgtggtctcagagctggccacggtcataaaaaagtgtgccgagaagctcagttcctacccccggttgcgagaggagacagagcgaatcgtcaccacttacatccgggaacgggaggggagaacgaaggaccagattcttctgctgatcgacattgagcagtcctacatcaacacgaaccatgaggacttcatcgggtttgccaatgcccagcagaggagcacgcagctgaacaagaagagagccatccccaatcagcctgaaaccctggtgatccgcaggggctggctgaccatcaacaacatcagcctgatgaaaggcggctccaaggagtactggtttgtgctgactgccgagtcactgtcctggtacaaggatgaggaggagaaagagaagaagtacatgctgcctctggacaacctcaagatccgtgatgtggagaagggcttcatgtccaacaagcacgtcttcgccatcttcaacacggagcagagaaacgtctacaaggacctgcggcagatcgagctggcctgtgactcccaggaagacgtggacagctggaaggcctcgttcctccgagctggcgtctaccccgagaaggaccaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatacgaaggccttcatccaccacgagctgctggcctacctatactcctcggcagaccagagcagcctcatggaggagtcggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacagccccactccacagcgccgaccggtgtccagcatacacccccctggccggcccccagcagtgaggggccccactccagggccccccctgattcctgttcccgtgggggcagcagcctccttctcggcgcccccaatcccatcccggcctggaccccagagcgtgtttgccaacagtgacctcttcccagccccgcctcagatcccatctcggccagttcggatccccccagggattcccccaggagtgcccagcagaagaccccctgctgcgcccagccggcccaccattatccgcccagccgagccatccctgctcgactaggcctcgaggggggcgtgctctcgggggggcctcacgcacccgcggcgcaggagcttcagtggtctggggccctccgccgcccctatgctgggaccaggctcccagtgggcagccctggcctcttccttaacgctggccccggtccagggccggcccctgtgcctggctggacaccgcactgcgcaaaggggccctggagctccaggcagggggcgctggggtgttgcactttgggggatggagtctcagggtggcagaggggggaccagaacccttgacaccatcctgaatgaggggtccagcctgggggggactctaccaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggccatattaaccacacagcctgagcctggcccagcctcggctgccagaggtgcctttgctaggcccggagccgttggcccgggccggccttgccctattcctctcctcctcctcctcctgggtcccccagggtggctgggcttgggctatgtgggtggtggtggcggggggtcttgggggcctctcagctcccgcccatgcctccctgatgggtgggcccagggcggcctctctctgaggagacctcacccactcctcgctcagtttgaccactgtaagtgcctgcactctgtattctattaataaactaaaataaagggaagacgctgctggtg

SEQ ID NO: 8968 - DNA, 3654 bp, Homo sapiens
gaggtcgctcgggtcgggtgtcgcctgagaaccggatgaggcggcgaccgtgaggccgagccgggagcgggcgtcttgccgaggcccgggcgggcggggagcaacggctacagacgccgcggggccaggtcgttgagggtcggcggcgggcgaggagcgcagggcgctcgggccgggggccgccggcgccatgggcaaccgcgggatggaagagctgatcccgctggtcaacaaactgcaggacgccttcagctccatcggccagagctgccacctggacctgccgcagatcgctgtagtgggcggccagagcgccggcaagagctcggtgctggagaacttcgtgggccgggacttccttccccgcggttcaggaatcgtcacccggcggcctctcattctgcagctcatcttctcaaaaacagaacatgccgagtttttgcactgcaagtccaaaaagtttacagactttgatgaagtccggcaggagattgaagcagagaccgacagggtcacggggaccaacaaaggcatctccccagtgcccatcaaccttcgagtctactcgccacacgtgttgaacttgaccctcatcgacctcccgggtatcaccaaggtgcctgtgggcgaccagcctccagacatcgagtaccagatcaaggacatgatcctgcagttcatcagccgggagagcagcctcattctggctgtcacgcccgccaacatggacctggccaactccgacgccctcaagctggccaaggaagtcgatccccaaggcctacggaccatcggtgtcatcaccaagcttgacctgatggacgagggcaccgacgccagggacgtcttggagaacaagttgctcccgttgagaagaggctacattggcgtggtgaaccgcagccagaaggatattgagggcaagaaggacatccgtgcagcactggcagctgagaggaagttcttcctctcccacccggcctaccggcacatggccgaccgcatgggcacgccacatctgcagaagacgctgaatcagcaactgaccaaccacatccgggagtcgctgccggccctacgtagcaaactacagagccagctgctgtccctggagaaggaggtggaggagtacaagaactttcggcccgacgaccccacccgcaaaaccaaagccctgctgcagatggtccagcagtttggggtggattttgagaagaggatcgagggctcaggagatcaggtggacactctggagctctccgggggcgcccgaatcaatcgcatcttccacgagcggttcccatttgagctggtgaagatggagtttgacgagaaggacttacgacgggagatcagctatgccattaagaacatccatggagtcaggaccgggcttttcaccccggacttggcattcgaggccattgtgaaaaagcaggtcgtcaagctgaaagagccctgtctgaaatgtgtcgacctggttatccaggagctaatcaatacagttaggcagtgtaccagtaagctcagttcctacccccggttgcgagaggagacagagcgaatcgtcaccacttacatccgggaacgggaggggagaacgaaggaccagattcttctgctgatcgacattgagcagtcctacatcaacacgaaccatgaggacttcatcgggtttgccaatgcccagcagaggagcacgcagctgaacaagaagagagccatccccaatcaggtgatccgcaggggctggctgaccatcaacaacatcagcctgatgaaaggcggctccaaggagtactggtttgtgctgactgccgagtcactgtcctggtacaaggatgaggaggagaaagagaagaagtacatgctgcctctggacaacctcaagatccgtgatgtggagaagggcttcatgtccaacaagcacgtcttcgccatcttcaacacggagcagagaaacgtctacaaggacctgcggcagatcgagctggcctgtgactcccaggaagacgtggacagctggaaggcctcgttcctccgagctggcgtctaccccgagaaggaccaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatacgaaggccttcatccaccacgagctgctggcctacctatactcctcggcagaccagagcagcctcatggaggagtcggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacagccccactccacagcgccgaccggtgtccagcatacacccccctggccggcccccagcagtgaggggccccactccagggccccccctgattcctgttcccgtgggggcagcagcctccttctcggcgcccccaatcccatcccggcctggaccccagagcgtgtttgccaacagtgacctcttcccagccccgcctcagatcccatctcggccagttcggatccccccagggattcccccaggagtgcccagcagaagaccccctgctgcgcccagccggcccaccattatccgcccagccgagccatccctgctcgactaggcctcgaggggggcgtgctctcgggggggcctcacgcacccgcggcgcaggagcttcagtggtctggggccctccgccgcccctatgctgggaccaggctcccagtgggcagccctggcctcttccttaacgctggccccggtccagggccggcccctgtgcctggctggacaccgcactgcgcaaaggggccctggagctccaggcagggggcgctggggtgttgcactttgggggatggagtctcagggtggcagaggggggaccagaacccttgacaccatcctgaatgaggggtccagcctgggggggactctaccaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggccatattaaccacacagcctgagcctggcccagcctcggctgccagaggtgcctttgctaggcccggagccgttggcccgggccggccttgccctattcctctcctcctcctcctcctgggtcccccagggtggctgggcttgggctatgtgggtggtggtggcggggggtcttgggggcctctcagctcccgcccatgcctccctgatgggtgggcccagggcggcctctctctgaggagacctcacccactcctcgctcagtttgaccactgtaagtgcctgcactctgtattctattaataaactaaaataaagggaagacgctgctggtggctgctg

SEQ ID NO: 8969 - DNA, 3633 bp, Homo sapiens
gagaaccggatgaggcggcgaccgtgaggccgagccgggagcgggcgtcttgccgaggcccgggcgggcggggagcaacggctacagacgccgcggggccaggtcgttgagggtcggcggcgggcgaggagcgcagggcgctcgggccgggggccgccggcgccatgggcaaccgcgggatggaagagctgatcccgctggtcaacaaactgcaggacgccttcagctccatcggccagagctgccacctggacctgccgcagatcgctgtagtgggcggccagagcgccggcaagagctcggtgctggagaacttcgtgggccgggacttccttccccgcggttcaggaatcgtcacccggcggcctctcattctgcagctcatcttctcaaaaacagaacatgccgagtttttgcactgcaagtccaaaaagtttacagactttgatgaagtccggcaggagattgaagcagagaccgacagggtcacggggaccaacaaaggcatctccccagtgcccatcaaccttcgagtctactcgccacacgtgttgaacttgaccctcatcgacctcccgggtatcaccaaggtgcctgtgggcgaccagcctccagacatcgagtaccagatcaaggacatgatcctgcagttcatcagccgggagagcagcctcattctggctgtcacgcccgccaacatggacctggccaactccgacgccctcaagctggccaaggaagtcgatccccaaggcctacggaccatcggtgtcatcaccaagcttgacctgatggacgagggcaccgacgccagggacgtcttggagaacaagttgctcccgttgagaagaggctacattggcgtggtgaaccgcagccagaaggatattgagggcaagaaggacatccgtgcagcactggcagctgagaggaagttcttcctctcccacccggcctaccggcacatggccgaccgcatgggcacgccacatctgcagaagacgctgaatcagcaactgaccaaccacatccgggagtcgctgccggccctacgtagcaaactacagagccagctgctgtccctggagaaggaggtggaggagtacaagaactttcggcccgacgaccccacccgcaaaaccaaagccctgctgcagatggtccagcagtttggggtggattttgagaagaggatcgagggctcaggagatcaggtggacactctggagctctccgggggcgcccgaatcaatcgcatcttccacgagcggttcccatttgagctggtgaagatggagtttgacgagaaggacttacgacgggagatcagctatgccattaagaacatccatggagtcaggaccgggcttttcaccccggacttggcattcgaggccattgtgaaaaagcaggtcgtcaagctgaaagagccctgtctgaaatgtgtcgacctggttatccaggagctaatcaatacagttaggcagtgtaccagtaagctcagttcctacccccggttgcgagaggagacagagcgaatcgtcaccacttacatccgggaacgggaggggagaacgaaggaccagattcttctgctgatcgacattgagcagtcctacatcaacacgaaccatgaggacttcatcgggtttgccaatgcccagcagaggagcacgcagctgaacaagaagagagccatccccaatcagggggagatcctggtgatccgcaggggctggctgaccatcaacaacatcagcctgatgaaaggcggctccaaggagtactggtttgtgctgactgccgagtcactgtcctggtacaaggatgaggaggagaaagagaagaagtacatgctgcctctggacaacctcaagatccgtgatgtggagaagggcttcatgtccaacaagcacgtcttcgccatcttcaacacggagcagagaaacgtctacaaggacctgcggcagatcgagctggcctgtgactcccaggaagacgtggacagctggaaggcctcgttcctccgagctggcgtctaccccgagaaggaccaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatacgaaggccttcatccaccacgagctgctggcctacctatactcctcggcagaccagagcagcctcatggaggagtcggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacagccccactccacagcgccgaccggtgtccagcatacacccccctggccggcccccagcagtgaggggccccactccagggccccccctgattcctgttcccgtgggggcagcagcctccttctcggcgcccccaatcccatcccggcctggaccccagagcgtgtttgccaacagtgacctcttcccagccccgcctcagatcccatctcggccagttcggatccccccagggattcccccaggagtgcccagcagaagaccccctgctgcgcccagccggcccaccattatccgcccagccgagccatccctgctcgactaggcctcgaggggggcgtgctctcgggggggcctcacgcacccgcggcgcaggagcttcagtggtctggggccctccgccgcccctatgctgggaccaggctcccagtgggcagccctggcctcttccttaacgctggccccggtccagggccggcccctgtgcctggctggacaccgcactgcgcaaaggggccctggagctccaggcagggggcgctggggtgttgcactttgggggatggagtctcagggtggcagaggggggaccagaacccttgacaccatcctgaatgaggggtccagcctgggggggactctaccaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggccatattaaccacacagcctgagcctggcccagcctcggctgccagaggtgcctttgctaggcccggagccgttggcccgggccggccttgccctattcctctcctcctcctcctcctgggtcccccagggtggctgggcttgggctatgtgggtggtggtggcggggggtcttgggggcctctcagctcccgcccatgcctccctgatgggtgggcccagggcggcctctctctgaggagacctcacccactcctcgctcagtttgaccactgtaagtgcctgcactctgtattctattaataaactaaaataaagggaagacgctgctggtg

SEQ ID NO: 8970 - DNA, 3436 bp, Homo sapiens
cacgtcactgtggcagcagcggatagctggaaaccacctgccagtgcccagcatgtagggcgtgcccctagagcgggagctgccacctgcttcctggggcccaggccccccagccaccttggagggagggacttccttccccgcggttcaggaatcgtcacccggcggcctctcattctgcagctcatcttctcaaaaacagaacatgccgagtttttgcactgcaagtccaaaaagtttacagactttgatgaagtccggcaggagattgaagcagagaccgacagggtcacggggaccaacaaaggcatctccccagtgcccatcaaccttcgagtctactcgccacacgtgttgaacttgaccctcatcgacctcccgggtatcaccaaggtgcctgtgggcgaccagcctccagacatcgagtaccagatcaaggacatgatcctgcagttcatcagccgggagagcagcctcattctggctgtcacgcccgccaacatggacctggccaactccgacgccctcaagctggccaaggaagtcgatccccaaggcctacggaccatcggtgtcatcaccaagcttgacctgatggacgagggcaccgacgccagggacgtcttggagaacaagttgctcccgttgagaagaggctacattggcgtggtgaaccgcagccagaaggatattgagggcaagaaggacatccgtgcagcactggcagctgagaggaagttcttcctctcccacccggcctaccggcacatggccgaccgcatgggcacgccacatctgcagaagacgctgaatcagcaactgaccaaccacatccgggagtcgctgccggccctacgtagcaaactacagagccagctgctgtccctggagaaggaggtggaggagtacaagaactttcggcccgacgaccccacccgcaaaaccaaagccctgctgcagatggtccagcagtttggggtggattttgagaagaggatcgagggctcaggagatcaggtggacactctggagctctccgggggcgcccgaatcaatcgcatcttccacgagcggttcccatttgagctggtgaagatggagtttgacgagaaggacttacgacgggagatcagctatgccattaagaacatccatggagtcaggacggggctcttcacccccgacatggcctttgaagccattgtgaaaaaacagattgtaaaactcaaagagccgagtttgaagtgtgttgatctcgtggtctcagagctggccacggtcataaaaaagtgtgccgagaagctcagttcctacccccggttgcgagaggagacagagcgaatcgtcaccacttacatccgggaacgggaggggagaacgaaggaccagattcttctgctgatcgacattgagcagtcctacatcaacacgaaccatgaggacttcatcgggtttgccaatgcccagcagaggagcacgcagctgaacaagaagagagccatccccaatcagggggagatcctggtgatccgcaggggctggctgaccatcaacaacatcagcctgatgaaaggcggctccaaggagtactggtttgtgctgactgccgagtcactgtcctggtacaaggatgaggaggagaaagagaagaagtacatgctgcctctggacaacctcaagatccgtgatgtggagaagggcttcatgtccaacaagcacgtcttcgccatcttcaacacggagcagagaaacgtctacaaggacctgcggcagatcgagctggcctgtgactcccaggaagacgtggacagctggaaggcctcgttcctccgagctggcgtctaccccgagaaggaccaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatacgaaggccttcatccaccacgagctgctggcctacctatactcctcggcagaccagagcagcctcatggaggagtcggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacagccccactccacagcgccgaccggtgtccagcatacacccccctggccggcccccagcagtgaggggccccactccagggccccccctgattcctgttcccgtgggggcagcagcctccttctcggcgcccccaatcccatcccggcctggaccccagagcgtgtttgccaacagtgacctcttcccagccccgcctcagatcccatctcggccagttcggatccccccagggattcccccaggagtgcccagcagaagaccccctgctgcgcccagccggcccaccattatccgcccagccgagccatccctgctcgactaggcctcgaggggggcgtgctctcgggggggcctcacgcacccgcggcgcaggagcttcagtggtctggggccctccgccgcccctatgctgggaccaggctcccagtgggcagccctggcctcttccttaacgctggccccggtccagggccggcccctgtgcctggctggacaccgcactgcgcaaaggggccctggagctccaggcagggggcgctggggtgttgcactttgggggatggagtctcagggtggcagaggggggaccagaacccttgacaccatcctgaatgaggggtccagcctgggggggactctaccaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggccatattaaccacacagcctgagcctggcccagcctcggctgccagaggtgcctttgctaggcccggagccgttggcccgggccggccttgccctattcctctcctcctcctcctcctgggtcccccagggtggctgggcttgggctatgtgggtggtggtggcggggggtcttgggggcctctcagctcccgcccatgcctccctgatgggtgggcccagggcggcctctctctgaggagacctcacccactcctcgctcagtttgaccactgtaagtgcctgcactctgtattctattaataaactaaaataaagggaagacgctgctggtg

SEQ ID NO: 8971 - DNA, 3633 bp, Homo sapiens
gagaaccggatgaggcggcgaccgtgaggccgagccgggagcgggcgtcttgccgaggcccgggcgggcggggagcaacggctacagacgccgcggggccaggtcgttgagggtcggcggcgggcgaggagcgcagggcgctcgggccgggggccgccggcgccatgggcaaccgcgggatggaagagctgatcccgctggtcaacaaactgcaggacgccttcagctccatcggccagagctgccacctggacctgccgcagatcgctgtagtgggcggccagagcgccggcaagagctcggtgctggagaacttcgtgggccgggacttccttccccgcggttcaggaatcgtcacccggcggcctctcattctgcagctcatcttctcaaaaacagaacatgccgagtttttgcactgcaagtccaaaaagtttacagactttgatgaagtccggcaggagattgaagcagagaccgacagggtcacggggaccaacaaaggcatctccccagtgcccatcaaccttcgagtctactcgccacacgtgttgaacttgaccctcatcgacctcccgggtatcaccaaggtgcctgtgggcgaccagcctccagacatcgagtaccagatcaaggacatgatcctgcagttcatcagccgggagagcagcctcattctggctgtcacgcccgccaacatggacctggccaactccgacgccctcaagctggccaaggaagtcgatccccaaggcctacggaccatcggtgtcatcaccaagcttgacctgatggacgagggcaccgacgccagggacgtcttggagaacaagttgctcccgttgagaagaggctacattggcgtggtgaaccgcagccagaaggatattgagggcaagaaggacatccgtgcagcactggcagctgagaggaagttcttcctctcccacccggcctaccggcacatggccgaccgcatgggcacgccacatctgcagaagacgctgaatcagcaactgaccaaccacatccgggagtcgctgccggccctacgtagcaaactacagagccagctgctgtccctggagaaggaggtggaggagtacaagaactttcggcccgacgaccccacccgcaaaaccaaagccctgctgcagatggtccagcagtttggggtggattttgagaagaggatcgagggctcaggagatcaggtggacactctggagctctccgggggcgcccgaatcaatcgcatcttccacgagcggttcccatttgagctggtgaagatggagtttgacgagaaggacttacgacgggagatcagctatgccattaagaacatccatggagtcaggacggggctcttcacccccgacatggcctttgaagccattgtgaaaaaacagattgtaaaactcaaagagccgagtttgaagtgtgttgatctcgtggtctcagagctggccacggtcataaaaaagtgtgccgagaagctcagttcctacccccggttgcgagaggagacagagcgaatcgtcaccacttacatccgggaacgggaggggagaacgaaggaccagattcttctgctgatcgacattgagcagtcctacatcaacacgaaccatgaggacttcatcgggtttgccaatgcccagcagaggagcacgcagctgaacaagaagagagccatccccaatcagggggagatcctggtgatccgcaggggctggctgaccatcaacaacatcagcctgatgaaaggcggctccaaggagtactggtttgtgctgactgccgagtcactgtcctggtacaaggatgaggaggagaaagagaagaagtacatgctgcctctggacaacctcaagatccgtgatgtggagaagggcttcatgtccaacaagcacgtcttcgccatcttcaacacggagcagagaaacgtctacaaggacctgcggcagatcgagctggcctgtgactcccaggaagacgtggacagctggaaggcctcgttcctccgagctggcgtctaccccgagaaggaccaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatacgaaggccttcatccaccacgagctgctggcctacctatactcctcggcagaccagagcagcctcatggaggagtcggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacagccccactccacagcgccgaccggtgtccagcatacacccccctggccggcccccagcagtgaggggccccactccagggccccccctgattcctgttcccgtgggggcagcagcctccttctcggcgcccccaatcccatcccggcctggaccccagagcgtgtttgccaacagtgacctcttcccagccccgcctcagatcccatctcggccagttcggatccccccagggattcccccaggagtgcccagcagaagaccccctgctgcgcccagccggcccaccattatccgcccagccgagccatccctgctcgactaggcctcgaggggggcgtgctctcgggggggcctcacgcacccgcggcgcaggagcttcagtggtctggggccctccgccgcccctatgctgggaccaggctcccagtgggcagccctggcctcttccttaacgctggccccggtccagggccggcccctgtgcctggctggacaccgcactgcgcaaaggggccctggagctccaggcagggggcgctggggtgttgcactttgggggatggagtctcagggtggcagaggggggaccagaacccttgacaccatcctgaatgaggggtccagcctgggggggactctaccaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggccatattaaccacacagcctgagcctggcccagcctcggctgccagaggtgcctttgctaggcccggagccgttggcccgggccggccttgccctattcctctcctcctcctcctcctgggtcccccagggtggctgggcttgggctatgtgggtggtggtggcggggggtcttgggggcctctcagctcccgcccatgcctccctgatgggtgggcccagggcggcctctctctgaggagacctcacccactcctcgctcagtttgaccactgtaagtgcctgcactctgtattctattaataaactaaaataaagggaagacgctgctggtg

SEQ ID NO: 8972 - DNA, 3654 bp, Homo sapiens
gaggtcgctcgggtcgggtgtcgcctgagaaccggatgaggcggcgaccgtgaggccgagccgggagcgggcgtcttgccgaggcccgggcgggcggggagcaacggctacagacgccgcggggccaggtcgttgagggtcggcggcgggcgaggagcgcagggcgctcgggccgggggccgccggcgccatgggcaaccgcgggatggaagagctgatcccgctggtcaacaaactgcaggacgccttcagctccatcggccagagctgccacctggacctgccgcagatcgctgtagtgggcggccagagcgccggcaagagctcggtgctggagaacttcgtgggccgggacttccttccccgcggttcaggaatcgtcacccggcggcctctcattctgcagctcatcttctcaaaaacagaacatgccgagtttttgcactgcaagtccaaaaagtttacagactttgatgaagtccggcaggagattgaagcagagaccgacagggtcacggggaccaacaaaggcatctccccagtgcccatcaaccttcgagtctactcgccacacgtgttgaacttgaccctcatcgacctcccgggtatcaccaaggtgcctgtgggcgaccagcctccagacatcgagtaccagatcaaggacatgatcctgcagttcatcagccgggagagcagcctcattctggctgtcacgcccgccaacatggacctggccaactccgacgccctcaagctggccaaggaagtcgatccccaaggcctacggaccatcggtgtcatcaccaagcttgacctgatggacgagggcaccgacgccagggacgtcttggagaacaagttgctcccgttgagaagaggctacattggcgtggtgaaccgcagccagaaggatattgagggcaagaaggacatccgtgcagcactggcagctgagaggaagttcttcctctcccacccggcctaccggcacatggccgaccgcatgggcacgccacatctgcagaagacgctgaatcagcaactgaccaaccacatccgggagtcgctgccggccctacgtagcaaactacagagccagctgctgtccctggagaaggaggtggaggagtacaagaactttcggcccgacgaccccacccgcaaaaccaaagccctgctgcagatggtccagcagtttggggtggattttgagaagaggatcgagggctcaggagatcaggtggacactctggagctctccgggggcgcccgaatcaatcgcatcttccacgagcggttcccatttgagctggtgaagatggagtttgacgagaaggacttacgacgggagatcagctatgccattaagaacatccatggagtcaggacggggctcttcacccccgacatggcctttgaagccattgtgaaaaaacagattgtaaaactcaaagagccgagtttgaagtgtgttgatctcgtggtctcagagctggccacggtcataaaaaagtgtgccgagaagctcagttcctacccccggttgcgagaggagacagagcgaatcgtcaccacttacatccgggaacgggaggggagaacgaaggaccagattcttctgctgatcgacattgagcagtcctacatcaacacgaaccatgaggacttcatcgggtttgccaatgcccagcagaggagcacgcagctgaacaagaagagagccatccccaatcaggtgatccgcaggggctggctgaccatcaacaacatcagcctgatgaaaggcggctccaaggagtactggtttgtgctgactgccgagtcactgtcctggtacaaggatgaggaggagaaagagaagaagtacatgctgcctctggacaacctcaagatccgtgatgtggagaagggcttcatgtccaacaagcacgtcttcgccatcttcaacacggagcagagaaacgtctacaaggacctgcggcagatcgagctggcctgtgactcccaggaagacgtggacagctggaaggcctcgttcctccgagctggcgtctaccccgagaaggaccaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatacgaaggccttcatccaccacgagctgctggcctacctatactcctcggcagaccagagcagcctcatggaggagtcggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacagccccactccacagcgccgaccggtgtccagcatacacccccctggccggcccccagcagtgaggggccccactccagggccccccctgattcctgttcccgtgggggcagcagcctccttctcggcgcccccaatcccatcccggcctggaccccagagcgtgtttgccaacagtgacctcttcccagccccgcctcagatcccatctcggccagttcggatccccccagggattcccccaggagtgcccagcagaagaccccctgctgcgcccagccggcccaccattatccgcccagccgagccatccctgctcgactaggcctcgaggggggcgtgctctcgggggggcctcacgcacccgcggcgcaggagcttcagtggtctggggccctccgccgcccctatgctgggaccaggctcccagtgggcagccctggcctcttccttaacgctggccccggtccagggccggcccctgtgcctggctggacaccgcactgcgcaaaggggccctggagctccaggcagggggcgctggggtgttgcactttgggggatggagtctcagggtggcagaggggggaccagaacccttgacaccatcctgaatgaggggtccagcctgggggggactctaccaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggccatattaaccacacagcctgagcctggcccagcctcggctgccagaggtgcctttgctaggcccggagccgttggcccgggccggccttgccctattcctctcctcctcctcctcctgggtcccccagggtggctgggcttgggctatgtgggtggtggtggcggggggtcttgggggcctctcagctcccgcccatgcctccctgatgggtgggcccagggcggcctctctctgaggagacctcacccactcctcgctcagtttgaccactgtaagtgcctgcactctgtattctattaataaactaaaataaagggaagacgctgctggtggctgctg

SEQ ID NO: 8973 - DNA, 5650 bp, Homo sapiens
tgcctgctcttccctgatttacccacaaccctaactttgcatattcaaagggggagatcctggtaagtacatgcttagtgtggtagcaaacattagagaatctagtggtgatggagaccccgcccacccctaatattccctgttccccatcccctccaaataacaaaaatactaaaaatcgagctaacctggaaaccccatgccgcagccggcgctggactgcacgttgccctgggtataagtcgactcacacaggcactaactggaccgccacccttgaaggcgcacttctgcagccagttcctggcaggttttcctggtttcctgtaggtcagggatggcaaatacttacacaccgcccctgcctcccctcacatccctggctgtggaagatctcgcttaagccagaccagaattcattcttggcactgcccctcctccttctatctcctatgcagatgtcactcatggatcagagcatatttttccacatggcagaaatcttgccctcttgtgcccatggcagacatggctagttgatctagcactctttgccttgtgccgctcctctagcacacgcccatggcagacattgctaagcaatcctagcattctttccaaataagcttgccagcactcctgttctatagcagatgtggctaagtgattaaggtattgtttttctccctatatgataccctcttctctatgcatggcaggcatgactagtcaatcaggagcctctttcctagatgctgcctcttgtcctccagataaattgatgaggctcttctgttccacttaccctttctcctatccttggcctgtgacaggcaacactaattgatcctagcaccgtttcctgccacgcccagaattctcaccacagtgcttcaggtatcttgtaccagtcgattgacatggctcccgagatgaatcatatttgctgtccatccctgctgtgggtaacacctccttcctttgtgcagaaccctcagctggggcccagtgtggggcgtgagatgggcgtgaggcccagtccagcccagcccagcgggaagcagcctgctactcatagctgagaactgaacccagctcaaggagctcacctctaggcagccggcctcagcccggctcttacacttggacagcacagcctgggcctccagtcctagcaggggctcccttttgctggacattctcccactgccagccaccaaggcgctggtcatccctgccactgccctctggcggggctcttctggcaatcccagggtctttcttgtagctgagccgatcctatgccagggcctcgctgctcccagggcctgggtgtgcagatagggccatgggtggggcagtgacgggaggaattagttggcctcgggcttgtggttttcaggttcctcatgtgttccccccagtccctttgaatttgccaggccaagaccaggaacctgcttctcccttgtaccccaagaggtttaggggttcctcttttcctaccagaggccacatagcccagccccgtcatgagcgtggccgtggcctctgggtctcccatctgtggttcccatctctacccgggagactcaggccaggaccctcacccaggaaagagactggagcagcctgccagaggatccctgctttgccgccccctgcctgccctgccacccataccgccccatgtgcctgcctgcctgtcactgtgcaccctagcccgcaacggcctgccgcctcttctgtctctcccacccctacttccttctaagcccagtcccattgggatgtgtcccttggatgcaaacctgactttctgctgaggcctggctgctccctttctctggctcacaagtggtggatggctaacgggcctttgtttgccacccacagcttgcagctccctagggtgggattttgtctctgaacccgtgtggagaagggcacctcagggcttctgccagacgtcctgccccaaggcttggtgtgccatccccagcatggccccgatcagtgccctggccctgtggccatgcaccccaaagtgtagcgtgggccctgtgctccagctctgaccaacactaaccccggctggaggcaggagagccaggccaccgaggggtgtgcgggcacatccctctccttagaaaccgggccaggcctaggagtatggaggcctcacatttctctgggggagcaccgacagcctgtctccctgttttccctcacctggttgtcattcagtcatggaaccagggtctactaagcactcgttctgtgcccagctctgggctgagacaaggcagtgcccccaccccgctccccccgggtgaatggaggcattcccagactgccagacctttggtgctaacaccaggacgtcctggacagaccaggaagagctcgtcactgcgttcccagaggggatgctgtgacctcacaggggctgctggcctcagccccctcacccaccaccaggcagcccgtgaatggccagatgccaggggtcactgcctgctccaaacaactgtgagagtcctgtctgctcatcccagggagggataagtctgtacccttggccttaacaaggggcgcccggtggcatctcatgctgtccccagcctgggcagtgacttctgcatggtccaggggtccctgggtactctttagccacctccgtcttcatggccacctggggcttagcactcacatccagccaccaaggagccgctggagctgtgggctggtggccctggttcagaatgtcaggcccggggtgggtcggggtagtccggatgaagcccctccagaggaccgcccccgactaggacagcatctgggccccagagggattcctggaggccccatctctggcgctcctgccgtgccgtgccctgccatgccctgcactgggggatgcaggccagcccttcgcagctgtccatggccatgctcagcccaccctttgtagcttggccaagtctgtcagtgcctgggtcccaggccgccctgtgcgtgcctccgtgtgcttcctgcagctcccagggccctcgtcctgagtggggtggggggctctgcccacacatgcctccagcggccagggagcatgggagcacagcccccaggctgcctgccgttagttgtcaggtgagtccctgcgcaggcctgggttctgacccccacgcagatgacagctacagccacacaatccccatccatggggtctcccagcctgaaaccctgatgtgtcagtcaaaaggatgaccaccaggcttgcagccagcttgggacatgagccgcgctccttcaatgtccttggggagggcccctgggctcacacctttgaccctagccctctgtgtggatgctacccttggaaccttatctcacgcaaacaagtgcagttcctcagatgtcacatttcatgtgccacagccccacacacaagccccagggactcctcccatgggcccctttccatcaggcctctgtgagtctataccccatcagcccctggcccagtgagtctgtctgtccgcccacctgcccaggtggcgcctcatgttggtttcctgctggaaatgcttgggacagggtggaactgggtttcctgggctttggggctggaggtgtctctattgcggtccctggcttcccactgagctgtgggcaaggctgctgcgctgggggatggctggggcacggagcgaggttccctgctaagctgcgcgctttcccccaggtgatccgcaggggctggctgaccatcaacaacatcagcctgatgaaaggcggctccaaggagtactggtttgtgctgactgccgagtcactgtcctggtacaaggatgaggaggagaaagagaagaagtacatgctgcctctggacaacctcaagatccgtgatgtggagaagggcttcatgtccaacaagcacgtcttcgccatcttcaacacggagcagagaaacgtctacaaggacctgcggcagatcgagctggcctgtgactcccaggaagacgtggacagctggaaggcctcgttcctccgagctggcgtctaccccgagaaggaccaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatacgaaggccttcatccaccacgagctgctggcctacctatactcctcggcagaccagagcagcctcatggaggagtcggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacagccccactccacagcgccgaccggtgtccagcatacacccccctggccggcccccagcagtgaggggccccactccagggcccccctgattcctgttcccgtgggggcagcagcctccttctcggcgcccccaatcccatcccggcctggaccccagagcgtgtttgccaacagtgacctcttcccagccccgcctcagatcccatctcggccagttcggatccccccagggattcccccaggagtgcccagcagaagaccccctgctgcgcccagccggcccaccattatccgcccagccgagccatccctgctcgactaggcctcgaggggggcgtgctctcgggggggcctcacgcacccgcggcgcaggagcttcagtggtctggggccctccgccgcccctatgctgggaccaggctcccagtgggcagccctggcctcttccttaacgctggccccggtccagggccggcccctgtgcctggctggacaccgcactgcgcaaaggggccctggagctccaggcagggggcgctggggtgttgcactttgggggatggagtctcagggtggcagaggggggaccagaacccttgacaccatcctgaatgaggggtccagcctgggggggactctaccaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggccatattaaccacacagcctgagcctggcccagcctcggctgccagaggtgcctttgctaggcccggagccgttggcccgggccggccttgccctattcctctcctcctcctcctcctgggtcccccagggtggctgggcttgggctatgtgggtggtggtggcggggggtcttgggggcctctcagctcccgcccatgcctccctgatgggtgggcccagggcggcctctctctgaggagacctcacccactcctcgctcagtttgaccactgtaagtgcctgcactctgtattctattaataaactaaaataaagggaagacgctg

SEQ ID NO: 8974 - DNA, 14955 bp, Homo sapiens
cttctacatcgcgaatatccctcgccggcctggcgcccggcgccatctgctggacccgttccggctggggcgcacagacctgggcgcggggtcgggcgattgggttctccctgccttttcaatgtcctgcggggcggtggctcactgtctctcgccccagcccttccagctgggtcctgacaccaggccccccgcacccttcggctcgccagatgtggctactttcctttagtcccggagccttcaagccctgggtccctgaggggtagacctgggcggggtggggccgcgaagcagggatccagggcgcctgcgcggaggaggcgggctccgaggggccgcacaccggccactcgcccctccctgcccggggttgccatggggacgcgtgcagacgccggcccgagagggctgcgaggggcaacttcttagagtggcccatcggtcggtctagggaggggagggtcagcgtggcaaggtgtgtgtcgggggcagagggaaggagggaaggagtgctggggagaaggggcagtagtgtcggggtaggaagggacagttgttggggagaagaggcagttgtggagggagagggagcaaggaatatttgtgtgggggagggggaggagaaggggcagttgtgacagctgggggggaagagccattctgaggggaaatttgcctgctggtaaccagtttaaggataccagctgctggtataaatactgctggataaatactgctggatttatactgcaggataaatactgctggcccctgcggtatttcctagtactagagtgagccccgacttagcagagcagttcctcctggggcctgcggtgtgggatcgcgtggtgaaccccacggtgcatgcgcctcaggctctagtttgaggcaggaaagcgcagcttgatgcttctctggagactgatggaggaagcctccttgctgtagttggttttattgatttgctggcctaacagaacgtttttccttggagcaaagtacaaatccttcaagtttgaaattcataacctgagatcaatgcctgtggcagcctgtggggatgaggaaggagagccacaggtgccgttaggctgcagcctaatgaaaagagagtgcccagcgcctcagactttgcgcctgggattctgagcacctgtccgagatccccgcttcctgccatcctacctttctgagagaggcaccactgtgaccttcctcgtgccccaattgctttttcctcatgacacaatttgaaatttatgattggatgacttttgtccttctttcttccaatctgttctcagggcattttgagtcaaataaatgatcctgactgatcttaaccattagcacagagttcctcagccaactctgctaagagacctcagtacacacaaaacagtgttcctgcccctcaggacttcaaagcgatagacccaggttttgcctgcacgatgtccagcaaagctgagaagaagcagcgattgagtggccgaggaagctcccaggcaagctggtcagggcgggccactcgggctgctgtggccacacaggagcaggggaatgccccggctgtcagtgagccagagctgcaggctgagctccccaaggaggagcctgagccacggttggagggacctcaagcacagagtgaagaatcagtggagcccgaggcagatgtgaagcccctcttcctttcccgagctgcgctgacaggactggcggatgcagtgtggacacaggagcatgatgccattctggaacactttgcccaggaccctacagaatccatcctcaccatcttcattgacccttgttttgggctgaagctagagctgggcatgcctgtacagacccagaaccagcttgtctacttcattcgccaagcaccagttcccatcacctgggagaacttcgaggcaactgtgcagtttgggacggtgcggggcccctatatcccggccctgcttcggctgctcggtggagtctttgcccctcagatctttgcaaacacaggctggcctgagagcattagaaatcattttgcttctcatctgcacaagttcttggcctgcctgacagacactcggtacaaactggaggggcacacggtcctctacatccctgcagaggccatgaacatgaagcctgagatggtgataaaggacaaagagctggtgcaacggctagagacctccatgatccactggacccggcagataaaggagatgctcagtgcccaggagactgtggagacaggagaaaatttaggtcctctggaggagattgagttctggcgcaaccgatgcatggacctgtctggcatcagtaagcagctggtgaagaagggagtgaagcacgttgaatccatcctgcaccttgccaagtcgtcctacttggcgccctttatgaaactggcacagcagatccaggatggctctcgtcaagcacagtcaaacctgacctttttgtcaatcctgaaggaaccttaccaggagttggctttcatgaagcccaaggacatctctagcaagctccctaagctgatcagtctcatccgcatcatctgggtcaactctccccactacaacactcgggagagactgacctcgctcttccgaaaggtatgtgactgtcagtatcacttcgcccgctgggaagatggcaagcagggtccccttccttgcttctttggtgcccaggggccacagataacacggaacttgctggagattgaggacatctttcataaaaatctgcacacgctgcgagccgttcgcgggggtatcctggatgtcaagaacacctgttggcatgaagactacaataagttccgtgccggaatcaaggacctggaggtgatgacccagaacctgatcacctcagccttcgagttggtgcgggacgtgccgcacggcgtgcttctgctggacaccttccacaggcttgcctcccgcgaggctatcaagcggacttatgacaagaaggcggtggatctctacatgctgttcaatagcgagctggccctggtgaaccgtgaacggaacaagaaatggccagacctggagccctacgtggcccagtattccggaaaggcgcgctgggtgcacatcctccggcgtcgcatcgacagagtcatgacctgccttgctggtgctcatttcctgccccgtattgggactggaaaggagagtgtgcacacctatcagcagatggtccaggccattgatgagctggttcgaaaaaccttccaagagtggacatcaagtctggacaaggattgcattcggcggttggataccccattgctgcgaatcagccaggagaaggcgggcatgctggatgtcaactttgacaagtcccttctgattctctttgcggaaattgactactgggagcggctgctgtttgagacgccccattacgtggtgaacgtagctgagcgagccgaggacctgcgcattctgcgtgaaaatctgctactcgttgctagagactacaataggattattgccatgctgtccccagatgagcaggccctattcaaagagcgtattcggctcctggataagaagatccacccgggactcaagaaactgcactgggccttgaagggggccagtgccttcttcatcacggagtgccgtatacatgccagcaaggtgcagatgattgtgaatgagttcaaggcatccactctgaccattggctggcgagcccaagagatgtcagagaagctgctggtacgcattagtggcaaacgggtatacagggacctggaatttgaagaggaccaaagagagcatcgggcagctgtacagcagaaattgatgaacctgcaccaggatgtggtgaccatcatgaccaactcctatgaggtcttcaagaatgatggtcctgagattcagcagcagtggatgctgtacatgattcggctggaccgcatgatggaggatgccctgcgcctgaatgtgaagtggtcactgctagaactatccaaggctatcaacggggatggaaagaccagcccaaacccactcttccaagtccttgtcattttgaagaatgatctgcaaggaagtgtggcacaggtggaattctcacccactctgcagactttggcaggtgtggtcaatgacattggcaaccacctcttttccaccatctctgtcttctgccacctccctgacattctcaccaagcgcaagttacatcgtgaacccatccaaacagttgtggagcaagatgaggacatcaagaagatccagacccaaatcagcagcggcatgactaacaacgcaagcctgctgcagaactacctcaagacctgggacatgtaccgggagatctgggagatcaacaaggactccttcattcatcgctaccagcgcctcaaccctcctgtctcttcttttgttgccgacattgcccgctacacggaagttgctaataacgtgcagaaggaggagacagtcaccaacatccagtttgtgctgctggactgttcgcacctcaagttctccctggtgcagcactgcaatgaatggcagaacaagttcgcgactctgctcagggagatggctgctgggcgcctcctggagctgcacacctacctgaaggagaacgcagagaaaatcagccgccctccgcagacactggaggaactgggggtcagcttgcagctcgtggatgccctgaagcacgacttggccaacgtggagactcagatccctcccatacacgagcaatttgccattcttgaaaagtacgaggtgccagtcgaggacagtgtcctggagatgctggacagtctcaacggggagtgggttgtcttccaacaaactctgctggacagtaagcaaatgctgaagaaacacaaggagaaattcaagacaggcctgatccactcggcagatgacttcaagaagaaagcacatacacttctggaagatttcgaattcaaaggccatttcaccagcaacgtgggatacatgtctgccttagaccagattacacaagtgcgggccatgctgatggccatgcgggaagaggaaaatagtctccgagccaacctgggcatcttcaagatcgagcagccaccctccaaggaccttcagaacctggagaaggagctcgatgccctccagcaaatctgggagatcgcacgagactgggaggagaactggaatgagtggaagactggccggttcctgatcctgcagacggaaaccatggagaccacggcccacgggctgtttcgtcgcctcacaaaattagccaaagagtataaggaccgaaactgggaaattattgaaaccactcgctcaaaaatagagcagttcaagaggaccatgcctctcatctcagacctgcggaaccctgcccttagagagaggcactgggaccaggtccgggatgagatccagcgggagtttgatcaggaatctgaaagcttcaccttggagcagattgtggagcttgggatggatcagcatgtggagaaaattggggagatctctgcttcagcaactaaagagctggctatagaagtggctttacaaaacattgccaagacctgggatgtgactcagctcgacatagtaccctacaaggataagggccatcatcggctcagaggtacagaagaagtattccaggcactggaagataaccaggtagctctgtctaccatgaaggcatcacgctttgtcaaggcctttgagaaggatgtggaccactgggaacgctgcctctccctcattttggaggttattgagatgattctcacagtgcagcgtcagtggatgtacttagagaatatcttcctaggagaagacatccgcaagcagctgcccaatgaatcgaccttatttgaccaggtcaacagcaactggaaagccatcatggacaggatgaacaaggacaacaatgctctccggagcacccatcacccaggcctcctggacacattgatagaaatgaatacaatcctggaagatattcagaaatctctggatatgtatttagagaccaagcgacatattttcccccgcttctacttcttgtccaatgatgacctgctggagattctgggccagtcccgaaacccagaggctgtgcagccacacctcaaaaaatgctttgacaacatcaagttgctgagaatccagaaggttggagggcccagcagcaaatgggaagctgtggggatgttctcgggcgacggcgagtacattgacttcctccactcagtatttttagaaggccctgtggagtcctggcttggcgatgtggaacagaccatgagggtgaccctgcgggaccttctccggaactgccacctggccctcaggaagttcctcaacaagagggacaaatgggtgaaggagtgggctggccaggtggtgatcactgccagtcagatccagtggacggctgatgtcaccaagtgcctgctgacagcgaaggagcgggcagacaagaaaatcctcaaggtcatgaagaagaaccaggtgtcaatcctgaataagtattcagaagccatcagggggaacttgaccaagatcatgcggcttaaaattgtggctctggtgacgatagaaattcatgcccgggatgtgttggagaagctttacaagagtggcctcatggatgtcaattcctttgactggctcagccaacttcggttctactgggagaaggatcttgatgactgtgtcatccgccagaccaacacgcaatttcagtataattatgagtacttgggtaactcgggccggctcgtcatcacccccctgacggacaggtgttacatgacactgaccacggcattgcacctgcaccgagggggctcccccaaaggccctgcaggcacaggcaagaccgagaccgtcaaggacctgggcaaggccctgggcatatatgtcattgtggtcaactgctctgagggcctggactacaagtccatgggccgaatgtactcaggtctggcccagactggagcttggggctgctttgatgagtttaaccgcatcaacatcgaggtgctgtcagtggtggcccaccagatcctgtgcatcctgtctgccctggctgccggcctcacccatttccattttgatggctttgaaataaatctggtgtggtcctgtgggatcttcattaccatgaatcctggctatgctggccgcacagagcttcccgaaaatcttaaatccatgttccgcccaattgccatggtggtgcctgactccaccctcattgcagaaatcattctctttggagagggctttggcaactgcaagattctggccaagaaggtgtacacactctactcactggctgtgcagcagctgtccagacaggaccactatgactttggcctgcgtgccctcacctcccttctgcgctatgctggcaagaagcgccgcctacagccggatctgactgatgaagaggttctgctgctctcaatgagagatatgaacatcgccaagctcacttcagttgatgcacccctgttcaatgccatcgtgcaagatctgtttcccaacattgagctgcctgtcattgactatggcaagctgcgggagaccgttgagcaggagattcgagacatgggcctgcaaagcacgccgttcaccctcaccaaggttttccagttgtatgaaaccaagaactcccgccactccaccatgatcgtgggctgcacgggcagcggcaagactgcctcatggcgcattctacaggcctccctgtcctctctgtgccgcgccggagaccctaacttcaacattgttagagagttccctttgaaccccaaggcattgtccctaggggaactgtatggggaatatgacctcagcaccaatgaatggacagatggcatcttgtccagtgtcatgcggacggcatgtgcagatgagaaacccgacgagaagtggatcctgttcgatggccccgtggacacactgtggatcgagaacatgaactccgtcatggacgataacaaggtgttgaccctcatcaacggcgagcgcatcgcgatgcccgagcaggtgtctctcctgtttgaagtggaggacctggcaatggcctctccggccactgtatcccgctgcgggatggtctacactgactacgctgacctgggctggaagccctatgttcagtcatggctggagaagaggccaaaggctgaggtggagccccttcaacgcatgttcgaaaagctcatcaacaagatgctggcctttaagaaggacaactgcaaggagctggtgcccctgcccgagtacagcggtatcacctccctctgcaagctgtactctgccctggccacgccagagaatggggtgaacccagctgacggcgagaactatgtcaccatggtagagatgacatttgtgttcagcatgatctggtctgtgtgtgcctctgtggatgaggagggccggaagaggatcgacagctacctccgagagatcgagggctcctttcccaataaggacacggtatatgagtattttgtggaccccaaaatacggagttggacatcatttgaggacaagctccctaagagttggcgctaccctccaaacgcccccttctataagatcatggtgcccaccgtcgacactgttcgctacaactacctggtgagcagcttggtggccaaccagaatcccattctgctggtgggtcccgtggggactgggaagacctccatcgcccagagcgttctgcagtccctgccctccagccagtggtcggtgctcgttgtcaacatgtccgcacagaccacatccaataacgtgcagagcatcattgagagcagggttgagaagcgaaccaagggtgtctacgtgccattcgggggcaaaagcatgatcacctttatggatgacctaaatatgcccgctaaggacatgtttgggtcccagccacccctggagctgatccgcctctggattgactatggcttctggtatgaccgtacgaagcagaccatcaagtacattcgagaaatgttcctgatggctgccatgggcccccctgggggtggacggactgtcatctccccaaggctacggagtcgcttcaacattatcaacatgaccttccccacaaagtcccagatcatccgcatattcggcaccatgatcaatcagaagcttcaggactttgaggaagaggtgaagcccattgggaacgtggtgacagaggccaccctggacatgtacaacaccgtggtacagcgcttcctgcccacgcccaccaagatgcattacctcttcaaccttcgagacatctccaaggtgttccagggcatgcttagagccaacaaggacttccatgataccaagtccagcatcacacggctctggatccatgaatgtttcagagtcttctctgaccggctggttgatgcggcagacacagaagccttcatgggcatcataagcgacaagctcggctccttctttgacctcacatttcatcatctctgtcccagcaagcgtcctcctatctttggggatttcctgaaggagcccaaggtgtatgaagacctcacggatctgacagtgctgaagacagtcatggagacagctctaaatgagtataacctgtcaccctctgtcgtgcccatgcagctagtgctcttccgagaggctattgaacacatcacacggatcgtgcgggtcattggacagcctcggggcaacatgctcctggtgggtatcgggggcagcggacgccagagtctggcccgcctggcttcatccatctgcgactacaccaccttccagatcgaggtcaccaaacattatcggaagcaggagttccgagatgatatcaagcgtctgtatcgccaggctggggtggagctcaagaccacgtccttcatttttgtggacacccaaatagctgatgagtccttcctagaggacatcaacaacatcctcagctcaggcgaggtgcccaatctctacaagcctgatgaatttgaagagatccagtcgcatatcatagaccaggcccgggtggagcaggtgcctgagtcatcggacagcctcttcgcctacctcattgaacgcgtgcagaacaacctgcacatcgtgctctgcctcagccccatgggggatcccttcaggaactggatccgccagtacccagccttggtgaactgcacaaccatcaactggttctcagagtggccccaagaggccctgctcgaggtggctgagaagtgcctcataggagtagacctgggaactcaggagaatatccacaggaaggtggcccagatctttgtcactatgcactggtcagtagctcagtattcccagaagatgctgttggaactgcggagacacaactatgtcacacccaccaaatacctggaactcctgtctggatataagaagttgctgggagaaaaacggcaggagctgctggcccaagccaataaactgcggacaggcttgttcaagatcgacgaaactagggaaaaggtgcaagtgatgtcgttggagctggaggatgccaagaagaaggtggctgagttccagaagcagtgtgaggagtacctggtcatcattgtgcagcagaagcgggaggcagatgagcagcagaaggccgtaacagccaacagtgaaaagattgcagttgaggaaatcaagtgtcaggcactggctgacaatgcccagaaagatctagaagaggcactgcccgccctggaagaggccatgcgggccctggagtctctgaacaagaaggatataggagagatcaagtcttatggacggcccccagcccaagtggagatagtgatgcaggcagttatgattcttcgaggcaacgagcccacatgggcagaggccaagaggcagctaggggaacagaacttcatcaagtcactgatcaactttgataaagacaatatctcagataaggttctgaagaagattggggcctactgcgcccagcctgacttccagcctgatatcatcggccgcgtctccctggctgccaagtccctctgcatgtgggtgcgggccatggagctgtatgggcggctatatcgggtggtggagcccaagcgaatccgaatgaacgctgccttggctcagcttcgggagaagcaagccgcgctcgctgaggcccaggagaagctgcgggaggtagctgagaaactggagatgctaaagaaacagtatgatgagaagctggcacagaaggaggagcttcgcaagaagtctgaagagatggagctgaagctggagcgagctgggatgctcgtgtcggggttggctggcgagaaggccagatgggaggagacagtccagggcctggaggaggacctgggctacctggtgggggactgtctcctggcagctgccttcctgtcctacatgggacccttcctgaccaactaccgggatgagattgtcaaccaaatctggatcgggaagatctgggagcttcaggttccttgctccccttctttcgccatcgataacttcctgtgcaatcctaccaaagtccgggactggaacatccaagggttgccctcagacgccttctccactgagaatggcatcatcgtcacccgaggcaacaggtgggcactgatgatcgaccctcaggcccaggccctgaaatggattaagaacatggaaggaggccagggcctgaagatcatcgacctgcagatgagcgattacctgcgaatcctagaacacgccattcactttggatacccggtgctacttcagaacgtgcaggaatatctggaccccacactgaaccccatgctcaacaaatctgtagcccgaatcggtggtcggctgttgatgcgcattggcgataaggaggtggaatataataccaatttccgtttctacatcaccaccaagctctccaacccccactacagcccagagacctcagccaagaccaccatcgtcaactttgctgttaaagaacagggcctggaggcccagctgctgggcattgtggtgcggaaggagcggcctgagctggaggagcagaaggactcactggtcatcaacatcgcggctggtaaaaggaagctcaaggagctggaggatgagatcctgcggctgctgaatgaggccaccggctccctgctggatgatgtgcagctggtgaacacgctgcatacctccaagatcacagccacagaggtgactgagcagctggagaccagtgagaccacagagatcaacactgacttggcgcgggaggcttaccgcccatgcgcccagcgggcatcaatcctgttcttcgtgctcaatgatatgggctgcatcgaccccatgtaccagttctcactggatgcctacatcagcctctttattctcagcattgacaaaagccaccgcagcaataagctggaggaccgcattgactacctgaatgactaccacacctacgctgtctacaggtacacctgccgtacccttttcgaacgccacaaactactattcagttttcatatgtgtgccaaaatcttggagacttctggcaagctcaacatggatgaatacaacttctttctacgtgggggtgtggtcttggatcgggagggccaaatggacaatccatgtagtagctggcttgcagatgcctactgggataacatcacagagctagacaaactgaccaacttccacggactcatgaactcctttgagcagtaccctcgtgactggcacctgtggtataccaatgctgccccggagaaggcgatgctgccaggtgagtgggaaaatgcctgcaatgaaatgcaacggatgctgatcgttcgctccctgcgccaggaccgcgtggccttctgcgtgacctccttcatcatcaccaaccttggctcccgcttcatcgagccgcctgtgctgaatatgaagtcggtgctggaggattcaaccccacgatccccactcgtgttcatcctgtcccctggtgtggaccccaccagtgccctgctgcagctggcagagcacatgggcatggcccagcgcttccacgccctgtccctgggccagggccaggcccccatcgctgctcggctcctccgagagggtgtgactcagggacactgggtgttcctggcaaactgccacctgtcactgtcttggatgcctaatctggacaagctggtggagcagctgcaggtggaggatcctcatccatccttccgcctctggctcagctccatcccccacccagacttccctatctcaatcttgcaggtcagcatcaagatgaccacagagccaccaaagggcctaaaggccaacatgacacgtctttaccaactgatgtcagaaccacagttttcccgctgctccaaacctgccaaatataagaagctgctgttttcactctgtttcttccactctgtgttacttgaacgcaaaaagttcctgcagcttggctggaacatcatctatggcttcaatgactccgactttgaggtgtcagaaaacttgctgagcctctatctcgatgagtacgaggagacaccttgggacgcacttaagtacctcattgccggcatcaactatggtggacatgtcacagatgactgggaccggcgcctgctgaccacctacatcaatgattatttctgtgaccagtctctatcaactcccttccaccggttgtcagcactggagacttatttcatccccaaggatggcagcctcgcttcttacaaggaatacatcagcttattgcctggcatggacccccctgaggcctttggccagcaccccaatgctgatgtggcctctcagatcactgaggcacaaaccctctttgatactttgctttccttgcaacctcagattacacccaccagggctggaggccagacccgggaagagaaggtccttgagttggccgctgatgtgaagcagaagatccctgaaatgatcgactatgaggggactcaaaaactgctagctctcgacccctcccccctcaatgtggtccttctgcaggagatccagagatacaacacactgatgcagaccatcctgttctcactgacagacctagagaaaggcatccagggtctcatcgtcatgtctacaagcctggaagagattttcaattgcatctttgatgcccatgttcctccgctctggggaaaggcatacccctcacaaaagccattggctgcctggacccgggacttggccatgcgtgtggagcagtttgagctgtgggccagccgggcccggcctcctgtgatcttctggttgtctggtttcacctttcccactggcttcctcactgctgtgctgcagtcttcagctcgccaaaacaacgtttcagtggacagcctctcctgggagtttatcgtttccactgtggatgacagcaacctagtgtatccccccaaggatggtgtctgggtccggggcctgtacctggaaggtgctggctgggaccggaagaactcctgcttggtggaggcagagcccatgcagcttgtctgcctcatgcccacgatccacttccggcctgcagagagccgcaagaagagcgccaagggcatgtactcctgcccctgctattactatcccaaccgggcaggcagctcagaccgagcctcctttgtcatcggcattgacctgcggtctggggccatgacacctgatcattggatcaagaggggcactgctctactcatgagcctggacagctgagacctcctcctcttctccgcttgagagagagggtcagggactccaggagctaagacagatgttgcacctaggactgaggccggacctcactcagactttgaccttggccgaatttgtgtgatgtggccctggagatacctagttgtgttagccataaaagtgaaagagttgtattggagctcagtgctgtaaaacacccgcgacaacaagc

SEQ ID NO: 8975 - DNA, 2240 bp, Homo sapiens
caagcaaccggtaaacgccgccgtttgaggagcaccggagccgcgaccgtggattgaacgcttccccagagacccagaagcagaaggagcggacccaggccggcaccatggagattgtgtacgtgtacgtcaagaagcgcagcgagttcgggaagcagtgcaatttctcggaccgccaggccgagctgaacatcgacatcatgcccaaccctgagctggccgagcagttcgtggagcggaacccagtggacacgggcatccagtgctcgatcagcatgtcggaacacgaggccaactcagagcggtttgagatggagacccggggagttaaccatgtcgaggggggctggcccaaggacgtgaaccccctggagctggagcagaccatccgtttccggaagaaagtggagaaagatgagaactacgttaacgccatcatgcagctcggctctatcatggagcactgcatcaagcagaacaatgccattgacatctatgaagagtatttcaatgacgaggaggccatggaagtgatggaggaggacccttcagctaaaaccatcaatgtgttcagggacccccaggaaatcaagagggctgccacacacctctcctggcaccccgatggcaacaggaagttggcagtggcatactcctgcttggattttcagcgggcacctgtgggcatgagcagcgattcatacatctgggacctggaaaaccccaacaagcctgaacttgctctgaagccatcgtctccactcgtgacgttggagttcaaccccaaagattcccacgtactcctgggtggctgctacaatggacagatagcctgctgggacacccgaaagggcagcctggtggcggagctatccaccattgagtccagccaccgagaccctgtgtatggcaccatctggctgcagtcgaagacgggcaccgagtgcttctcagcttccacggatgggcaggtcatgtggtgggacatccgaaagatgagcgagcccactgaagttgtgatcttggacatcaccaagaaggaacagttggaaaatgccttgggggccatctccctggagttcgaatctactttgcccaccaagttcatggtggggaccgagcagggcatcgtcatctcctgcaaccgcaaggccaagacgtcagctgaaaagattgtgtgcaccttcccgggccatcatggccccatctacgccctccagagaaaccccttctacccgaagaacttcctgacggttggcgactggacagcccgcatttggtctgaagacagccgggaatcgtccatcatgtggaccaagtaccacatggcttacctcactgatgctgcctggagccccgtgaggccgaccgttttctttaccaccaggatggacggaaccctggatatctgggacttcatgttcgagcagtgcgatcccaccctcagcttgaaggacaatgggtgtctcatcgcctgcggctcccagctggggacaaccaccctgctggaggtctcgcctgggctctctaccctccagaggaatgagaagaacgtagcctcttccatgtttgagcgtgagacccggcgagagaagatcctggaggccaggcaccgggagatgcggctgaaggagaagggtaaggcggagggcagggatgaggagcagaccgatgaggagctggccgtagacctggaggcgctggtcagcaaggccgaggaggagttcttcgacatcatcttcgcagagctgaagaagaaggaggcagacgccataaagctgacgccagtgcctcagcaaccaagtccagaagaagaccaggtggtggaggagggagaggaagcagcgggggaagaaggggatgaagaagtggaagaagacttagcctagaagtcagccttcgactgcggcgctatccctgtgtgccttcctttcccacctcttgaccctcaaccagacttgcatggccatggcagggcctcgggaagaccttcaggagtggggaagggtttctcctccatgatcgaccctcctcgtccacctacaaatcaggaacagaaagtctgtccactttgaaaatacctttccaggcagctccctgaccatttggacacattgccacgacaggagcctccaagtatgtgggaggggacgggcgggacgagcttggctgttctgctgcacctgaatgctttctgttatcctaattcttgtaaaattaaatgaatcgtaacaatgcca

SEQ ID NO: 8976 - DNA, 3100 bp, Homo sapiens
gagaaggacaatgggctggatgtgttcaagttgagtgaccgcgacttcctgcgcagcatggagaacgccatccgctttggcaagccatgtctcctggagaacgtgggcgaggagctagacccagccctggagccagtgctgctcaagcagacgtacaagcagcagggaaacacggtgctgaagctgggggacacggtgatcccctaccatgaggacttcaggatgtacatcaccaccaagctgcccaacccacactacacgcccgagatctccaccaaactcaccctcatcaacttcaccctgtcgcccagtggcctagaggaccagctactgggccaggtagtggcagaggagcgacccgacctggaggaggccaagaaccagctgattatcagtaatgccaagatgcgccaggagctgaaggacattgaggaccagatcctgtaccggctcagctcctccgagggcaaccctgtagatgacatggaactcatcaaggtgctggaagcctccaagatgaaggctgctgagatccaggccaaagtcaggattgcagagcagacggagaaggacatcgacctgacgcgcatggagtacatacccgtggccatccgcacccagatcctcttcttctgtgtgtccgacctggccaacgtggaccccatgtaccagtactcccttgagtggtttctcaacatcttcctctcgggcatcgccaactcagagagagcagacaacctgaagaagcgcatctccaacatcaaccgctacctgacctacagcctctacagcaacgtctgccgcagcctctttgagaagcacaagctgatgtttgccttcctgctgtgtgttcgcatcatgatgaacgagggcaaaatcaaccagagtgagtggcgatacctcctgtctgggggctccatctcgatcatgactgagaatccggcaccggactggctgtcagaccgggcttggcgagacatcctagcactctcgaacctgccaaccttttcctccttctcttccgacttcgtgaagcacctctcagaattccgggtcatcttcgacagccttgagccccaccgggagcctttgcctggcatctgggaccagtacctagaccagttccagaagctgctagtcctccgctgcctgcgtggggacaaggttaccaacgccatgcaggactttgtggccaccaacctggagccacgcttcattgaaccccagacagccaatctgtcagtggtgttcaaagactccaactccaccacacccctcatctttgtgctgtcacccggcacagaccctgctgccgacctctacaagtttgccgaagaaatgaagttctccaaaaagctctctgccatctccctgggccaggggcagggccctcgggcagaagccatgatgcgcagctccatagagaggggcaaatgggtcttcttccagaactgccacctggcaccaagctggatgccagccctagaacgcctcatcgagcacatcaaccccgacaaggtacacagggacttccgcctctggctcaccagcctgcccagcaacaagttcccagtgtccatcctgcagaacggctccaagatgaccattgagccgccacgcggtgtcagggccaacctgctgaagtcctatagtagccttggtgaagacttcctcaactcctgccacaaggtgatggagttcaagtctctgctgctgtctctgtgcttgttccatgggaacgccctggagcgccataagtttgggcccctgggcttcaacatcccctatgagttcacggatggagatctgcgcatctgcatcagccagctcaagatgttcctggacgaatatgatgacatcccctacaaggtcctcaagtacacggcaggggagatcaattacgggggccgtgtcactgatgactgggaccggcgctgcatcatgaacatcttggaggacttctacaaccctgacgtgctctcccctgagcacagctacagcgcctcgggcatctaccaccagatcccgcctacctacgacctccacggctacctctcctacatcaagagcctcccactcaatgatatgcctgagatctttggcctgcatgacaatgccaacatcacctttgcccagaacgagacgttcgccctcctgggcaccatcatccagctgcaacccaaatcatcttctgcaggcagccagggccgggaggagatagtggaggacgtcacccaaaacattctgctcaaggtgcctgagcctatcaacttgcaatgggtgatggccaagtacccagtgctgtatgaggaatcaatgaacacagtactagtacaagaggtcattaggtacaatcggctgctgcaggtgatcacacagacactgcaagacctactcaaggcactcaaggggctggtagtgatgtcctctcagctggagctgatggctgccagcctgtacaacaatactgtgcctgagctctggagtgccaaggcctacccatcgctcaagcctctgtcatcatgggtcatggacctgctgcaacgcctggactttctgcaggcctggatccaagatggcatcccagctgtcttctggatcagtggattcttcttcccccaggctttcaacaggcactctgcagaattttgcccgcaaatttgtcatctccattgacaccatctcctttgatttcaaggtgatgtttgaggcaccatcagagttaacacaaagaccccaagtagggtgctatatccatggattattcctggaaggtgcccgctgggatccagaggccttccagctggctgagtctcagcccaaggagctgtacacagagatggccgttatctggctcttgccaacacccaaccgcaaggcccaggaccaggacttttacctgtgccccatctacaagacactgactcgtgctggaacactatcaaccacaggacactctaccaactatgtcattgctgtggagatccccacccatcagccccagcgacactggataaagcgtggtgtggccctcatctgtgccctggactactagactcagacagaagggctggggccattaaagctgaattttctaagc

SEQ ID NO: 8977 - DNA, 13104 bp, Homo sapiens
ggggggtacccaacctatacgcagacccattgagcagccagactgccctaaacagggctatggagtccttgtcccttctaagagctgtggacaccttgcctccagttcccctcacagtcctttcttccttctgcagtgatcactgagtacctgtgtgaatgccaacaagaaaaataaaaccacagtttggattcaggaaaggttgcaccaccatcaggtcttgaagggagcttcggctggggcatctccctgagaagcagcatggagcagcctaacagtaaaggctatagcctgggaaggacccctcagggcccagagtgcagcagtgctcctgcagtccaagtggggacccacaggggcctagagtataacccggggaagattcttccaggatcagactatgggttgggaaatcctccagcccttgaccccaagctcccacatttacccctgcccccggccccacccacactctcagacttggggcagccacggaagtcacccctgacaggcactgataagaagtacccgctgatgaagcagcgtgggttctactccgacatcctcagccctggaaccttagatcaacttggggaggtatgtcgtggcccccgaatgagccagaacctcctgcggcaggctgaccttgacaagttcaccccaagagtcggaagctttgaggttcctgaagacttccaggagcgcatggagcagcagtgcatcgggtccaccacccggctgctcgcccagactgacttcccactgcaggcctacgagcccaagatgcaggtgcctttccaggtgctgccaggccagcatcctcgcaagattgagatcgagaggaggaaacagcagtacctgagcctggacattgagcagttgctgttcagccagggcatcgactccaacaagctcatgcccaggcacctggaccaccagcacccccaaaccatcgaacagggccatgacccaatcttccccatctacctcccactgaaggtatttgacaatgaggactttgactgccggactcccagagagtggatcaacatgggcttggagccagggtctctggacaggaaacctgtcccgggaaaagccctcttgcccactgatgacttcctggggcatgaggaccccaagagtcagaagctgaagtacaaatggtgcgaggtcggcgtcctggactacgacgaggagaagaagctatacctggtacacaagacagacgagaaaggcctggtgcgagatgagatggggaggcccatcctgaatgcaggggtcaccactgaaggaaggccaccccttcaggtctgtcagtactgggtgccacggatccagcttctcttctgcgctgaggacccttgcatgttcgcacaacgtgtggtccaggccaacgccctgcgcaagaacacggaagcactgctgctctacaacttgtatgtggactgcatgccctctgacggccagcatgtcatcagtgaacagagcctgagcaagatcaagcagtgggccctgagcacgcctcggatgcgcaaaggcccctcggttctagagcacctcagcagtcttgccagagaagtgagcctggactatgagcgcagcatgaacaagatcaactttgaccacgttgtctcttccaagcccgagaccttctcctacgtcaccctccccaagaaggaggaggagcaggtgcctgagcgagggctggtgagtgtccccaagtaccacttctgggagcagaaggaggacttcactttcgtgtccctgctcacacggccagaggtcatcacggccctcagcaaggtgagggccgagtgcaacaaggtgaccgccatgtccctgttccactcgagcctctccaagtacagccacctggaggaatttgagcagatccagtcacagaccttctcccaggtgcagatgttcctcaaggacagctggatcagctcgctaaaggtggccatgcgcagcagcctgcgcgacatgagcaagggctggtacaacctctacgagaccaactgggaggtgtacctcatgtccaagctgcgcaagctgatggagctggtgaagtacatgctgcaggacacactgcgcttcctggtgcaggactcacttgccagcttctcacagttcatcagcgacacctgttgcagcgtgctcaactgcaccgatgacatggtctggggtgacgacttaattaacagcccctacaggccccggaagaatcccctgttcatcatggacctggtgctggacagctctggggtgcactatagcaccccactggagcagtttgaggcatctctgctgaacctcttcgacaagggcatcctggccacccatgccgtgccccagctggagaagctggtgatggaggacatcttcatcagcggtgaccccctgctggagtccgtgggccttcatgagccactggtggaagagctacgggccaccattgccagtgccgtgtccaaggccatgatcccactgcaggcctacgccaaggagtaccgaaagtacctggagctgaacaacaatgacattgcctcctttctcaaaacctaccagacgcagggcctgttggcccaggaggtgcgggaggtagtgctcacccacctgcgggagaaggagatcctggacagctcgctgcccagcagcatcatcattgggcctttctacatcaacaccgacaatgtcaagcagagcctgtccaagaaacgcaaggccctggccacttccgtgctggacatccttgccaagaacctgcataaggaggtggatagcatctgcgaggagttccgcagcatcagccgcaagatctatgagaagcccaacagcattgaggagctggctgagctgcgagagtggatgaagggcatcccggagaggctggtgggcctggaggagcggattgtgaaggtcatggatgactaccaggtcatggatgaattcctctacaacctcagctcagatgacttcaatgacaaatggattgccagcaactggccttctaagatccttgggcagatagagctggtgcagcagcagcatgtggaggatgaggagaagttccgcaaaatccagatcatggatcagaacaacttccaagagaagctggaagggctgcagctggtagtagctggcttctccatccatgtggagatttcacgtgcacacgagatcgccaacgaggtgcggcgtgtcaagaagcagctgaaggactgccagcagctggccatgctctacaacaaccgcgagcgcatcttcagcttgcccatcaccaattatgacaagctctccaggatggtgaaggagttccaaccctacctggacctttggaccacagcgtctgactggctgcgctggtcggagagctggatgaatgaccccctctctgccatcgatgctgagcagctggagaagaacgtggttgaagccttcaagaccatgcacaagtgcgtgaagcagtttaaggacatgccagcctgccaggaagtggccttggacatccgggcccgcatcgaggagttcaaaccatacatcccactgatccaggggctgcgcaaccctggcatgcggatccggcactgggagacactgtccaaccagatcaacatcaatgtcaggcccaaggccaacctgacctttgctcgctgcctggagatgaacctgcaggaccatatcgagagcatcagcaaggtggctgaggtggctggcaaggagtacgccatcgagcaggcactggacaagatggagaaggagtggtcgaccatcctgttcaatgtactgccctacaaggcgacagacacctacatcctgaagagcccggacgaggcctcacagctgctggacgaccacatcgtcatgacccagaatatgtcattttcaccctacaagaagccctttgagcagcgcatcaactcctgggagaacaaactgaagctgacccaggaggttctggaggagtggctgaactgtcagcggtcctggctctacctggagcccatctttagctctgaggacatcaaccagcagctgcctgtggagagcaagcgctaccagaccatggagcggatctggaagaagatcatgaagaatgcctacgagaaccgggaggtgatcaatgtgtgttccgacctgagaatgctggacagcctgcgggactgcaacaagattctggacctggtgcagaagggcctcagcgagtatctggagaccaagaggagcgccttccccagattctacttcctgtcagatgatgaactactagagatcttgtcgcagacaaaggaccccacggccgtgcagccacacctgcgcaagtgcttcgagaacatcgctcggctgctattccaggaggacctggagatcacgcacatgtactcagccgagggggaggaggtacagttgtgcttctccatctacccctccagcaacgtggaggactggctgcgggaggtggagcgcagcatgaaggccagtgtgcacgacatcattgagaaggccatcagggcctaccccacgatgcccaggacccagtgggttctgaactggcctggccaggtgaccatcgctgggtgccagacctactggaccatggaggtggcagaggctctggaggccggcaacctcagaagccaactgttcccccagctctgccagcagctcagtgatctggtggcccttgtgcgggggaagctgtcccgcatgcagcgggcagtgctgtcagcgctaatcgtcattgaggtccatgccaaggacgtggtgagcaagctaatccaggagaacgtggtcagcgtgaatgacttccagtggatctcacagctgaggtactactggacaaataatgacctgtatatccgtgctgtgaatgctgagttcatctatggctatgagtacctgggcaacagtgggaggctggtgatcacgcccctcaccgacaggtgctacctgacactgaccggagctctgcacctcaagtttgggggtgccccagctggcccagctggcacaggcaaaactgagaccaccaaagacctgggtaaggccttggccatacagaccgttgtgttcaactgctctgaccagctcgacttcatggccatgggcaagttcttcaagggcctggccagtgctggggcctgggcctgcttcgacgagttcaatcgcatcgacatcgaggtgctgtctgtggtggcgcagcagatcaccaccatccagaaggcgcagcagcagcgggtggaacgcttcatgtttgagggtgtggagatcccactggtgccatcctgcgcagtgtttatcaccatgaacccgggctacgctggccgcacggagctgcctgacaatctgaaggcgctcttccgacccgtggccatgatggttccagattacgccatgatcactgagatctccctctattcctttggctttaatgaggccagtgtgctggctaagaagatcacaaccaccttcaagctgtcttctgagcagctcagctcccaggatcactatgacttcgggatgagagccgtgaaaactgtgatctcggctgctgggaacctcaagcgagaaaaccccagcatgaatgaggagctgatctgcctccgggccatccgtgatgtgaacgtgcccaagttcctgcaggaggacctcaagctcttctctggcatcgtgtccgacctgtttcccaccatcaaggaggaggacacggactacggcatcctggatgaggccatccgcgaggcctgcaggaacagcaacctcaaggatgtggagggcttcctgacaaagtgcatccagctctacgagaccacggtggtacgacacggcctcatgctcgtcgggcccacaggctccggcaagagtacttgttacagagtcctggcagctgccatgacgtcactgaaagggcagccatccatcagtggtggcatgtacgaggctgtcaactactacgtgctcaaccccaagtccatcacgatgggccagctgtacggggagtttgacctcctcacccatgagtggacagacgggatattctcctcgttcatccgggcgggggccatcacctccgacaccaacaagaagtggtacatgttcgatgggccggtggatgccatctggattgagaacatgaacacggtgctggatgacaacaagaagctgtgcctcagctctggggagatcatcaagctcacagaggcaatgaccatgatgttcgaggtgcaagacctggcggtggcttcaccagctacagtctcccgctgtggcatggtgtacctggagcccagcatcctggggctcatgcccttcatcgagtgctggctgaggaagctgcctcccttgctgaagccctatgaggagcatttcaaggccctctttgtcagcttcctggaggaatccatctccttcgttcggtcctcagtgaaggaggtgatcgcctcaaccaactgcaacctgaccatgagcctcctcaagctgctggactgcttcttcaagccctttctgcctagagagggcctcaagaaaataccctctgaaaagctgagtcgcatcgtagagttgatcgagccctggttcatcttctccctgatctggagcgtgggtgccactggggacagcagtggccgcaccagtttcagccactggctaaggctcaagatggagaacgaacagctgactctgcttttcccagaagaggggctggtgttcgattacaggctggaggacgcgggcatcagtggcaccaacgacagtgaggatgaagaggaggaatacaagcaggttgcctgggtgaagtggatggactcctcagctccattcaccatggtaccagacaccaactactgcaacatcattgtgcccaccatggacaccgtgcagatgtcccatttactggacatgctgctcaccaacaagaagcccgtgctgtgcattgggccaacaggcacggggaagacgctcaccatctctgacaagctcctcaagaacctggcactggattacatcagccacttcctcaccttctcagcccgcacttcagccaaccagacccaggacttcattgacagcaagctggacaagaggcggaagggtgtgtttggaccacctctggggcgcaactttatcttcttcatcgatgacctgaacatgccggccctggagacctacggtgcacagccacccatcgagctgttgcgccagtggatggaccacggcggctggtacgaccgcaagatcattggtgccttcaagaacctagtggacatcaactttgtctgtgccatgggccccccgggtggaggcaggaacaccgtcaccccgcggctgatgcgtcacttcaactacctgtctttcgctgagatggacgaggtcagcaagaaacgcatcttctccaccatcctgggcaactggttggatggactccttggagaaaaaagctaccgggagcgtgtgcctggggccccccacattgcccacttcacggagccccttgtggaagccaccatcatggtgtatgcaaccatcacctcccagctgctgcccactccagccaagtcccactacaccttcaacctgagggacctctccaaggtcttccaaggcatgctcatggctgacccggccaaggtcgaggaccaagtgcagctgctgcgactgtggtatcacgagaactgccgcgtgttccgggaccgactggtgaatgaggaggaccgcagctggttcgaccagctcctcaagcgctgcatggagcagtgggaggtgaccttcaacaaggtctgccccttccagcccattctttacggggacttcatgtcaccaggctccgatgtcaagtcctacgagctcatcaccagtgagagtaagatgatgcaggtgatagaggagtacatagaggactacaaccagatcaacacggccaagctgaagctggtcctcttcatggacgccatgagccacatctgtcgcatcagccgcaccctacgccaggcgctgggcaatgcactcctgctgggcgtgggtggcagcggccgcagctccctcacaaggctcgcctcgcacatggccgagtacgagtgcttccagattgaactatccaagaactacggcatgtccgagtggcgagatgatgtgaagaaggtcctgctcaaggcgggcctacagaacctacccatcaccttcctcttctcagacacccagatcaagaacgaatccttcctggaagatatcaacaacgtcctaaactctggtgacattcccaatctgtatactgcggacgagcaggaccagatcgtcagcaccatgcggccctatatccaggagcagggcctacagcccaccaaggccaacctcatggctgcttacacagggcgtgtgcgcagcaacatccacatggtgctgtgcatgagccccatcggagaggtcttccgagctcgtctgaggcagtttccctccctggtcaactgctgtaccatcgactggtttaacgagtggccggcagaagccctgaagtctgtggccaccgtgttcctcaatgagatcccagaactggaatcctcccaggaagaaatccaaggactgatccaggtctgtgtgtacatccaccagtcggtgtccaagaagtgcatcgagtacctggcagagctgacccgccacaactatgtgacccccaagagctacttggagctgcttcatattttctccatcctcatcgggcagaagaaactggagctgaaaactgccaagaaccgcatgaagagcggcctcgacaagctgctgcgcacttctgaggatgtagccaagatgcaggaggacctggagagtatgcaccccctgctggaggaggctgccaaggacaccatgctcaccatggagcagatcaaggtggatacggccatcgccgaggagacccggaattcagtgcagacagaggagatcaaagccaatgagaaggccaagaaggcacaagctattgctgacgatgcccagaaggacctggacgaggcgttgccagccctggatgcggctctggccagcctgcgcaacctcaacaagaacgatgtgaccgaggtacgtgccatgcagcggccacccccgggtgtgaaactggtcatagaagctgtgtgcattatgaaaggcatcaagcccaagaaggtgcctggagaaaagccaggcaccaaggtggatgactactgggagcctggcaaggggctgctgcaggacccgggccacttccttgagagcctcttcaagtttgacaaggacaacattggggatgtggtgatcaaagccatccagccgtacatcgataatgaagagttccagccagccaccattgccaaggtgtccaaggcttgcacctccatctgccagtgggtgcgcgccatgcacaagtaccactttgtggccaaggccgtggagcccaagcggcaagccctgctggaggcccaggatgacctgggggtgacacagaggatcctggatgaggcaaaacagcgccttcgtgaggtggaggacggcatcgccacaatgcaggctaagtaccgggaatgcattaccaagaaggaggagctggagctgaagtgtgagcagtgtgagcagcggctgggccgagctggcaagctcatcaacgggctgtcggatgagaaggtgcgctggcaggagacggtggagaacctgcagtacatgctcaacaacatctccggcgatgtcctggtggccgctggctttgtggcctacctgggccccttcacgggccagtaccgcacggtgctctacgacagctgggtcaagcagctcaggagccacaatgtcccacacacctccgagcccacgctaatcgggacgctggggaaccctgtgaagatccgatcgtggcagatcgctggcctccccaacgacacactgtcagtggagaacggggtcatcaaccagttttcccagcgctggacccacttcattgaccctcagagccaggccaacaaatggatcaagaacatggagaaggacaatgggctggatgtgttcaagttgagtgaccgcgacttcctgcgcagcatggagaacgccatccgctttggcaagccatgtctcctggagaacgtgggcgaggagctagacccagccctggagccagtgctgctcaagcagacgtacaagcagcagggaaacacggtgctgaagctgggggacacggtgatcccctaccatgaggacttcaggatgtacatcaccaccaagctgcccaacccacactacacgcccgagatctccaccaaactcaccctcatcaacttcaccctgtcgcccagtggcctagaggaccagctactgggccaggtagtggcagaggagcgacccgacctggaggaggccaagaaccagctgattatcagtaatgccaagatgcgccaggagctgaaggacattgaggaccagatcctgtaccggctcagctcctccgagggcaaccctgtagatgacatggaactcatcaaggtgctggaagcctccaagatgaaggctgctgagatccaggccaaagtcaggattgcagagcagacggagaaggacatcgacctgacgcgcatggagtacatacccgtggccatccgcacccagatcctcttcttctgtgtgtccgacctggccaacgtggaccccatgtaccagtactcccttgagtggtttctcaacatcttcctctcgggcatcgccaactcagagagagcagacaacctgaagaagcgcatctccaacatcaaccgctacctgacctacagcctctacagcaacgtctgccgcagcctctttgagaagcacaagctgatgtttgccttcctgctgtgtgttcgcatcatgatgaacgagggcaaaatcaaccagagtgagtggcgatacctcctgtctgggggctccatctcgatcatgactgagaatccggcaccggactggctgtcagaccgggcttggcgagacatcctagcactctcgaacctgccaaccttttcctccttctcttccgacttcgtgaagcacctctcagaattccgggtcatcttcgacagccttgagccccaccgggagcctttgcctggcatctgggaccagtacctagaccagttccagaagctgctagtcctccgctgcctgcgtggggacaaggttaccaacgccatgcaggactttgtggccaccaacctggagccacgcttcattgaaccccagacagccaatctgtcagtggtgttcaaagactccaactccaccacacccctcatctttgtgctgtcacccggcacagaccctgctgccgacctctacaagtttgccgaagaaatgaagttctccaaaaagctctctgccatctccctgggccaggggcagggccctcgggcagaagccatgatgcgcagctccatagagaggggcaaatgggtcttcttccagaactgccacctggcaccaagctggatgccagccctagaacgcctcatcgagcacatcaaccccgacaaggtacacagggacttccgcctctggctcaccagcctgcccagcaacaagttcccagtgtccatcctgcagaacggctccaagatgaccattgagccgccacgcggtgtcagggccaacctgctgaagtcctatagtagccttggtgaagacttcctcaactcctgccacaaggtgatggagttcaagtctctgctgctgtctctgtgcttgttccatgggaacgccctggagcgccataagtttgggcccctgggcttcaacatcccctatgagttcacggatggagatctgcgcatctgcatcagccagctcaagatgttcctggacgaatatgatgacatcccctacaaggtcctcaagtacacggcaggggagatcaattacgggggccgtgtcactgatgactgggaccggcgctgcatcatgaacatcttggaggacttctacaaccctgacgtgctctcccctgagcacagctacagcgcctcgggcatctaccaccagatcccgcctacctacgacctccacggctacctctcctacatcaagagcctcccactcaatgatatgcctgagatctttggcctgcatgacaatgccaacatcacctttgcccagaacgagacgttcgccctcctgggcaccatcatccagctgcaacccaaatcatcttctgcaggcagccagggccgggaggagatagtggaggacgtcacccaaaacattctgctcaaggtgcctgagcctatcaacttgcaatgggtgatggccaagtacccagtgctgtatgaggaatcaatgaacacagtactagtacaagaggtcattaggtacaatcggctgctgcaggtgatcacacagacactgcaagacctactcaaggcactcaaggggctggtagtgatgtcctctcagctggagctgatggctgccagcctgtacaacaatactgtgcctgagctctggagtgccaaggcctacccatcgctcaagcctctgtcatcatgggtcatggacctgctgcaacgcctggactttctgcaggcctggatccaagatggcatcccagctgtcttctggatcagtggattcttcttcccccaggctttcttaacaggcactctgcagaattttgcccgcaaatttgtcatctccattgacaccatctcctttgatttcaaggtgatgtttgaggcaccatcagagttaacacaaagaccccaagtagggtgctatatccatggattattcctggaaggtgcccgctgggatccagaggccttccagctggctgagtctcagcccaaggagctgtacacagagatggccgttatctggctcttgccaacacccaaccgcaaggcccaggaccaggacttttacctgtgccccatctacaagacactgactcgtgctggaacactatcaaccacaggacactctaccaactatgtcattgctgtggagatccccacccatcagccccagcgacactggataaagcgtggtgtggccctcatctgtgccctggactactagactcagacagaagggctggggccattaaagctgaattttctaagc

SEQ ID NO: 8978 - DNA, 14166 bp, Homo sapiens
ctcggcgctcttcatctaccgcactatggtgccggaggaggtggaggtggagattgatgagatacctgtcctgtctgaagagggagaagaggaagaagagacttattctcaaaaagtggagtccgtggataaagtgcgagctaagcgtgtgtcactgagaaccgaatctctaggccaacctctaaacagagaggatgaagaaatggacaaagagatttcagaaaaactcccttccaaaagaactgcgaagcacatcatggaaaagatgcatctccacatgctctgtacccctcttcccgaggagttcctggaccaaaacgtggtgtttttcctcagaaataccaaagaggcaatctctgaagctaccgacatgaaggaagctatggaaattatgccagaaacactggagtatggaattataaacgctaatgtgctccattttctgaagaatattatatgtcaggtttttttgccagcattgtccttcaatcagcacaggacgagtacaaccgtgggagtcacatctggagaagtctctaattcctctgagcatgaatcagacctgccgcccatgcctggggaggcagtagaatatcacagtattcaattaatacgggatgaatttttaatgaacgtgcagaaatttgcaagtaatattcaaagaaccatgcagcaacttgaaggtgagatcaagttagaaatgccaatcatcagtgtggagggagaggtgtctgacctggcagctgacccggaaaccgttgacatcttggagcagtgtgtgataaactggctgaatcagatatccacagcggttgaggcccaactgaagaagacacctcagggtaaaggccctctggctgaaattgaattctggagggaaagaaatgcaaccttaagtgcgctgcatgaacaaacaaagcttccaatagtcagaaaagtcttggatgtgatcaaggaatccgactccatgcttgtggctaatctgcagccagtgttcaccgagttattcaagttccacacggaggcctcagacaatgtgcgctttctctccaccgtggagcgttatttcaagaacataacgcacgggtctggcttccacgtggtcctggacaccatccccgccatgatgagtgccctgcggatggtgtggatcatctcccgacactacaacaaagacgagaggatgattccgctcatggagcgcatcgcctgggaaatcgctgagagagtctgccgagtggtcaacctgcggactttgttcaaagaaaatcgagcgagtgcccaaagcaaaaccttggaagccaggaacaccctcaggctgtggaaaaaggcctattttgacacccgggccaagatagaggcttcggggagggaagatcggtgggagtttgaccggaagcggctgttcgagaggacggattatatggccaccatctgccaggacctctccgacgttctgcagattttggaggaattttataacatatttggtccagaactaaaggcagtgacgggggaccccaagcgcattgatgatgtcctatgcagagtggacggcctagtcacccccatggaaaacctgacctttgaccccttcagcatcaagtcctcccagttctggaaatatgtgatggatgaattcaagattgaagttctgattgacatcattaataaaatctttgtccagaaccttgaaaatccaccactgtataagaatcaccctccagtagcaggtgcaatatactgggaacgatctctgttctttcggattaagcataccatcctccgatttcaagaggtacaagagatactggacagtgatcgaggacaggaggtcaaacaaaaatatttggaagtaggtaggacaatgaaggagtatgaagacagaaagtatgagcagtggatggaggtgacggagcaggtgctgccagctctcatgaagaagagccttttgaccaagtcttccatcgccacagaggagccttcgactttagaaaggggagctgtttttgcaatcaacttttcaccggctctcagagagattattaatgaaacaaagtacttagagcagctggggttcactgtccctgaattagcaagaaatgttgctctccaggaagacaaattccttaggtacacagctgggatacagcgcatgttggatcattatcacatgctcataggaacgttaaacgatgcggagtctgtgcttctcaaagatcattcccaggaactgctccgagtgtttaggtcgggatataagaggttgaactggaactcactaggtatcggtgactatataactggttgcaaacaggccattgggaaatttgagtctctcgtccaccagattcataagaatgcagatgacatttcttccaggctgacattaatagaggccataaatctctttaaatatccagccgctaaaagtgaggaagaactcccaggcgtgaaggaattttttgaacacattgagcgagaaagggccagcgacgtggaccacatggtccggtggtatcttgccattggaccactgctgaccaaagttgagggcctggtcgtccacaccaacacaggcaaggcccccaagctggcctcctactacaaatactgggaaaagaaaatttatgaggtcctgacaaagctcatcctgaagaacttgcagtcttttaattctttgatccttggaaatgtccctctgttccacactgaaaccattctgacggcacctgagatcatccttcatcccaacacaaatgagatcgacaagatgtgcttccattgtgtccggaattgcgtggagatcaccaagcattttgttcgttggatgaatggcagctgcatagaatgcccacctcagaagggggaggaagaggaagttgttataataaacttttacaatgatatctctctgaaccctcagataattgaacaagctgttatgatcccccaaaatgtccacaggattctgatcaatcttatgaagtatctacaaaaatggaagcggtatcgacctctctggaaattggacaaagctattgtgatggagaaatttgctgccaagaaacctccttgtgtagcatatgatgaaaagttgcagttctattccaagatagcttatgaggttatgcgccaccctctaattaaggatgagcattgcatcagacttcagctcaggcatctggcaaacacagtgcaggaaaatgccaagtcctgggtgatttcgcttggaaaacttctcaatgagtcagcaaaagaggagctctataatctccatgaagagatggagcacctggccaaaaaccttaggaagatccccaatacccttgaagatctcaagtttgtccttgcaacaattgcagaaattagaagtaaatctctagtcatggaactcagatatagggacgtccaggagcgataccgtaccatggcaatgtataacctctttcctcctgatgcagagaaagaactggttgataagattgagagcatatggtccaatctgtttaatgattcagtgaatgtggagcatgctcttggggacataaagagaactttcacagagcttactcgaggcgaaataatgaactacagagttcagatagaggagtttgcaaagcgtttttacagtgaaggccctggttctgttggtgatgatcttgataaaggagtagagcttttaggtgtttatgaaagagagctggcaagacatgaaaagagccgtcaggaactggctaacgctgagaaacttttcgatcttcctattacaatgtacccagagctgctgaaagtgcagaaggaaatgagtgggctgaggatgatttacgagctctatgaaggactaaaggttgcaaaagaagaatggtctcagaccctttggatcaacctgaatgtgcagattctccaggaaggaattgaaggttttctcagggctctcagaaagctacctcggccagtccgtggcttatcagtgacctactacttggaagcaaaaatgaaggcattcaaagactcgattcctttacttcttgacttgaaaaacgaggcactaagagacaggcattggaaagaacttatggaaaaaacgtctgtcttttttgaaatgaccgaaacgttcaccttggaaaatatgtttgctatggaactgcacaaacacacagatgttctcaatgagattgtcacagcagcaatcaaggaggttgccattgagaaggctgtgaaggaaatcctagacacgtgggaaaatatgaaattcactgtagtcaagtattgcaaaggcacacaggagcgaggctacatcctgggttctgttgacgaaattattcagtctcttgatgacaacactttcaacctgcagagcatctcaggaagcagatttgtggggccttttctgcaaactgttcacaaatgggaaaaaacgctttctctaataggggaagtcattgagatttggatgttggttcagagaaaatggatgtatcttgaaagtatttttattggtggagatataagatcacaacttccggaagaggcaaaaaagtttgacaacatcgataaagtatttaaaaggatcatgggtgagaccttaaaagaccccgtgatcaagaggtgctgtgaagccccaaaccgcctcagtgacctacagaacgtcagcgagggcctggagaaatgccagaaaagcctcaacgactacttagattcgaagagaaatgctttcccaaggttcttcttcatttctgacgatgagttgcttagcattctggggagcagcgacccactctgcgtccaggagcacatgatcaagatgtacgacaacatagcatcactgaggtttaatgacggcgatagtggagaaaaactggtgtccgcgatgatttcagcagaaggagaagtcatggagtttcggaagatcttgcgggctgaagggcgcgtggaggactggatgacggcagttttgaatgagatgagaagaactaatagactaattaccaaagaggctatttttagatactgtgaagacagaagcagagtcgactggatgctcctgtaccagggcatggtggtgctggccgctagccaggtgtggtggacctgggaggtggaagacgtcttccacaaagcgcaaaaaggggagaagcaggccatgaagaactatggcaggaaaatgcaccggcagatcgatgagttggtaacgcgcatcaccatgccgctaagcaaaaacgacaggaaaaaatacaacactgttctcatcattgatgtgcatgccagagacatagttgattctttcataagaggcagtatcctggaggcccgagagtttgactgggaaagtcagttgcggttttattgggaccgggagccggatgagctgaacatccgccagtgcacgggaacctttggctacggctacgagtacatgggcctgaacggcaggctggtcatcacgcccctcaccgatcggatttacctgacgctcacccaggcgctgtccatgtatctaggtggggcccccgccggcccagcaggaaccggcaaaaccgagaccaccaaggacctggcgaaagccttgggcttgctctgtgttgtcaccaactgtggcgaaggcatggattacagggccgtggggaagattttctctggcctggcacagtgcggggcttggggctgctttgatgagtttaatcgaatcgatgcttctgtgctctccgtgatctcctcccagatccagacgatccgaaatgctctgatccatcagttaaccacgttccagtttgaagggcaggagatttccctggactcccgcatgggcatcttcatcaccatgaaccccggctacgcaggccgcacggagctgcccgagtcggtgaaggcgctgttcaggcctgtggtcgtgatcgtgcccgacctgcagcagatctgtgagatcatgctcttctctgagggcttcctggaggccaagactctggcgaaaaagatgacggttctgtataagctggcccgggagcagctgtccaagcagtatcactatgattttggactcagagccctgaaatcggtgctggtcatggctggtgagctgaagagaggctcctctgaccttagggaggacgtggtgctgatgagggccttgcgagacatgaacttgcccaaatttgtgtttgaagatgttcctcttttccttggtttgatttcggatctgtttcctgggctggactgccctcgcgtccgctaccctgacttcaacgatgcggtagagcaggtcctggaggagaacggctacgcggtcctacccatccaggtggataaagtggttcaaatgttcgagaccatgttaacccgccacacgacgatggtggtggggcccaccagagggggcaagtccgtcgtcattaacactctgtgtcaggcccagaccaagcttgggctgacgacaaagttgtacatcctgaaccccaaagccgtgagtgtcatagaactctacggcatcctggacccaaccacccgagactggacagatggggtgttgtcaaacatcttcagggaaatcaacaagccaacagacaagaaggagcgaaagtatattttatttgatggtgatgtggatgctctatgggtggaaaacatgaattctgtgatggatgacaacaggttgttgacattggccaacggggaacgcatccggctccaagcacactgtgccctgctctttgaggttggagatttacagtatgcctcccctgcaactgtctctcgatgtggaatggtttatgtggatcctaaaaacttgaaatatcgaccatactggaaaaaatgggttaatcaaataccaaacaaggtggagcaatacaatttgaatagtctctttgagaagtatgtgccctatctcatggatgtgatagtggaaggaattgtggatggaagacaagcagaaaagctgaagacaatagttcctcagacagacctcaatatggtaacccagttagccaagatgttggatgcgttgctagaaggagaaatagaagaccttgacctgctggagtgctacttcctggaggctttgtactgctctctgggagcctccctgcttgaggatggaaggatgaaatttgacgaatatatcaaacgccttgcttctttgtctactgttgacacagaaggagtttgggccaaccctggggaactgccaggtcaacttccaaccttgtatgactttcattttgataacaaacggaatcaatgggtcccatggagtaaattagttccagagtatattcatgcccccgagaggaaattcatcaacatcctggttcacacagtggataccactcggactacctggatattggaacaaatggttaaaattaagcaacctgttatttttgttggtgaatctggcacttctaagacagccactacccagaatttcctcaaaaatctgagtgaagaaactaacattgtgttaatggtcaacttctcctcccgcaccacgtccatggatatccaaagaaatttagaagcaaatgtggaaaagcgaaccaaagatacttacggcccacccatgggaaaacgcctgctggtgttcatggatgacatgaatatgccaagggtggatgaatatggcacgcagcagcccattgccttgctgaagctgctgttggaaaaaggctacttatatgaccgtgggaaggagctgaactgtaaaagcattcgagaccttggctttattgctgcaatgggaaaggctggaggaggccgcaatgaagttgacccaagatttatttcgctattcagtgtcttcaatgtgccatttccttcagaggagtctctgcatttaatttattcctccatcctgaaaggccacacctcgacgtttcatgagagcattgtggctgtgagtggcaagctgacattctgcacgctagcactttacaaaaatattgtgcaagacctacctcccactccgtcaaagttccattacatcttcaaccttcgagatctctcacgggtttttaatggtcttgtcctcactaacccggagcgattccagacggtggcccagatggtgagagtctggaggaatgagtgtctgagagtcttccacgaccggctgatcagtgaaacagacaagcagctggtacaacagcacataggcagcttggttgtggaacattttaaagatgacgtggaggtggtgatgagggatcccatattgtttggagacttccagatggctctgcacgaaggagaaccacgcatttatgaagacatccaggactacgaggcggccaaggctctgttccaggaaattcttgaagagtataatgaaagcaacaccaaaatgaacttggttctcttcgacgatgctctggagcatttaacccgggtgcaccgtatcatccgcatggaccgcggccacgccctgctggtcggggtagggggctcagggaagcagtctctttcgaggctggctgccttcacagccagctgtgaggtgtttgagatcctgctgagccgaggctactcggagaacagtttccgggaagacctgaagagcctctatttgaaacttgggattgagaacaaagcgatgatctttctgttcacggatgcccatgtggctgaggagggcttcctggagctcatcaacaacatgctgacctcaggaattgtacctgcgcttttttctgaagaggagaaagagtctatcctgagtcagattggacaggaagctctgaagcaaggcatggggccggccaaggagtctgtgtggcagtacttcgtgaacaaaagtgcaaataacctgcacattgtcctgggcatgtcgccagtgggggacaccctgaggacctggtgcagaaacttcccaggtatggtaaataacactggtattgactggttcatgccctggcctccccaagccctccatgcggtcgcaaagtcctttctagggtataatccaatgatcccggcagaaaatatagaaaatgtggtgaagcatgttgtcttggttcaccaatccgtggaccactacagccaacagtttctacagaaattgaggcgcagcaactatgtcactcccaagaactaccttgattttattaacacctattcaaaattgctggatgagaaaactcagtgtaatatagctcagtgcaagcgtctggatgggggactggacaagctgaaggaggccaccatccagctggacgagctgaaccagaagctggccgagcagaagatcgtgctggcggagaagtccgccgcctgcgaggccttgctggaggagatcgccgtcaacaccgctgtagccgaggagaagaagaaactggcagaggaaaaggccatggagatagaggagcagaacaaagtcattgccatggagaaggccgaggccgagacgaccctggcagaggtcatgcccatcctggaggccgccaagctggaactgcagaagctggacaagtcggacgtgactgagattaggtcgtttgctaagcccccgaagcaggtgcagacggtctgcgaatgcatcctcatcatgaaagggtacaaagagctgaactggaaaacagccaagggcgtgatgtccgacccgaatttcctgcggtctctgatggagattgattttgattcgattacccagagccaagtgaaaaacatcaaaggcctcttgaagactcttaataccacaactgaagaaatggaagctgtcagcaaagccgggctggggatgctgaaatttgttgaagctgtaatgggctactgtgatgttttcagagaaatcaagcccaaaagagagaaggtggccaggctggagcggaatttttacctcactaaacgggaactggaaaggatccagaatgagttggcagcaattcagaaagagctggaaacattgggtgccaaatatgaggccgccatactggaaaagcagaagctgcaggaagaagccgagatcatggagaggcggctgattgccgcagacaaactcatctcgggtctggggtcagaaaacatcaggtggctgaacgacctggatgagctgatgcaccggcgcgtgaagctgctgggggactgcctgctctgcgcggctttcctcagctacgagggagccttcacctgggagttccgtgacgagatggtcaatcggatttggcaaaatgacatcctggagcgggagatccccctgagccagcctttccggctggaaagcctgctcacggatgatgttgagatcagcagatggggatcccagggccttccccccgatgagctctccgttcagaatggcatcctcaccacccgggccagccgcttccctctgtgtatcgacccccagcagcaggccctcaactggatcaagagaaaagaggagaagaacaatctgcgggtcgcttcctttaatgaccctgacttcctcaagcagctagagatgtccataaagtacgggacccctttcctgttccgcgatgttgatgaatacatcgatcctgtgattgacaacgtcttagaaaaaaatataaaagtctcccaaggacggcagtttattatcctgggagacaaggaagtggactatgattcaaatttcagactgtacctgaacaccaagctggccaatcccagatattccccatccgtgtttgggaaagctatggtgatcaattacactgtcacgctgaagggcctggaggaccagctgctgagcgtgctggtggcttacgagaggcgggagctggaggagcagcgggagcacctcatccaggagaccagcgagaacaagaacctgctcaaggacctggaagattccctccttcgggagctggccacgtccacggggaacatgctggacaatgtggacctggtgcacaccctggaggagaccaaatccaaggcaacagaggtctcagagaaactcaagctggcggagaagacagccttggacatcgacaggctgcgggatggctaccggccagcagccaggaggggggccatcctgttcttcgtcctgtctgagatggccctggtgaactccatgtaccagtactccctgattgccttcttagaggtcttcaggctgtcactgaagaagtcgctgcctgattccatcctcatgaaacgcctgaggaacatcatggacacgctgaccttcagcatctataaccacggctgcacagggctgtttgagaggcacaagctactcttttcttttaatatgaccatcaagatagaacaagcagaagggagagtccctcaagaagaactagatttctttttaaaaggaaacatttccctggagaaaagcaaaagaaaaaagccctgcgcttggttgtctgaccaaggatgggaagatatcattcttttatcagaaatgttttcagacaactttgggcaacttcctgatgatgttgagaataatcagactgtctggcaggagtggtatgacctggattcactggagcagtttcccgtccccttgggttacgataacaacatcacccctttccagaagttgcttattttgcgctgtttccgtgtggatcgggtctatcgggccgtgactgactatgtgactgtaacaatgggagagaagtatgtgcagcccccaatgatcagctttgaagctatttttgagcagagcactccacattcgcccattgtgtttatcctgagtcctggctccgaccctgccactgatcttatgaaattagcagagcgaagtggttttggaggaaatcgcctcaaattccttgcaatgggtcaaggtcaagaaaaggtggccctgcagctgctggagacggcggtggctcgggggcagtggctgatgctgcagaactgccacctcctggtcaagtggctgaaagatctggagaagtccctggagaggatcaccaagccccacccagacttccgcctgtggctcaccacggaccccaccaagggcttccccattgggattctgcagaagtccctaaaggttgtcaccgagccacccaatgggctgaaactcaacatgagggcaacttacttcaagatctctcacgaaatgctggaccagtgcccgcaccctgccttcaagccgctggtctacgtgctggcgttctttcatgctgtggtgcaggagagaaggaagtttgggaagattggctggaacgtgtactatgacttcaatgagtctgacttccaggtctgcatggaaattctgaacacgtacttaacgaaagccttccagcaacgggacccaaggatcccgtggggcagcctcaagtacctaattggagaggtcatgtatggaggacgggccatcgacagctttgatcgccgcatcctgaccatctacatggatgagtacctgggggacttcatttttgatactttccagccattccacttcttccggaacaaggaagtggactacaaaatccctgttggtgatgaaaaggagaaatttgttgaagccatcgaggccctcccgcttgccaacacgccagaagtgtttggtctccaccccaacgctgagattggctattacacgcaggcggctcgagacatgtgggctcacctgctggagctgcagcctcagacaggggaatccagcagtggtatcagccgcgatgattatattggccaagtggccaaagaaatagaaaacaagatgcccaaagtctttgacttggaccaggtgaggaagcgcctcggaacaggactctcccccacttcggtggtgctcctgcaggaactggaacgcttcaacaagcttgtggtccggatgacgaagtctctggctgaacttcaaagggccttggctggagaagttggaatgagcaatgagttagatgatgtggccaggtctctttttatcgggcatatccctaatatctggagaaggcttgctcctgacaccttaaagtcccttggaaactggatggtctacttcctgcggcggttcagccagtacatgttgtgggtgaccgagagcgagcccagcgtgatgtggctctcggggctgcacatccctgagtcctacctcacggcgctggtgcaggccacctgccggaagaacggctggccactggaccgctccaccttgttcacacaagtgaccaagttccaggatgcagatgaagtgaatgagcgggcgggacaaggatgctttgtctcaggactgtacctggaaggtgctgactgggatatagaaaaaggatgtcttatcaagagcaaacccaaggtgctggttgtggacctgccgatcctgaagatcatccccattgaagcccatcgcctcaagctgcagaatactttccggacccccgtctacaccacctccatgagaaggaacgccatgggagtcggcttggtttttgaagctgatctctttaccacgaggcacatttctcactgggtgctgcaaggagtatgcctcaccctgaattctgattaacctttgggtgaagaaaactgcttaatgaattcggagcctggggttgtcagagtgatcgggtctgctgtcatttcttggggcctctcaagaggcaggagggggactgacactgatttttcatttgaaatcagccacttaaatctctttccatacaaattaacctgaatggttttgtttttaatactactttttaaaaggaatttatataatcaaaaagtaaatattggagagtattttaagatgtgtggagttttcttttccttctcagagaaaacacttgattaggcaaaagtgcctggcatacatagcattggcacaagtgagaatcctaatgtaatttccaaaggtgtgttttcgatgatccaggtctgtttcagcagatgctcctttttggcaagaagggctgatgatgtcgggcacagagcagaagtgaccagtcacctggagccacttctcccccttccagaactctctggccctagcttctttggctctgacctgctacggcgactgtgaagttgttgagcttagtgtttagttcctgcatgagcttctacccccagcctgcctgggtctgtgtggggtcaggtaaggacacagaacctccaggaccagtggtcactgggcaccccttccctctgtgcaccatgaggctggcctggagccctggctggccacctggaggtgaggggtggcttcactccatgagggaggagaggggctag

SEQ ID NO: 8979 - DNA, 14188 bp, Homo sapiens
ccggcctcgcgttccctcggacggttgcccaatggcagcccaggtggcagcccgggaggcgcgagacttcagagaagccccgacccttcgcctaacctcgggggccggcctggaggcagtgggcgctgtggagctcgaggaggaggaggagaacgaggaggaggcggcggccaggagagcgcggagtttcgcccaagacgcgcgggtgcgcttcctcggcggccgcctggcgatgatgctggggttcacggaggagaaatggagccagtatttggaaagcgaggacaaccggcaggttcttggggagtttctggaaagcaccagcccggcttgccttgtgtttagcttcgccgcctcggggcgccttgcggcttcccaggagattccaagagatgcaaaccataaacttgtttttatttccaagaagattactgaaagcattggagtaaatgacttttctcaagtggttttatttggagagttacctgcgttgtctcttggacatgtatctgctttccttgatgagattttagtgccagttctttctaataagaacaaccataagtcctggtcctgttttacttcacaagatatggaatatcacatagaagtcatgaaaaagaagatgtatatttttaggggcaaaatgtctagaagaactcttctaccaattcccactgttgcaggaaagatggatctggatcagaattgttcagagaacaagccaccgtcaaacgaaaggataatacttcatgcaattgaatctgtggttattgaatggtcacatcaaatccaagaaattatagaaagagattcagtgcagcgtttgttgaatggtcttcacttgtctcctcaagcagaactagatttctggatgatgaggagagaaaatctgtcatgcatttatgatcaacttcaggcacctgttgtcctcaaaatggttaagatcctgacaactaaacaaagcagctattttcctactctgaaggacatttttctggctgtggaaaatgctcttctcgaagcccaagatgtggaactttacctgagacctctgaggagacacatccagtgtctccaggagacggaattcccacagacacgcatattaatcgctccattatttcataccatctgtctgatctggagtcattccaagttttataacaccccagctcgggttatagttttattgcaagagttttgtaatctcttcattaaccaggcaacagcttacctttcacctgaggaccttttgaggggagaaatagaagagtcactggaaaaggtgcaggtggctgttaacatcttaaagactttcaaaaactcctttttcaactatagaaaaaaattggcaagctactttatgggaagaaagctgagaccatgggatttccagtctcatctggtgttttgcagatttgacaagtttcttgatcgtttaataaaaatagaggatatatttgccaccactttggaatttgaaaagctggaaagactggaatttggtggtaccaaaggagcaattttaaatggacaagtccacgagatgagtgaagaacttatggaactctgtaaactttttaaacagagcacttatgacccatctgattgcactaacatggagtttgaaagtgattatgtggcatttaagtccaaaactctggaatttgacagaaggcttgggacaattatttgtgaagctttctttaactgcaatggcttagaagctgcatttaagcttttgaccatatttggaaattttctagagaagccagttgtcatggaaattttcagcctacattacagcacactagtgcatatgtttaatacagagctggatgtgtgtaagcaactgtataatgaacacatgaaacagattgaatgtggtcatgtagttcttaacaagaacatgccatttacctcaggaaatatgaaatgggcccagcaggttctccaacgacttcaaatgttttggtcaaacttcgcatctctccgttatctatttttgggcaatcctgatcacgctttagtttatcaaaagtatgttgaaatgaccactttgcttgatcaatttgaaagtcgtatctataatgaatggaaaagtaatgtggatgaaatctgtgaattcaatttgaatcaacccttggttaaattcagtgccataaatggtcttctctgtgtcaattttgacccaaagctagtggctgtattgagagaagtgaaatatcttttgatgttgaagaaacaagacataccagattcagctttagccatcttcaagaaaaggaacactattttaaagtacattggaaatcttgaccttcttgtgcaagggtataataaactcaaacagacgctcctggaagttgaataccctctgattgaagatgagctgagggctattgacgagcagctgacagcagccacaacgtggctgacatggcaggatgactgctggggctacatcgagagggtgagggcagccacgtccgagttggagcacagagttgagcgcacacagaaaaacgtgaaggtgatccagcagaccatgaggggctgggccaggtgcgtgctacctcccaggagagagcacagacgagaggcagccttcaccttggaggacaagggtgatttgtttacaaaaaaatacaagttaatccaaggagatggctgcaagatccacaacttggtcgaggaaaataggaagctcttcaaagccaatccctctctggatacctggaaaatttatgtagaattcattgacgacattgtggtggaaggcttttttcaggctataatgcacgacttagacttctttctgaagaatacagagaaacaattgaaaccggcaccgttttttcaagcacaaatgatcttgttgcctcctgagattgtgtttaaaccttccctagacagagaggctggggatggcttctatgatcttgtagaagaaatgttatgcaatagttttagaatgtctgcccagatgaaccgaatagcaacacacctggaaattaaaaattatcagaatgatatggataacatgttaggcctggcagaggtcaggcaggagatcatgaacagagtggtgaatgtcatcaacaaagtcttagatttcagaaacaccctggagacccacacttacctctgggtggatgatcgagctgagtttatgaagcattttctcttgtatggccatgctgtgtcttccgatgaaatggatgctcatgcaaatgaagaaattcccgaacaaccaccaactcttgagcaattcaaagaacagattgacatttatgaagctttgtatgttcaaatgagcaaatttgaggactttagagtgtttgatagttggttcaaggtggacatgaagcctttcaaagtgagcttgttaaccataattaagaaatggagctggatgtttcaggagcatcttttgagatttgtcattgacagtctgaatgagctacaagaatttataaaggagacagattccggacttcagagagaattaaatgaaggtgatcatgatggtttagttgacatcatggtgcatcttctggctgtaagaagccgacagagagctactgatgaactctttgaacctctaaaagaaacgatcaccctcttggaaagctatggccagaagatgcctgagcaggtctatattcagctagaggaattacctgaaagatgggaaactaccaaaaagatcgcagcaactgtcagacatgaagtctcacctctccataatgcggaagtcactcttataaggaaaaaatgtattttgtttgacgcaaagcaggcagagttcagagagagattcagacactatgcccctcttggatttaatgcagaaaatccatacacagcgcttgataaggcaaatgaagagcttgaggccttagaagaagaaatgttgcagatgcaagaatctactcgtctttttgaagtggctcttccagagtacaaacaaatgaaacagtgtcgcaaagaaataaaattgctcaagggactgtgggatgtcattatttatgttcgaagaagcattgataattggactaaaacccagtggagacagattcatgtggaacagatggatgtagaactcagaaggtttgccaaggcgagttccataactgaaatttggtcactcaacaaggaagtccgcgtctgggatgcttacacgggcctggaaggcacagttaaggacatgacagcctccctgagggccatcacagagttacagagccctgccctcagggacaggcattggcaccagctgatgaaagctattggggtcaagtttttaataaatgaagccacaactttggcagatttgttagcactgcggttacacagagtggaagatgatgtccgaaggattgtggacaaggcggtgaaagagctggggactgagaaggttattactgaaatcagtcagacctgggcaaccatgaagttttcttacgaagttcactatcgaacaggcattccattactaaagtctgatgaacaactttttgaaactctagagcacaaccaagttcagttgcagactcttcttcaaagcaagtatgtagaatatttcattgagcaagtgttaagctggcaaaataaattaaacatagcagacttggtcatcttcacttggatggaagtccagcgaacttggtctcacctggaaagcatttttgtctgttcagaagatattcgaatccagcttgtgaaagatgctagaagatttgatggggtggatgctgaatttaaggagttaatgttcaagacagccaaagtagaaaatgtgttagaagcaacgtgcagacctaatctctatgaaaaacttaaagatttacagtccaggctttctctttgtgaaaaagctctcgctgaatacctggaaaccaagcgcatagcctttcctcgcttctatttcgtctcttctgctgatttacttgacattctctcaaaaggagctcagcctaaacaggtaacatgtcaccttgccaaacttttcgacagcattgcagatctgcagtttgaagacaatcaggatgtttctgcacacagggcagttggaatgtacagcaaagaaaaggagtatgtcccattccaagccgagtgtgaatgtgtgggccatgtggaaacatggcttctgcaacttgaacagactatgcaagaaacggtgcgtcattctataacagaagccatagtggcctacgaggaaaaacctagggaactgtggatttttgatttcccagctcaggttgcactaaccagctcacaaatatggtggaccacagatgtaggaatagccttcagtagactggaagaaggctacgaaacagccctgaaggatttccataaaaaacagatttctcagctgaatacactgattacacttttgctgggagaacttccacctggagacagacagaagatcatgacaatttgtaccatagatgtccatgccagagacgtggtggcaaaacttatttctcagaagcaagttgttgtcagtccccaagcttttacatggctgtctcaacttcgtcaccgatgggaggatacccagaaacactgctttgttaatatttgtgatgcccagttccagtacttctatgaatacttaggaaacagccctcgactagtgatcactcctctaactgacaggtgttatattaccttaactcaatcacttcatctaaccatgagtggggctcctgctggcccagctggtaccgggaaaacagagaccaccaaagacctaggacgtgcccttggcatgatggtctatgtattcaactgttcagagcaaatggactacaaatccataggcaatatctataagggattggtgcagacaggagcttggggctgctttgatgagttcaaccgaatctctgtggaagttctgtcagtggtggcagtacaagtgaaaatgattcatgatgccatcagaaacaggaagaagagatttgtatttcttggggaagctatcacactgaagccatcagttggaatatttattactatgaacccgggttatgctggtcgaaccgaattaccggaaaatctcaaagctcttttcagaccctgtgccatggtggcccctgacattgagctaatctgtgaaatcttgttagttgctgaaggttttgtggatgcgcgtgcattagcccgaaagttcattacgttgtacacgctttgcaaggagcttctctccaagcaggatcattacgactggggacttcgtgctattaagtctgtcttggttgtggctggatctctgaaacgaggagataaaaatagacccgaagatcaggtactcatgagagcattaagggatttcaatatgcccaaaatagtgactgacgacatcccagtgtttctgggcctggtcggtgacctgtttccagccctggatgtgccccggaggaggaagctgcactttgaacagatggtcaggcagtctaccctggagctccgcctgcagcctgaagagagcttcatcctcaaagttgtccagcttgaggaactgttggctgtgcggcactcggtctttgtagttggaaatgcaggcacaggaaagagtaagattttgagaacactgaaccgaacatatgttaacatgaaacagaagccggtttggaatgacttaaaccctaaagctgtgacaacagatgaactctttggtttcatacatcatgctacccgagaatggaaagatggcaagattgtttactcttattttataggtctcttctcatccattctacgagaacaagcaaatcttaagcatgatggaccaaaatggatagtcctggatggcgatattgaccccatgtggattgaatcactgaatactgtaatggatgataacaaggtgctgaccctcgccagcaatgagcgcattgcactcactcccttcatgaggcttctgtttgagatacatcacttaaggagcgcaaccccggccactgtttccagagctggtattctgtatgtgaacccacaagatctgggctggaatccgtatgtggccagttggatagacagaaggcggcatcaatcagaaaaggccaatttgactattctttttgataaatatgtccctgcatgcttggataaactgagaacaagctttaaaaccatcacttcaattcctgagagtagcctggtgcagactctatgtgttcttttggagtgcttgctgactcctgaaaatgtaccttctgacagcccaaaagaagtttatgaagtctattttgtatttgcttgtatctgggcttttggaggcaccctgctacaagatcagatttctgattatcaagctgacttcagtcggtggtggcagaaagagatgaaagcagtgaaatttccgtcgcagggaacaatctttgattattatgtggaccacaaaactaagaaattattgccctgggctgacaaaattgcccagtttactatggatccagatgtgcctctgcagacagttctcgttcacacaacagagacagctcgtcttagatatttcatggagttgttgcttgagaaaggaaaacctctaatgctagtaggaaatgcaggagtgggaaaaacagtctttgtaggtgacacattggcaagtctctctgaggattacatagtatcccgtgtgcctttcaactactacacgacatccacagctctgcaaaaaattcttgagaaacccctagagaaaaaagctggtcataactatggtcctggaggaaataaaaaattgatttattttatcgacgacatgaacatgcctgaagtggacttatatggcaccgttcagcctcacaccctgatccggcagcatattgattatggacattggtatgatagacagaaggtgatgcttaaagaaatccataactgccagtatgtcgcctgcatgaatccgatggtgggcagcttcaccatcaatcccaggctacagagacatttcacagtgtttgcattcaattttccatctttggatgcactaaacaccatctatggccaaatctttagcttccatttccaacagcaagcatttgctccatcaattctcaggagtggccccactttgatccaggcaacaatagcattccatcagacaatgatgtgtaactttttacccacggctattaaattccactacatctttaatctgagagatttatcaaacgtcttccaggggattttatttgcttctcctgagtgtttaaaaggtccacttgatttaatacatctgtggcttcatgaatctgcccgtgtttatggagacaaactgatagacaaaaaagattgtgatttgtttcagagaagaatgctggaaactgcttataaatattttgaaggtatagatagtcacatgctgcttcaacagcccctcatttattgccactttgctgatagagggaaggacccacattacatgccagtgaaggactgggaagtgctgaagacgattcttacagaaacgttagacaactacaatgaactaaatgctgccatgcacctagttttgtttgaagatgccatgcaacatgtgtgtcgcatcagccggatcttacgaacccctcagggctgtgctctcttggttggagttgggggcagtggcaagcagagcttgtccaggctggcagcttaccttcgtggccttgaggtctttcagatcactctgaccgagggctatggaatccaggaacttcgggtagatcttgccaatttgtacatccgaactggagccaagaacatgcccactgtgttcctgctgacagatgcccaggttctagatgagagcttcctcgtgctgattaatgacttgctggcatcaggagaaatcccagatctgttcagcgatgaagatgtggacaagataatttctggaattcataatgaagttcatgctctgggcatggtagactccagggaaaactgttggaaattctttatggccagggtgcgactacagctcaaaatcattttgtgtttctctccagttggtcgcacgctgagagttagagctcggaagttcccagccatagttaactgcacggctattgactggtttcatgcgtggccgcaggaggctctggtctccgtcagcaggaggttcattgaggaaaccaagggaattgagccagtgcacaaagactctattagccttttcatggcacatgttcacaccactgtaaatgaaatgagtaccagatattaccagaatgagagaagacacaactataccaccccaaagagttttctagaacaaatatcactgtttaagaacctgttgaagaagaagcaaaatgaggtatccgagaaaaaagaacgcctggtgaacggcatccaaaagctaaaaaccacagcctctcaggtgggagatctaaaagccagacttgcctctcaagaagccgagctgcaactgagaaatcatgatgccgaagctctgatcacaaagatcggccttcagacggagaaagtgagccgggaaaagaccatcgctgatgctgaggagcgaaaggtgacagccattcagactgaagtgttccagaaacagagagaatgtgaagctgacttactcaaggctgagcctgcactggtggctgctacagctgcactcaatacactcaacagggtcaacctcagtgagctgaaagcctttcccaaccctcccatcgcagttaccaatgttactgcagccgtgatggtccttctggctcctcggggaagagtgcccaaagaccgaagttggaaagcagctaaagtcttcatgggaaaggttgatgattttttgcaagcattaattaactatgacaaagagcacattccagagaactgtctaaaagtggtgaatgaacactatttgaaagacccagagtttaatccaaacctgattcgaaccaaatcttttgcagcagctggcctgtgtgcctgggtcatcaacatcattaaattctatgaggtctactgtgatgtggagccaaaacgccaagcattagcccaagcaaacttagaactggctgcagctactgaaaaactagaggctatcaggaaaaagcttgtggatctggatcgaaatctgagcagactcacggcttcatttgaaaaagcaacagctgagaaagtccggtgtcaagaagaggtgaaccaaaccaacaaaaccatcaaattagctaacagacttgtcaaggaacttgaggcaaagaagattcgctggggtcaatccattaagtcctttgaagctcaagagaagacactctgtggagatgttcttctcacggcggcatttgtgtcttacgtcggacccttcacaaggcagtatcgccaggagctggtgcactgcaagtgggttccctttcttcaacagaaggtttccattccactaaccgaaggcctggacttgatatccatgttgacggatgatgctacaattgccgcctggaataacgaaggactgcccagtgacagaatgtccaccgaaaatgccgctatcctaacacactgtgagcgctggcctctggtgatagatccccagcaacagggaattaagtggatcaagaataagtatggaatggacctgaaagtcacacatttgggccagaaagggtttttgaatgccattgaaactgctttggcctttggtgatgtcatcttaattgaaaatctcgaggaaacgatagatccagtcctggatccactacttggcaggaacacaattaaaaaaggaaagtatatcaggattggagataaagaatgtgaatttaacaagaactttcgccttatccttcacacaaaattggcaaatcctcactataagccggaattacaagctcagacaactctcctcaatttcacagtcacagaagatggtctagaagcccagctgctggcagaggttgtcagtattgaaaggccagatttggagaaacttaagttggtattgacaaagcaccaaaatgattttaaaattgagctcaagtatctggaagacgatctccttttgcgcctttctgcggcagagggaagctttctggatgacaccaaactggtagagagattggaggcaacaaagaccaccgtggcagagatagagcacaaggtgattgaagccaaagaaaatgaaagaaaaatcaacgaggcccgagaatgttacagaccagtggcagcaagagcatctcttctttattttgttattaatgacctccaaaaaatcaaccccctctaccaattctctttgaaggcttttaacgtgctgttccacagagcgatcgagcaggctgacaaggtggaagacatgcagggacgcatctctatcctgatggagagcatcacccatgctgtcttcctctacaccagccaggcgctgtttgagaaggacaagctcaccttcctgtcccagatggcttttcagattttgttgagaaagaaagagatagaccctcttgaattggatttcctgcttcgattcacagttgaacacactcatctgagtcccgttgacttcctaacttctcagtcatggagtgctatcaaggcaattgccgtcatggaagaatttcgaggcatagaccgagatgtggaaggatctgccaagcagtggaggaagtgggtagaatccgagtgtccagaaaaagaaaaattacctcaagaatggaagaagaaaagtttaatacagaagctgattcttctgagagcaatgcgccctgacagaatgacgtatgctctcagaaattttgtagaggaaaaactgggtgcgaagtatgtggagaggaccagattggacttagttaaagcattcgaagaaagcagcccagccacccccatattcttcatcctgtctccgggggtagatgcccttaaagacctggagattcttggcaaaagacttggctttacaattgactctggaaaattccacaatgtgtctttaggacaaggtcaggagacggtggcagaagtggccctggagaaagcttccaaaggaggacactgggtcatcctccaaaatgttcatttggtagccaagtggctaggaaccttggagaagctccttgaaagattcagccaaggaagccacagagattacagggttttcatgagtgctgagtctgcacctacaccagatgagcatatcatccctcaaggactcctggaaaattccattaagatcactaatgaacccccaacagggatgctggccaatttgcatgccgccctgtacaactttgatcaggatacacttgaaatatgctccaaggagcaggagtttaaaagcatccttttttctctctgctacttccacgcctgtgttgctgggagactgaggtttggcccccagggctggagccgaagctatccttttaatcctggagacctcaccatttgtgccagtgtcctctacaactacttagaggcaaactctaaagtcccatgggaagatctccgttatctctttggtgagatcatgtatggaggccacatcacagatgactgggatcgcaaactgtgtcgggtgtatttagaagaattcatgaatccatctctgactgaagatgaactgatgctggcaccaggttttgctgccccaccctacctagattatgcaggctaccaccagtacatagaggagatgcttcctccagaaagcccggcactgtatggcctccacccaaatgctgaaatagaattcctgacagtgacatccaacactctcttcagaactttgctggagatgcagcccaggaatgcactcagtggtgatgaactggggcagtctacagaagaaaaggttaagaatgtcttggatgacattttggagaaacttccagaagagttcaacatggcagagataatgcaaaaaaattcaaatagaagcccatatgttcttgtttgcttccaagaatgtgagaggatgaatattctcattcgggaaatacgtatatcacttgaacaactggaccttagtttgaagggggaattggcattatctcctgctgtggaagcccagcagtttgcattgagttatgacacggtaccagacacttggagcaaactggcttatccttctacttatggcctagcccagtggttcaatgacctcctcctgcgatgccgagaactcgatacttggacacaagaccttacccttccggctgtcgtgtggctctccggcttcttcaaccctcagtccttcttaactgcaatcatgcagacgatggctcgaaaaaatgagtggcccctggataaaacgcgcttgactgctgatgttaccaaaaaaacaaaggaagattatggacacccgccaagggaaggtgcatacctccacggactcttcatggagggcgcccgctgggacacccaagcaggaaccattgttgaagcccgtctcaaggagctggcatgccctatgccggtcatctttgcaaaagccacccccgtggacagacaagaaaccaaacagacctacgagtgccctgtgtatagaaccaaactgagaggccccagctacatctggaccttcaggctgaagagcgaagagaagactgcaaaatgggttctggctggagtggctctgcttctagaagcgtaaggtaacactggcattcctctagcctctgctggagtgcagtgaggattttctagcatgttgctgcactgttcccatgcacattattctaactttttagtaactcacacgtgcattcttttttcaacgctatccttagagtgaaagtcagaaaaaaatactagaaactaactcagggctgagcgtggtggcacacgactgtaatcccagttactcaggaggtaggagaatcacttgaacctaggaggcaaaggttgcagtgagccgaggttgcaccactgcactccctcctgggcaacagaacaagactccatctcaaaaaaaaaaaagtacatcataaaagtacatcatatgtgaacatgcaaaagcaatgcagccggaaagaacggagattttaatttttaacaaacaacaaattaaattattagcccttaaactctttcaaaatataaaagcagcaggccccaggtgagtcctgaaggaagaggctagcactctgtaaggcctccagtgtccagtgtctacaatgttgatggtccccttttgttcagtcaagttttaataaaaataaaactgttctacagttaa

SEQ ID NO: 8980 - DNA, 2048 bp, Homo sapiens
cttctccagctactcgtttgagagccggtggcgttccggaggtttctccctcgttatccccctgcctttcacctgaggagaggctctgactgtctctctctctctctggcgtctgcgcagcggggaagtagtgagaaacaatcagagtacagagtattttaatctttaggggatcaagatgtcagatgcaaacaaagctgccattgcagcagaaaaggaagctctgaacttgaagttaccccccattgtccatctcccagaaaacataggcgttgatacaccaacacaaagtaagctgctaaaatacagaagatccaaggagcagcagcagaaaattaatcagttagtaattgatggagccaaaagaaatttagacagaacactgggtaaaagaacacctctattaccaccacctgattatcctcaaactatgaccagtgaaatgaaaaaaaaaggattcaactatatttatatgaagcaatgtgtagaaagtagtcctttagtacctattcagcaggaatggctggatcacatgttaaggctgatacctgagtctttaaaggaagggaaagaaagagaagaacttcttgaaagtctcataaatgaggtgtcaagtgactttgaaaacagcatgaagagatatttggtgcagagcgttcttgtgaaaccaccagttaaatcgcttgaagatgaaggaggtcctttacctgaatctcctgtaggcctagattattctaatccttggcattctagctatgtgcaggcaagaaatcaaatattctctaatttgcacattattcatccaactatgaaaatgttactggaccttggttatacaacatttgctgatacagttttgttggacttcacaggaattagagctaaaggtccaattgactgtgaatcactgaaaactgatctatcaatacaaactagaaacgcagaagagaagataatgaatacatggtatccaaaggttataaatctctttaccaagaaggaggcactagaaggtgttaaacctgaaaaattggatgcattttatagctgtgtttccacacttatgtcaaatcagctaaaggatctattaaggagaactgtagaaggatttgtaaaactctttgacccaaaagatcaacaaaggctgccaatatttaagatagaattgacatttgatgacgacaaaatggaattttatcctacctttcaagatttggaagataatgtcttgagtttggtggaacgaatagccgaagctctgcagaatgtccaaacaatcccctcttggctatcaggaacttcaacaccagtaaatcttgacacagaacttcctgaacacgtgttacactgggctgttgatacactgaaggcagcagtacatcggaacttagaaggtgcaagaaagcattatgagacatatgttgaaaaatataattggctccttgatgggactgcagttgagaatatagagacttttcagacagaagatcatacttttgatgaatatacagaggagctggattgctgggtggtatgggaagtgtatttttaactttttaagaaactgttaagccaggcatagtagcttgcacctgtagtctcagctactcaggaggctgaggtgaaaggattactggagcctaggagttcgagtctgcagtgagttatgatcatgccactgcactccaacttgagtgacagagcaaaactctttgtctcaaaaaacagaagaaacttaaatttctttcaaagttgttataccatttacaatctcaccagcagtgtatgagatttccagttcttccacatccttttcaacctttgggcttatcagtcttttactttttactattgttttattttttcccactgcactttcacatctagattatcagtctttttaatttcatgtgtatattggtatcccactgtggttttaatttgcatttccctgatgactaatgatgtttagcatcttttaacatgtcatgttccatctgtgtatctttttactaataaaaataaagtgtcttttgtttgtacatttt

SEQ ID NO: 8981 - DNA, 2255 bp, Homo sapiens
tttaactttagtaacaaatccaagattttggaaaagcgcctacgatatttaaatgaccacttcacatacaacttatattgtaatatatgccgatcactatttgagaaggacaagctgttattttcctttttattatgtgccaatcttcttctggcaaggaaagagattgaataccaggaactgatgtttcttttaactggaggagtaagtcttaaaagtgctgagaaaaatcctgatccaacttggctacaggacaaaagctgggaggaaatctgtcgggcaagtgaatttcctgccttcagaggactcaggcaacatttttgtgaacatatatatgaatggcgagaaatctatgacagtaaagagccacataatgctaaatttccagcaccaatggataagaacctaaatgaactacagaaaataataattcttcggtgtttaagacctgataagataaccccagctataacaaactatgtaactgacaaactagggaaaaagtttgtagagcctccaccatttgatttgacaaagagttacttggattcaaattgcaccattcccttaatttttgttctatctccaggagcagatcctatggccagcctgctgaaatttgcaaatgataaatctatgtctggaaataagtttcaagctatttcactgggacagggacaaggaccgattgcagcaaaaatgattaaagcagcaattgaagaaggaacttgggtgtgcctacagaattgccatcttgcagtgtcctggatgcccatgttggaaaaaatatgtgaagattttacctctgaaacctgtaactcatcctttaggctttggctgacaagctatccatcttcaaaattcccagtaacaattctacagaatggagtaaaaatgactaatgaacctcccacgggtcttcggctgaatctccttcaatcatatctcactgatccagtttctgatcctgagtttttcaagggatgccgtggaaaggaactgttatttatcaatgaatatgatacaattccatttgaagctatatcttacctgactggggagtgtaattatggaggaagagtgacagacgattgggacagacgtcttctattaaccatgctggctgacttttataatctgtacatagttgaaaaccctcattataagttttctcccagtggaaactattttgcacctcctaaaggcacttatgaggactacattgaattcattaagaaacttccatttactcaacaccctgagatatttggattacatgaaaacgttgacatctccaaggatcttcaacaaacaaaaaccctctttgagtccttgctcctcacccagggaggctccaaacagacaggagcctcaggaagtactgatcagattctgttagaaattaccaaagatatcctcaacaagctccctagtgatttcgacattgaaatggcactacggaagtatcctgtgagatatgaagaaagcatgaatactgtgttagtacaagaaatggaaagatttaacaatttaattataactatacgtaacactctacgggaccttgaaaaagctattaagggtgtggttgtgatggattctgcattggaggcactctccggtagcttacttgttggaaaggttccagaaatatgggccaaacgttcatacccaagccttaagcccctgggaagttacatcacagatttcctagcccggttgaactttttacaggactggtataattcaggaaaaccttgtgtgttttggctgtcaggtttctttttcactcaggcctttttaactggagctatgcagaattatgccagaaaatataccacccctattgatttgctaggatatgaatttgaggttatcccatctgatacatctgacacatcaccagaagatggtgtttatatccacggactgtatctcgatggcgcacgctgggaccgagaaagtggattgcttgctgaacaatatcccaaacttctgtttgacctgatgcccatcatatggataaaaccaactcaaaaatctcggattataaagtcggatgcctatgtctgtcccctctacaagacaagtgaacgtaaaggaactctttccactacgggacattctactaactttgtcattgcaatgttgttaaaaacagaccaacctactcggcactggatcaagcgcggggttgctttgctttgtcagttggatgactaaattggacaaatttataaaacatccaaaagttt

SEQ ID NO: 8982 - DNA, 9542 bp, Homo sapiens
gcccttctccagctactcgtttgagagccggtggcgttccggaggtttctccctcgttatccccctgcctttcacctgaggagaggctctgactgtctctctctctctctggcgtctgcgcagcggggaagtagtgagaaacaatcagagtacagagtattttaatctttaggggatcaagatgtcagatgcaaacaaagctgccattgcagcagaaaaggaagctctgaacttgaagttaccccccattgtccatctcccagaaaacataggcgttgatacaccaacacaaagtaagctgctaaaatacagaagatccaaggagcagcagcagaaaattaatcagttagtaattgatggagccaaaagaaatttagacagaacactgggtaaaagaacacctctattaccaccacctgattatcctcaaactatgaccagtgaaatgaaaaaaaaaggattcaactatatttatatgaagcaatgtgtagaaagtagtcctttagtacctattcagcaggaatggctggatcacatgttaaggctgatacctgagtctttaaaggaagggaaagaaagagaagaacttcttgaaagtctcataaatgaggtgtcaagtgactttgaaaacagcatgaagagatatttggtgcagagcgttcttgtgaaaccaccagttaaatcgcttgaagatgaaggaggtcctttacctgaatctcctgtaggcctagattattctaatccttggcattctagctatgtgcaggcaagaaatcaaatattctctaatttgcacattattcatccaactatgaaaatgttactggaccttggttatacaacatttgctgatacagttttgttggacttcacaggaattagagctaaaggtccaattgactgtgaatcactgaaaactgatctatcaatacaaactagaaacgcagaagagaagataatgaatacatggtatccaaaggttataaatctctttaccaagaaggaggcactagaaggtgttaaacctgaaaaattggatgcattttatagctgtgtttccacacttatgtcaaatcagctaaaggatctattaaggagaactgtagaaggatttgtaaaactctttgacccaaaagatcaacaaaggctgccaatatttaagatagaattgacatttgatgacgacaaaatggaattttatcctacctttcaagatttggaagataatgtcttgagtttggtggaacgaatagccgaagctctgcagaatgtccaaacaatcccctcttggctatcaggaacttcaacaccagtaaatcttgacacagaacttcctgaacacgtgttacactgggctgttgatacactgaaggcagcagtacatcggaacttagaaggtgcaagaaagcattatgagacatatgttgaaaaatataattggctccttgatgggactgcagttgagaatatagagacttttcagacagaagatcatacttttgatgaatatacagagtttatagaaaaatttctcagtcttgcctcagaaataatgcttttgcctcagtggattcattacactatggtgcgtttggattgtgaagatttgaagacaggcctgacaaataaagcaaaagcctttgcaaacatattattaaatgacatagcttcaaaatatagaaaagaaaatgaatgtatttgcagtgaatttgaagcaattaaagaacatgcattaaaagtccctgaaacaacagaagagatgatggatctgatatcttatgtagaaaaagcccggactgtaggaatcgaagagttgattttaaggatccaggaatctaaacgccaaatgagttactttttagatgttttcctatttcctcaagaagacttagctttaaatgcaactgtcctcatgtggcctaggaaaattaatcccatctttgatgaaaatgatgagctaattgagaatgctaaacataaaaaagaaaatgaactaatggccaagagagagaaacttattttggaaatagaaaaagaatcacgccgcatggaggagtttacagaatttgcagagctggagcgcatgcaacagtatgtgacagatgtaagacaactacaaaaacgtattcaggaatctgaagaagcagtgcagtttattaataaagaagaggaacttttcaagtgggaattgacaaaatatcctgaactggataaattaaaagttaacattgagccctatcagaagttttttaattttgttttgaagtggcagcgatcagaaaaacggtggatggatggagggtttttggacctcaatggggaaagcatggaggctgatgtggaagagttttcccgagaaatttttaagacactaaaatttttccaaacgaagctaaagaaagaattacaagaaaaaagaaaggcagcaagaaaacggtctttggaagaagagaaaattgaagaagaaccaaaagacaatgctactattactatgtgcagaatgagagctcgtcactggaaacagatatcagaaattgtaggctatgacttgactccagactctggaactacactgagaaaagttttaaaattaaaccttaccccatacttggaacaatttgaagtgataagtgcaggtgcaagcaaggaattttcattagagaaagccatgaatacaatgataggaacttgggaagatattgcttttcatataagtctgtatcgtgacactggagtctgtattctttcttcggtggatgagattcaggccatccttgatgatcaaattataaaaactcagacaatgagaggctcacctttcatcaaaccatttgaacatgagatcaaggcctgggaggaccgcttgattcgaatacaagaaacaattgatgaatggttaaaagtacaagctcaatggctgtacttagagcccatcttttgttctgaggatatcatgcaacagatgccagaagaagggcgtcaatttcagacagtagacagacactggagagatatcatgaagttttgtgctaaagatccaaaggttcttgctgccacttctttaacaggtttattggaaaaactacagaactgcaatgaacttttggagaaaattatgaaaggtcttaacgcatatcttgaaaagaaacgtcttttcttccctcgttttttcttcttatctaatgatgaaatgttagagattttatcagagaccaaagatccacttagagttcagccacatttaaaaaaatgctttgagggcattgctaaattagagttccttcccaatttggacattaaagccatgtatagctctgagggcgagcgagtggagctgattgcactcatttccacgtctgcagcgcggggtgctgtggaaaagtggctcattcaagtggaagacctaatgctccggagtgttcacgatgtgatcgctgcagccaggctggcttatccagaatctgcaagaagagactgggttcgagagtggcctggccaagttgtactttgtatttctcaaatgttctggacatctgagacacaggaagtgataagtggcgggacggagggattaaagaagtattataaggaacttcagaaccaactgaatgagattgtagagctggtaagaggaaagttgtctaagcagaccaggaccactctgggggctttggttactattgatgtccatgctagagatgtggtcatggacatgattaaaatgggtgtctcacatgatacagatttcctgtggcttgctcagctccgatattattgggaaaatgagaatgcccgagttcgtatcattaattgcaatgtaaaatatgcttatgaatatcttggtaactcacctcgacttgtcattacgcctctaactgacaggtgttacagaacattgataggtgctttctatttaaaccttggaggtgctccagaggggccagcaggcacaggaaaaaccgaaaccaccaaggacttggctaaagctcttgctgtacagtgtgtggtgttcaactgttctgatgggctagattatctagcaatgggaaagttttttaaaggactggcttcttctggtgcttgggcttgctttgatgaattcaatcgaattgagttggaagtgttgtcagtggtagctcaacagatcctttgcattcagagagctattcaacagaagttggttgtgtttgtttttgaagggacagaacttaagctcaatccgaattgttttgtagctattaccatgaatcctggctatgcaggacgctctgaattgccggacaatcttaaggttctttttagaacagtggctatgatggttccaaactatgcgcttatagcagaaatctccctctactcttacggatttttgaatgcaagacctctgtctgtgaaaatagtaatgacctataggctttgctcagagcagctctcatcgcaatttcattacgactatggaatgcgagcagtaaaagccgttttagtggctgctggcaatctaaaactaaaatacccaaatgaaaatgaagatatacttcttcttcgatcaattaaagatgtaaatgaaccaaagtttttatcacatgatatacctttatttaatggaataactagtgacttatttcctggtattaaacttcctgaagctgactatcacgaatttttggaatgtgctcatgaagcctgcaatgtacataatcttcagcctgttaaattttttcttgaaaaaataattcaaacatatgaaatgatgattgttagacatggttttatgttagtaggagagccttttgctgctaagacaaaagttctgcatgtgctggcggatacgctaactttaatgaatgaacatggctatggagaggaagaaaaggtcatttatagaactgtaaaccccaaatctattactatgggccaactttttggacagtttgacccagtgtctcatgagtggactgatggtattgtggctaacacttttagagaatttgccttatcagaaacacctgaccggaaatgggttgtatttgatggtcctattgacactttgtggatagagagcatgaacacagtattggatgataataaaaagctttgccttatgagtggagaaatcattcagatgtccccccaaatgagcctcatctttgaaacaatggacctttcccaggcatcccctgccactgtaagtcgttgtggtatgatttatttggagccttcacagttaggatgggaaccacttgtgtcttcttggttgaattcactgaaaggacctctgtgtgaaccagaatatcaagctcttctgagaggactttttgcctggttaataccaccctctttaaaccagcgggttgaattattccagctaaactatttgtatacaaccatagtgtctaaaattttaaaaattctaattactttccgtatttcaaattattttaaatatgtgcctctaaaaactcaatgtacatttattaaattttttctccaccaacaggcttgctttatattctctttgatttggtcgattggaggaagttgtgatacagatggccgtcgtgtttttgatactttcatacgattaatcatactgggaaaagatgatgaaaacccagtgccagattctgtgggtaaatgggaatgcccatttgatgaaaaaggcctggtctatgactacatgtatgagttgaaaaacaaaggtcgctgggtccattggaatgaattaattaaaaatactaatttaggagataaacaaatcaagattcaagatatcatagtccctacgatggacacaattagatatacgtttctaatggatttgagtattacctatgcaaagccactcctttttgtgggtccaacgggtacaggaaaatctgtgtatgtgaaggataagctaatgaatcacttggaaaaggaccagtactttcctttttatattaacttatctgcacggaccagcgccaatcaggttcagaacattatcatggctagattggataaaagacgcaaaggagtctttggaccacctatgggaaagaagtgtataatttttatagatgatatgaatatgcctgcattggagaagtatggagctcaaccacctattgaattattacgacagttttttgactgtggacattggtacgaccttaaggacacaagtaaaatcacgctggtggacatagagctgattgctgcaatgggccctccaggtggtggaagaaatccagttactccccgttgtattcgacatttcaacatctgcagtattaattcttttagtgatgaaactatggtccgaatcttctcatctattgtagcattctaccttagaactcatgaatttcctccagagtactttgtaattgggaaccagatagtcaatgggactatggagatatataaacaatctgtggaaaatcttttacccactcccacaaaatcccattatactttcaacttgcgtgatttttcacgcgtcatccggggctgtttactcattgaaagagacgccgtggcgaacaaacacactatgatccgtctgtttgtgcatgaggttctccgagtgttttatgatcgcctcattaatgatgatgatcgaagatggctgttccagttaactaaaactgttataaaggaccattttaaagaatcatttcacagtatcttttcacatttgaggaaacaaaatgcaccagtaactgaagaagacttaagaaatctcatgtttggtgattatatgaatcctgaccttgaaggagatgatagagtttatattgaaattccaaatattcatcattttagtgatgttgtggaccagtgcttagatgagtataatcaaacacacaaaacaagaatgaatcttgtcatttttaggtatgttttggaacatttatcaagaatatgtcgagttctaaagcaatctggtggaaatgctttgcttgttggtcttggaggaagtggtcgtcaatctttaactcgtctggctacatccatggcaaaaatgcatattttccaaccagaaatttctaagagctatggtatgaatgaatggagagaggatatgaagagctttattgctgtcccggtgaccaacaggatagtggataacaaatccaagattttggaaaagcgcctacgatatttaaatgaccacttcacatacaacttatattgtaatatatgccgatcactatttgagaaggacaagctgttattttcctttttattatgtgccaatcttcttctggcaaggaaagagattgaataccaggaactgatgtttcttttaactggaggagtaagtcttaaaagtgctgagaaaaatcctgatccaacttggctacaggacaaaagctgggaggaaatctgtcgggcaagtgaatttcctgccttcagaggactcaggcaacatttttgtgaacatatatatgaatggcgagaaatctatgacagtaaagagccacataatgctaaatttccagcaccaatggataagaacctaaatgaactacagaaaataataattcttcggtgtttaagacctgataagataaccccagctataacaaactatgtaactgacaaactagggaaaaagtttgtagagcctccaccatttgatttgacaaagagttacttggattcaaattgcaccattcccttaatttttgttctatctccaggagcagatcctatggccagcctgctgaaatttgcaaatgataaatctatgtctggaaataagtttcaagctatttcactgggacagggacaaggaccgattgcagcaaaaatgattaaagcagcaattgaagaaggaacttgggtgtgcctacagaattgccatcttgcagtgtcctggatgcccatgttggaaaaaatatgtgaagattttacctctgaaacctgtaactcatcctttaggctttggctgacaagctatccatcttcaaaattcccagtaacaattctacagaatggagtaaaaatgactaatgaacctcccacgggtcttcggctgaatctccttcaatcatatctcactgatccagtttctgatcctgagtttttcaagggatgccgtggaaaggaactggcctgggagaagttactgtttggagtttgtttttttcatgcccttgtgcaagagagaaagaaatttggtcctcttggttggaatattccatatggatttaatgaatctgacttgcgcatcagtatccgacaactgcagttatttatcaatgaatatgatacaattccatttgaagctatatcttacctgactggggagtgtaattatggaggaagagtgacagacgattgggacagacgtcttctattaaccatgctggctgacttttataatctgtacatagttgaaaaccctcattataagttttctcccagtggaaactattttgcacctcctaaaggcacttatgaggactacattgaattcattaagaaacttccatttactcaacaccctgagatatttggattacatgaaaacgttgacatctccaaggatcttcaacaaacaaaaaccctctttgagtccttgctcctcacccagggaggctccaaacagacaggagcctcaggaagtactgatcagattctgttagaaattaccaaagatatcctcaacaagctccctagtgatttcgacattgaaatggcactacggaagtatcctgtgagatatgaagaaagcatgaatactgtgttagtacaagaaatggaaagatttaacaatttaattataactatacgtaacactctacgggaccttgaaaaagctattaagggtgtggttgtgatggattctgcattggaggcactctccggtagcttacttgttggaaaggttccagaaatatgggccaaacgttcatacccaagccttaagcccctgggaagttacatcacagatttcctagcccggttgaactttttacaggactggtataattcaggaaaaccttgtgtgttttggctgtcaggtttctttttcactcaggcctttttaactggagctatgcagaattatgccagaaaatataccacccctattgatttgctaggatatgaatttgaggttatcccatctgatacatctgacacatcaccagaagatggtgtttatatccacggactgtatctcgatggcgcacgctgggaccgagaaagtggattgcttgctgaacaatatcccaaacttctgtttgacctgatgcccatcatatggataaaaccaactcaaaaatctcggattataaagtcggatgcctatgtctgtcccctctacaagacaagtgaacgtaaaggaactctttccactacgggacattctactaactttgtcattgcaatgttgttaaaaacagaccaacctactcggcactggatcaagcgcggggttgctttgctttgtcagttggatgactaaattggacaaatttataaaacatccaaaagtttaaaaaaaaaaaaacctgtcctacttaaaatatatacattataaaaccaag

SEQ ID NO: 8983 - DNA, 2613 bp, Homo sapiens
gcccttctccagctactcgtttgagagccggtggcgttccggaggtttctccctcgttatccccctgcctttcacctgaggagaggctctgactgtctctctctctctctggcgtctgcgcagcggggaagtagtgagaaacaatcagagtacagagtattttaatctttaggggatcaagatgtcagatgcaaacaaagctgccattgcagcagaaaaggaagctctgaacttgaagttaccccccattgtccatctcccagaaaacataggcgttgatacaccaacacaaagtaagctgctaaaatacagaagatccaaggagcagcagcagaaaattaatcagttagtaattgatggagccaaaagaaatttagacagaacactgggtaaaagaacacctctattaccaccacctgattatcctcaaactatgaccagtgaaatgaaaaaaaaaggattcaactatatttatatgaagcaatgtgtagaaagtagtcctttagtacctattcagcaggaatggctggatcacatgttaaggctgatacctgagtctttaaaggaagggaaagaaagagaagaacttcttgaaagtctcataaatgaggtgtcaagtgactttgaaaacagcatgaagagatatttggtgcagagcgttcttgtgaaaccaccagttaaatcgcttgaagatgaaggaggtcctttacctgaatctcctgtaggcctagattattctaatccttggcattctagctatgtgcaggcaagaaatcaaatattctctaatttgcacattattcatccaactatgaaaatgttactggaccttggttatacaacatttgctgatacagttttgttggacttcacaggaattagagctaaaggtccaattgactgtgaatcactgaaaactgatctatcaatacaaactagaaacgcagaagagaagataatgaatacatggtatccaaaggttataaatctctttaccaagaaggaggcactagaaggtgttaaacctgaaaaattggatgcattttatagctgtgtttccacacttatgtcaaatcagctaaaggatctattaaggagaactgtagaaggatttgtaaaactctttgacccaaaagatcaacaaaggctgccaatatttaagatagaattgacatttgatgacgacaaaatggaattttatcctacctttcaagatttggaagataatgtcttgagtttggtggaacgaatagccgaagctctgcagaatgtccaaacaatcccctcttggctatcaggaacttcaacaccagtaaatcttgacacagaacttcctgaacacgtgttacactgggctgttgatacactgaaggcagcagtacatcggaacttagaaggtgcaagaaagcattatgagacatatgttgaaaaatataattggctccttgatgggactgcagttgagaatatagagacttttcagacagaagatcatacttttgatgaatatacagagtttatagaaaaatttctcagtcttgcctcagaaataatgcttttgcctcagtggattcattacactatggtgcgtttggattgtgaagatttgaagacaggcctgacaaataaagcaaaagcctttgcaaacatattattaaatgacatagcttcaaaatatagaaaagaaaatgaatgtatttgcagtgaatttgaagcaattaaagaacatgcattaaaagtccctgaaacaacagaagagatgatggatctgatatcttatgtagaaaaagcccggactgtaggaatcgaagagttgattttaaggatccaggaatctaaacgccaaatgagttactttttagatgttttcctatttcctcaagaagacttagctttaaatgcaactgtcctcatgtggcctaggaaaattaatcccatctttgatgaaaatgatgagctaattgagaatgctaaacataaaaaagaaaatgaactaatggccaagagagagaaacttattttggaaatagaaaaagaatcacgccgcatggaggagtttacagaatttgcagagctggagcgcatgcaacagtatgtgacagatgtaagacaactacaaaaacgtattcaggaatctgaagaagcagtgcagtttattaataaagaagaggaacttttcaagtgggaattgacaaaatatcctgaactggataaattaaaagttaacattgagccctatcagaagttttttaattttgttttgaagtggcagcgatcagaaaaacggtggatggatggagggtttttggacctcaatggggaaagcatggaggctgatgtggaagagttttcccgagaaatttttaagacactaaaatttttccaaacgaagctaaagaaagaattacaagaaaaaagaaaggcagcaagaaaacggtctttggaagaagagaaaattgaagaagaaccaaaagacaatgctactattactatgtgcagtacagtcatggaacagataaaagcttttaaggtataaatatatataataacattttaatattatagctatcttctcaacttttctgttacctaatatataaattataaagccta

SEQ ID NO: 8984 - DNA, 929 bp, Homo sapiens
ccagttcctttatagttttgttcagaaaaacatatggagacgtttatacccattgatttgacaactgaaaatcaagagatggacaaggaggaaaccaagacaaaaccaagacttttaagatatgaagagaaaaaatatgaagatgtgaaaccattagagactcaaccagctgaaatagcagaaaaggaaacattggaatataaaacagttagaacattctctgaatctttgaagtcagagaaaacagaagattaccttagagaaagtataattcaacaacatatggtttctccagagccagcttcccttaaggagaaagggaagtcaaggagaaaaaaggatcaaactcatgcttgtccaaatgttaggaaagccaggcctgtgtcctatgatagaacagaaccaaaagatgatgatgtgataagaaatattattaggctacgagaaaagcttggttggcaaactatattaccgcagcacagtttgaaatacggaagctccaaaattgcaattcagaagattactttaaagaaacctttggaagatgatggagaatttgtttattgccttcctcggaaaagtcctaaatccctttacaatccatatgatcttcaggtagtatcggctcatactgctaaacattgcaaagaattttgggttattactgcttcatttatctcaaagagatacttggtcatttgtggagcagtttatatataagaatctccttgggagcatgttatttaatagtgaagtttttccttttgtgtagagatttaggtttgaagattcaactttaataaattttttcatctatcaaatactttgttaatacttggggtaaatttttacaggaagaactacaaaacaagcatttgctagcttaatgggaactataataataaagaaaagaatattctttattggca

SEQ ID NO: 8985 - DNA, 1103 bp, Homo sapiens
aggcgtggctcttggtcaggcggttacggccaggaggcgtcggagcctggcgtggtagggctgtgctgcgcggtccttcccattcaccctagtctggcgctcgccggcgtgggcgggccggaccttcgccgcttccaggaagggccacaacggccgtcggaccacggcgcggcggccagttcctttatagttttgttcagaaaaacatatggagacgtttatacccattgatttgacaactgaaaatcaagagatggacaaggaggaaaccaagacaaaaccaagacttttaagatatgaagagaaaaaatatgaagatgtgaaaccattagagactcaaccagctgaaatagcagaaaaggaaacattggaatataaaacagttagaacattctctgaatctttgaagtcagagaaaacagaagattaccttagagaaagtataattcaacaacatatggtttctccagagccagcttcccttaaggagaaagggaagtcaaggagaaaaaaggatcaaactcatgcttgtccaaatgttaggaaagccaggcctgtgtcctatgatagaacagaaccaaaagatgatgatgtgataagaaatattattaggctacgagaaaagcttggttggcaaactatattaccgcagcacagtttgaaatacggaagctccaaaattgcaattcagaagattactttaaagaaacctttggaagatgatggagaatttgtttattgccttcctcggaaaagtcctaaatccctttacaatccatatgatcttcaggtagtatcggctcatactgctaaacattgcaaagaattttgggttattactgcttcatttatctcaaagagatacttggtcatttgtggagcagtttatatataagaatctccttgggagcatgttatttaatagtgaagtttttccttttgtgtagagatttaggtttgaagattcaactttaataaattttttcatctatcaaatactttgttaatacttggggtaaatttttacaggaagaactacaaaacaagcatttgctagcttaatgggaactataataataaagaaaagaatattctttattggc

SEQ ID NO: 8986 - DNA, 1984 bp, Homo sapiens
ggctcttggtcaggcggttacggccaggaggcgtcggagcctggcgtggtagggctgtgctgcgcggtccttcccattcaccctagtctggcgctcgccggcgtgggcgggccggaccttcgccgcttccaggaagggccacaacggccgtcggaccacggcgcggcggccagttcctttatagttttgttcagaaaaacatatggagacgtttatacccattgatttgacaactgaaaatcaagagatggacaaggaggaaaccaagacaaaaccaagacttttaagatatgaagagaaaaaatatgaagatgtgaaaccattagagactcaaccagctgaaatagcagaaaaggaaacattggaatataaaacagttagaacattctctgaatctttgaagtcagagaaaacagaagattaccttagagaaagtataattcaacaacatatggtttctccagagccagcttcccttaaggagaaagggaagtcaaggagaaaaaaggatcaaactcatgcttgtccaaatgttaggaaagccaggcctgtgtcctatgatagaacagaaccaaaagatgatgatgtgataagaaatattattaggctacgagaaaagcttggttggcaaactatattaccgcagcacagtttgaaatacggaagctccaaaattgcaattcagaagattactttaaagaaacctttggaagatgatggagaatttgtttattgccttcctcggaaaagtcctaaatccctttacaatccatatgatcttcaggtagtatcggctcatactgctaaacattgcaaagaattttgggttattactgcttcatttatctcaaaggttattaatatagttggtagtgtaaaggaagtagaactcatacctactttggaatggctatcagaaagaagacattactatttattacggcaattcaagatattttctgatttccgaatgaataaagcatttgttacctggaaattgaatgttaaaagaattaagacagagaagagcaggtcatttttgtaccaccatctttttttggctgatgacttgtttcaaacctgtttggtttatataagaggactttgtgaagatgcaattaatctcaaaaattataatgaccatgaaaataatctatctgccatatgccttgtaaagctggatagttctcgaacatattctctagatgaattttgtgaagagcagttacagcaagctacccaggcattgaaacaacttgaggacatcaggaataaagcaatttcagagatgaaaagtacttttctaaaggttgcagaaaagaatgaaatcaaagagtattttgagtcaaaactctctgaagatgacacaacacatttcaagctgcctaaatatagacgtttattagaaacatttttcaagtttgtaatgctggttgactacatatttcaggaactcattcgtcaacttatgaacactgcagtcacactacttttggaattatttaatggttctgctggaatgccattttcagtggaaaaaaagaatgaaaatcttatcaggtaaattacttttttgaagtcaaaaagtaacttacaattataatattttaacattgccacatatggaggaaatattcaataatttaagctagagtttgaaaattctccttgtggcagagtacatgtactcatttttgctattaacagaacttattatttggtaataccttacttaatatcggtgctataggatgcgcagtaaaatttgaatttcacataaatggtaaataattttagtatacttcaagtattacctatgttaaaattattgtttatctgaaattcagatttctctgataatttagcaaatatattttttatttgttatatctggcaattctgtgcctaagtatactctgtcttccaggttcagagttagtttttaaagatatgtgagaattctggaaggagctacaaagtccaa

SEQ ID NO: 8987 - DNA, 13788 bp, Homo sapiens
agggcgcaggcgtggctcttggtcaggcggttacggccaggaggcgtcggagcctggcgtggtagggctgtgctgcgcggtccttcccattcaccctagtctggcgctcgccggcgtgggcgggccggaccttcgccgcttccaggaagggccacaacggccgtcggaccacggcgcggcggccagttcctttatagttttgttcagaaaaacatatggagacgtttatacccattgatttgacaactgaaaatcaagagatggacaaggaggaaaccaagacaaaaccaagacttttaagatatgaagagaaaaaatatgaagatgtgaaaccattagagactcaaccagctgaaatagcagaaaaggaaacattggaatataaaacagttagaacattctctgaatctttgaagtcagagaaaacagaagattaccttagagaaagtataattcaacaacatatggtttctccagagccagcttcccttaaggagaaagggaagtcaaggagaaaaaaggatcaaactcatgcttgtccaaatgttaggaaagccaggcctgtgtcctatgatagaacagaaccaaaagatgatgatgtgataagaaatattattaggctacgagaaaagcttggttggcaaactatattaccgcagcacagtttgaaatacggaagctccaaaattgcaattcagaagattactttaaagaaacctttggaagatgatggagaatttgtttattgccttcctcggaaaagtcctaaatccctttacaatccatatgatcttcaggtagtatcggctcatactgctaaacattgcaaagaattttgggttattactgcttcatttatctcaaaggttattaatatagttggtagtgtaaaggaagtagaactcatacctactttggaatggctatcagaaagaagacattactatttattacggcaattcaagatattttctgatttccgaatgaataaagcatttgttacctggaaattgaatgttaaaagaattaagacagagaagagcaggtcatttttgtaccaccatctttttttggctgatgacttgtttcaaacctgtttggtttatataagaggactttgtgaagatgcaattaatctcaaaaattataatgaccatgaaaataatctatctgccatatgccttgtaaagctggatagttctcgaacatattctctagatgaattttgtgaagagcagttacagcaagctacccaggcattgaaacaacttgaggacatcaggaataaagcaatttcagagatgaaaagtacttttctaaaggttgcagaaaagaatgaaatcaaagagtattttgagtcaaaactctctgaagatgacacaacacatttcaagctgcctaaatatagacgtttattagaaacatttttcaagtttgtaatgctggttgactacatatttcaggaactcattcgtcaacttatgaacactgcagtcacactacttttggaattatttaatggttctgctggaatgccattttcagtggaaaaaaagaatgaaaatcttatcagaacattcaaggacaactcttttcctactggaaagacaacaaatgattgtgaagaacttgttgataattcaaagttacatgctatttctgttcaaaagtcagaagtaaaaacagacactgatattaatgagattttgaatagtgttgaagtggggaaggatttgagaaaaacatatgcaccaatatttgaagtaaatctatgcttgagaattcctgctgagagtgattcttcagaaaattctaaagagaactttcatgagtctgaccagtgccctgaagagtgtgtgatgtttgaagatgaaatgtcagaaaataaagacaattgtgtcaaaaaacactcaagtgaagaattgctcccaaaagccaagaaatcaaaagaaattagttacaatcttgaagatattatttcagacacagaaattgagactgagtttgagaataaatacatgtattatgaatttccagaatttcctacaaatctctttatagatcccaacagattggagttttcagtaaaaattcaaaatatgttgactaatatggaaaaatgtataaccacaattactcctctttgccaagatccccagctgtctatcttcattgatttggtttcaataatggatttacctaataagacaggaagcataatacattataaagagcagaccagatggccagattgtcacatcctttttgaaacagatcctgcctaccaaaatataattgtgaatctcctgactattattggtaattcaatgggcctagttaatgcttacagccacaagtttataaagtattgtaccatgacagaaaaggccaaaatcatgagtatgaaaatatcatctatgggagaattaacttcaaaagaatttgaagctattctaaatagattcagaaactattttagacatattgtgaatatggccattgagaagcgtattggtattttcaacgttgtaagtcttgattatcaatcagaatgcttactgtatattgacaacgtcatacatatgagccacaccctcatacaatctgtaattgaaaaaaagaacaaaaatttattggaagttgtggaatcatcattgcagcagctggaatgtgatcccactgaaatagaagaatttctggagcattttatttttttgaatgcaatttcctcaaaaatatctaaattagaaaaagagttcttaacaatgtctcagctatattctgttgcaaagcatcaccagatccatatttcagaagagcaaattgccatattccaagttcttcttcttaagtttagtcaactaaaatcatctatgaagttaagtaaaataaataaagacactgctataactaaattcagagataacttggaagcatgtatcagtggtctacatgttgatgttggcaatttaaaagccaagataagaactcctcttctgttatgtgctggtactcaagtgtcaacagcaatggaaatgatccagactctctcaggggaagctgcaagtttaactaacaaagctaaagcatattcacattatcaggattgtttcagtgattctcaatctcatatgcattctgttaatgtggaagaaattacacagattgtgctttcagagatctctgacattgaaggtgacttgactttgaggaaaaaactatgggaagcacaagaggagtggaagcgagcctcttgggaatggaggaatagttctcttcaaagtattgatgtagaatcagtacagagaaatgtttcaaaactgatgcacataatctcggtactagaaaaaggtttacctaaaagcgatatggtaacacatcttaagcaagtggtaacagagtttaaacaagagctgcctatcattatagctctgggaaatccctgtctcaagccaaggcattgggaggctctccaggagattattgggaagtcagttccgcttgataaaaactgtaaagtagagaatcttctagctctcaagatgtttcagtatgaaaatgaaataaatgatatgtcaacctcagcaactaatgaagctgctcttgaaaaaatgctatttaagattattgatttttggaacactactcctttgcctttaattcttcaccacacagagatttactctatcttcataattccatctatagatgacatatcagctcagttagaagagtctcaagtcatacttgcaacaattaaaggatctccccacattgggcccattaaggatcttgtgaatgaatgggatcaaaacttgactctcttctcttacacccttgaggaatggatgaattgtcaaagaaattggctttatcttgaaccagtctttcattcttcagaaatacgaaggcaactcccagcagaaacagaacttttctctcaagtgatttccatgtggaaaaaaataatgtcaaaaatacaaaacaaacagaatgctttgcagataaccacttctgcaggagtccttgaaattctgcaaaattgtaatatacatcttgaacatataaagaaaagccttgaggattaccttgaagttaaaagattaattttcccaagattttactttcttagcaatgccgagcttcttgatattctagctgatagcagaaatcctgagtctgtacagcctcatcttgtgaaatgctttgaaaatataaaacaattattgatatggaaacaagacattggccctcctgctgtaaaaatgctaatatctgctgaaggggaaggtctcgtgctgccaaagaaaattcgtgtaagaagtgctgtagaacagtggctggtaaatgtagaaaaaagcatgttcgatgtgctaaaaaaagagagatatatatataacattatcttactttttcagagccagatcatgttttataatgattgtgttaaaagttttgtgagttcttattcaagagaaaaattggaaaaagtccacgctggtctgatgtgtcatctagaagaggttgcagacctggtagtgctggatactagtaactctcgaacaaaagctatactaggggcattgcttatcctttatgttcactgcagagatatagtgataaatttactacttaaaaatatcttcaatgcagaggattttgagtggacaagacatttgcaatataaatggaatgaaaaacaaaagttgtgctatgtgtctcaaggaaatgccagctttacttatggctatgagtacttgggctgtacctcaagattggttattacgcctctcacagaccgatgctggctgactctcatggaagcactacacttgaatctaggaggctgtcctgccggtccagctggtacaggaaaaactgagactgtcaaagatctagcaaaatccttaggcaaacattgtgtggtcttcaactgttttgaggatttggattataagatagtgagaaaatttttctttggactagttcagtcaggagcatggagttgttttgatgaattcaatctaattgatttggaagttctctctgtcattgcctcacagatcctaacaattaaggctgcaaaagacaactattctgccaggtttgtactggaaggaaaagaaattcgtatcaatatgtcttgtgcggtatttatcaccatgaatcccagatacggaggtggagtagagctcccagataacttaaaatctctgtttcgcccagtggcaatgatggtgccccattatcaaatgattgctgaaataatattgttttcatttggtttcaaatctgcaaattcactctctggaaagctaactaacctttatgaattagcgcgcaaacagctctcacaacaggatcattataattttggcttgagatctctgaagatagttttaataatggctggaacgaagaaacgggagtttaaatgtctttctgaagcagatgaaaccttgattgttatcgaggctataagagaagctagtttgccaaaatgtcctcctgaagatgtcccactttttgaaaatattataggagatatttttccagaagtgacagttttgaaagtaaatcaacttgccttggagaaagtaatatatactgcaactcagcaattgggtttacaaaactggtcatctcagaaagagaagattatacagttttataatcaacttcaggtttgtgttggtgtgatgttagtgggcccaacaggtggaggaaagacaacagtcagaagaattttggaaaaagcattaacgctattaccaattgcagacttcttatcagttgcagaaagaaaatctgcttcaaagatttcagaaagaaaaggaaaagtagatatttgtgttttaaatccaaagtgtgtcactctcagtgaactatatggacaactggatcctaatactatggaatggactgatggattattatcagcaacaattcgaagttatgtatattttaacacaccaaagaacacaaagaaagacattgatctcagactaaagtcaagaatctcagatttatccaatgttttcaaacttgattcctctgatacaacagagactgatgataatatttttgaggagatagagaaagttgttaaaattccagaaaatcacaattttgattggcagtggattatcctagatggcccagtggacaccttttgggtagaaaatctgaactctgtgctagatgatactagaacattgtgcctagcaaacagtgagagaatagctttaactaataaaataagagtgatttttgaagtggacaatctctctcaggccagtcctgctactgtcagccgatgtgccatggtctatatggatcctgttgatctgggatgggaaccttatgttaagtcatggcttctgaaaacttctaaaattataagtcaatcaggagtggattgtcttgaattcatgattaaaaatagtgtcacagacggactacaatttataaggaatcgtcagaaatttcagccatatcctatggaggacataacagtcgtcataaccctctgcagaattcttgatgctttctttgacttcatgggtaaaaatggaggatttgaacaaagtgatgatttgaatgacacgtcatctaaggaggcaaattcccaaagagagtctgtcacattcaaggatatagaaaagagggatgaaaatacatggtatccagagaaaaatcctgataaattaacaaaaattattcaaaagctttttgtgtttgcctttacttgggcatttggaggagctttaaaccgtgaagatgaacacagagaaaatataccattttgtcccagtcttgaacctgattctcttgcaaaagtaacatacgattttgacaaacttgttcatgaattatttggaaacagttcacaagtaggatggaagcactggggtcagtcacagggcagacggagaaaggggaactgcatcaacctaccaactggtgaatgttccatctttggatattttgtggatatagagcaatgtgaattcataccttggtcagatttagttcctaatgatcagacactaattcaaagaggaacttcattactaactaatcttcaaagatctggcggaaacttcttgaagataacagaatgtggagaatgcattaattataccgctaccagagacacaacatgcctttcttttctcatgagccttcttttaaagaattcctgccctgtacttctcacaggagaatctggtgttgggaaaactgctgccattaatcaaatgcttgaaaagctagagggtccaggagcatttgacataaaacatggttcaattttaggagacaccctattatatagtgaaataaaaaaatcaagtagcctaaaacagaatatcaccatcttgattcctgaaactcataagacagcaactggaagttcagataatcccactaaaaagccagaagttagaactaataaaaagttacttaaaaataatgatcataaaggagttgtagtctctacaataaattttagcaccaatgtaacagctgccaaaaccaaggagatgattcttaagaagttaataagaagaactaaagatactcttggagcaccaaaaaacaaccggattctaatatttattgatgatatgaatatgccagtatcagatatgtatggagcacagccacccctggaattgataagacaattgttagatttgggaggagtttatgatactgaaaaaaatacatggaagaatattcaagatctgtctatagttgcagcttgtgttccagttgtgaatgatatcagcccacgtcttctcaaacacttttccatgctggtattacctcatccttcacaagacatcttatgtactattttccaggctcatttgggaatttatttctccatcaataacttcacacctgaagttcagaaaagtaaggatcagataatatcttgttccctagctatataccatcaagtacgtcagaatatgttaccaactccaacaaaatgtcactacatgtttaatcttcgagatatgtttaagcttctcctaggattgctgcaagctgacaggactgttgttaactccaaagagatggctgctctgctctttgttcatgaagccacccgagtatttcacgatcgcttaattgatttcactgataaaagccttttctatcggttgctttcaagggaacttgagaactgttttcagattggaatagatggatgtgggaaaaaaacatgtgcaaccttggcctgttatttgacagataataaactataccgagtgcctatatctcacaaatgtgcctacatcgaattcaaagaagtctttaaaaaggtgtttattcacgcaggattaaaagggaaacccactgttctgatggttcccaatttaaacatagaacaagactcatttttagaagatttgaactacatcatcagttcaggaagaatacctgacctgtttgaaaatgttgagctggattctattgcaatgaaaatcagatatcttactgaacaatctggtcatatggataataggcaatctttactttcattctttcaaaagagaatatataaaaatcttcatatttttgtgatcatgagtcctgaaggacctagcttccgccaaaattgtagagtgtatccttctatgattagctcctgcacgatcgattggtatgagaggtggccagaagaagctctccttattgtagctaactcattcttaaaagaaaaggtcaattttgagaacagagagaacttgaaagaaaaacttgccccaacatgtgtccaaatccacaaaagcatgaaagacttgaacagaaaatactttgaagaaactggaagattttattataccactcccaatagctacttgcaatttatggaaacatttgcacacattttgagggcacgagaggaagagatgcaaacaaagagggatcgcttccatatgggtctatccacaatcctggaagcaaccactctagttacagaaatgcaagaagagctcttgattcttggccctcaagtagaacaaaaaacaaaggaaacagaaactctaatggaaaaactacggaaagattcacaagtagttgagaaagttcagatgcttgttaaacaggatgaagaaattgtggcagaagaagtaagaattgtggaagattatgctcagaaaactgccaatgaactaaaaagtgtgctgccagcctttgacaaggcaattgtggctctgaatgccctggataaagctgatgtcgctgaattaagagtatacacacggcctcccttccttgtactgactgtcatgaatgcagtgtgtattcttctgcaaaagaaacctaactgggcaacggcaaagttacttctttcagaaactggtttcctgaaaaaattgattaaccttgacaaggacagcatacctgataaggttttcgtgaagctaaaaaaaattgtaaccttacctgatttcaacccacacaagatttcgctggtttctgttgcttgttgctccctgtgccagtgggttatagctttgaataactaccatgaagtacagaaggttgtgggccctaaacaaatccaagtagctgaagctcaaaacgtccttaaaattgcgcgacaaagacttgctgagaaacaaagaggtttacagctggttgaagaacatttgctgtttttacaggcagcttacaaagataccgttgctgaaaaacaactattagcaaatcggaaaacaatggccagcaggcgctttcagtgtgcgtcagtcttactaactgtcctggaagatgagaagactcgatggcaagaaacaatcaatcaaatagataacaaattagaaggaattttgggtgacatacttctttcagcagcgtgcattgtctacagtggaattttaacaccagaatttcgccagttgattgtgaataaatgggagacattctgcattgaaaatggcatttctttgtcttccaaattctctttaattaaagttatggcacaaaaatatgagatcagccgatggcataatcagggactgcctcatggtcagtattcagtagagaatgccatcttgatcaagaatggccagcagtggccactgctgattgacccacataggcaagctcacaaatggatccgtcagatggaaggatccaggctgcagaagctctccattgaagacagcaattataccaaaaaaattgaaaatgctatgaagacaggagggagtgtcctcctgcagaatctccttgagacattagctccaggcttaaaggcaattctgaaaaaggatatctatcagaaaaaaggacactatttcataagggttggtgatgctgagttcgaatacaattcaaattttaggttatacttatctacagaaatagacaacccccattttcttccatcagtttataactttgttactatgatcaacttcactgtaacattccaaggtttgcaagatcaactcttgtctactgtggtaactcatgaagttcctcatttagaagatcaacgttccaagttactggagagtatttcccttgatgccataactcttgaagaactagaggaaaaaacattaaatttactgcagaaagcactaggatccatattagatgatgacaaaattgtagataccttaagaaaatccaaaatgacatcaaacgaaatttcaaagcgcatcgaagcaacaaaaaaagctgaaagtgaaatccaagcaatacgtaaaaactatctccccattgcgacccgaggcgccctgctctacttcctagtagctgatctcacacaaatcaactacatgtaccagttctccctagactggtttcatcaggtttttgtttcatcagtagtttccaaaagcaaagaacaagaacatagttttaaaagggagaaagtgtctccaaaagaagttcatgagtttataagtatttcaaaagaacccaacctggaaaatgagaaaaatctcttagataagcatattaaaagtgcaatagacatgttgacaaaaagtatttttaaggtggtttcttcagctctatttaatgaagataaactttgcttctcttttcggctttgcactgtaatcatgcaaaacaatgctaatggaaatctaatacaggatgacattggattcctaccagaagaagaatggaacatctttttatattctggcatattgataaatattaaaagtgcattatcccagtctagacttactagcacatttgaaataggtgaaagtcaacatcttcagtggctgtcagattccaggtggaggcagtgccaatatgtcagcactcacctggaaccattttcacttctgtgcaaatcccttttatcaaacgtatcacaatgggatacttttaagaacagtaaagcagtttattctctgatcagcacacctttctcttcagaaaatgcttcattggaggaaaatacaaaaccaccagaggaaactgaacttttgaatgaaaataaagaaacgtgtaatcctataaattttccctgggagaaactcacttcatttcaaagacttattttggtaaaagttcttagaccagaaagtttaaacaattcagtgagaaagtttataactgaaaaaatgggaaataagtatcttcaaagaactggagttaatttgaaagatgcatataaaggatccaatgccagaactccgctgatacttattcaaactcatgggatcgaccttaccaatatcctcctgagatttgcacaagagttaaaaggaacaacacatcatgtgaccataatttctctgggccgtgaccaagcagctaaagctgaagacctcattttaaaggcactaacaaaaacacaacaatgggtcttcctccagaactgccatcttgcaacatcatttatgccaaggctttgcacaattgtagaatcttttaatagtccaaacgtgacaatagaccctgagtttcggctatggttaagctcaaaatcatacagttcttttccaattcctgttcttaaaaagggtttaaagattgccgtggaatctccccagggattgaaaagtaacttacttcagacatttggatgtactgggagtggagaggtaacagaagagatatttgaaaatcctgactgtggacaatggtggaaaaaacttttatttagcctatgttttttcaatgctgtaatcaatgaaagaaaaaattacggaatattgggctggaatattgcttataaatttaattcttcagacttgggggttgccattaaggtgttggaaaattccctgagaggacagcccagcatttcgtggcaagcactgcgctacctgattggagaagtgatttacggtggccgggtgattgataattgggacaagcgatgcttgaagaccctactctacaaattttgtaatcctgaagtgctgaaagatgacttcagtttctccagatctgcaagcataaaggactacatacacattatccagtccttacctgatgatgaccttcccgaggtcttaggaatacacccagaggccatcaggagctgctgggagacccagggcgaaaagtttattgaaaatctgattgccatgcaaccaaaaactaccactgccaacctcatgatcagacctgagcagagtaaggatgaactggtgatggaaattctatccgacttgctaaagcggctgccactgacagtggagaaagaagaaattgctgttggaactccaagcacattgaagagcatgatgtcaagctccatttgggagtctctttctaaaaatctcaaagatcacgacccccttatccattgtgtcttgctaacctttttgaagcaagaaattaaacgatttgataagttattatttgtcatacataaatccttaaaagatcttcagcttgctataaaaggagagatcatcctcacccaagaattggaggaaatatttaactcttttcttaatatgagagtgcctacattgtggcagaaacacgcctacagatcttgtaagccactgagttcctggattgatgatctcatccagcgactgaatttcttcaatacttgggccaaagtggcttatactgcaatacagcgtcggtatatgagatttgtcacagtttggaagcagtctattccatcaactagccaaaaatgcaaacaccctgaggattcagagaacaatttctttgaagggtttccttcaagatactggctcccagctttcttctttccacaagcctttcttgctgctgtgcttcaagactatgggaggtcccgaggaatcgctgtggatgccctcaccttcacccaccatgtgatttccaacaccactgacaaggatgagaagttctccgtatttatgccaaagaaactcaacatagtcaggagagcgtttaagggctcagcttcctctcacactggagtttacatttttggtttattcatcgagggggcaagatggaatcgtgaacagaaaatactggaagactcgctgcctctggagatgtgctgtgattttcccgacatatactttttgccaacaaagatttctaccaaaacaccaaatgcttccaaccagacagattcagaactctatgcttttgaatgcccagtttaccagacacctgagaggtcaagaattttggcaactaccggtttaccaacaaactttttaacatcagtgtatttatcaacgaagaaacctcctagtcactggatcacaatgcgggttgcattgctttgtgagaagaatgaaaaataaatgtccatatcaaaccattttaatt

SEQ ID NO: 8988 - DNA, 13548 bp, Homo sapiens
atggagacgtttatacccattgatttgacaactgaaaatcaagagatggacaaggaggaaaccaagacaaaaccaagacttttaagatatgaagagaaaaaatatgaagatgtgaaaccattagagactcaaccagctgaaatagcagaaaaggaaacattggaatataaaacagttagaacattctctgaatctttgaagtcagagaaaacagaagattaccttagagaaagtataattcaacaacatatggtttctccagagccagcttcccttaaggagaaagggaagtcaaggagaaaaaaggatcaaactcatgcttgtccaaatgttaggaaagccaggcctgtgtcctatgatagaacagaaccaaaagatgatgatgtgataagaaatattattaggctacgagaaaagcttggttggcaaactatattaccgcagcacagtttgaaatacggaagctccaaaattgcaattcagaagattactttaaagaaacctttggaagatgatggagaatttgtttattgccttcctcggaaaagtcctaaatccctttacaatccatatgatcttcaggtagtatcggctcatactgctaaacattgcaaagaattttgggttattactgcttcatttatctcaaaggttattaatatagttggtagtgtaaaggaagtagaactcatacctactttggaatggctatcagaaagaagacattactatttattacggcaattcaagatattttctgatttccgaatgaataaagcatttgttacctggaaattgaatgttaaaagaattaagacagagaagagcaggtcatttttgtaccaccatctttttttggctgatgacttgtttcaaacctgtttggtttatataagaggactttgtgaagatgcaattaatctcaaaaattataatgaccatgaaaataatctatctgccatatgccttgtaaagctggatagttctcgaacatattctctagatgaattttgtgaagagcagttacagcaagctacccaggcattgaaacaacttgaggacatcaggaataaagcaatttcagagatgaaaagtacttttctaaaggttgcagaaaagaatgaaatcaaagagtattttgagtcaaaactctctgaagatgacacaacacatttcaagctgcctaaatatagacgtttattagaaacatttttcaagtttgtaatgctggttgactacatatttcaggaactcattcgtcaacttatgaacactgcagtcacactacttttggaattatttaatggttctgctggaatgccattttcagtggaaaaaaagaatgaaaatcttatcagaacattcaaggacaactcttttcctactggaaagacaacaaatgattgtgaagaacttgttgataattcaaagttacatgctatttctgttcaaaagtcagaagtaaaaacagacactgatattaatgagattttgaatagtgttgaagtggggaaggatttgagaaaaacatatgcaccaatatttgaagtaaatctatgcttgagaattcctgctgagagtgattcttcagaaaattctaaagagaactttcatgagtctgaccagtgccctgaagagtgtgtgatgtttgaagatgaaatgtcagaaaataaagacaattgtgtcaaaaaacactcaagtgaagaattgctcccaaaagccaagaaatcaaaagaaattagttacaatcttgaagatattatttcagacacagaaattgagactgagtttgagaataaatacatgtattatgaatttccagaatttcctacaaatctctttatagatcccaacagattggagttttcagtaaaaattcaaaatatgttgactaatatggaaaaatgtataaccacaattactcctctttgccaagatccccagctgtctatcttcattgatttggtttcaataatggatttacctaataagacaggaagcataatacattataaagagcagaccagatggccagattgtcacatcctttttgaaacagatcctgcctaccaaaatataattgtgaatctcctgactattattggtaattcaatgggcctagttaatgcttacagccacaagtttataaagtattgtaccatgacagaaaaggccaaaatcatgagtatgaaaatatcatctatgggagaattaacttcaaaagaatttgaagctattctaaatagattcagaaactattttagacatattgtgaatatggccattgagaagcgtattggtattttcaacgttgtaagtcttgattatcaatcagaatgcttactgtatattgacaacgtcatacatatgagccacaccctcatacaatctgtaattgaaaaaaagaacaaaaatttattggaagttgtggaatcatcattgcagcagctggaatgtgatcccactgaaatagaagaatttctggagcattttatttttttgaatgcaatttcctcaaaaatatctaaattagaaaaagagttcttaacaatgtctcagctatattctgttgcaaagcatcaccagatccatatttcagaagagcaaattgccatattccaagttcttcttcttaagtttagtcaactaaaatcatctatgaagttaagtaaaataaataaagacactgctataactaaattcagagataacttggaagcatgtatcagtggtctacatgttgatgttggcaatttaaaagccaagataagaactcctcttctgttatgtgctggtactcaagtgtcaacagcaatggaaatgatccagactctctcaggggaagctgcaagtttaactaacaaagctaaagcatattcacattatcaggattgtttcagtgattctcaatctcatatgcattctgttaatgtggaagaaattacacagattgtgctttcagagatctctgacattgaaggtgacttgactttgaggaaaaaactatgggaagcacaagaggagtggaagcgagcctcttgggaatggaggaatagttctcttcaaagtattgatgtagaatcagtacagagaaatgtttcaaaactgatgcacataatctcggtactagaaaaaggtttacctaaaagcgatatggtaacacatcttaagcaagtggtaacagagtttaaacaagagctgcctatcattatagctctgggaaatccctgtctcaagccaaggcattgggaggctctccaggagattattgggaagtcagttccgcttgataaaaactgtaaagtagagaatcttctagctctcaagatgtttcagtatgaaaatgaaataaatgatatgtcaacctcagcaactaatgaagctgctcttgaaaaaatgctatttaagattattgatttttggaacactactcctttgcctttaattcttcaccacacagagatttactctatcttcataattccatctatagatgacatatcagctcagttagaagagtctcaagtcatacttgcaacaattaaaggatctccccacattgggcccattaaggatcttgtgaatgaatgggatcaaaacttgactctcttctcttacacccttgaggaatggatgaattgtcaaagaaattggctttatcttgaaccagtctttcattcttcagaaatacgaaggcaactcccagcagaaacagaacttttctctcaagtgatttccatgtggaaaaaaataatgtcaaaaatacaaaacaaacagaatgctttgcagataaccacttctgcaggagtccttgaaattctgcaaaattgtaatatacatcttgaacatataaagaaaagccttgaggattaccttgaagttaaaagattaattttcccaagattttactttcttagcaatgccgagcttcttgatattctagctgatagcagaaatcctgagtctgtacagcctcatcttgtgaaatgctttgaaaatataaaacaattattgatatggaaacaagacattggccctcctgctgtaaaaatgctaatatctgctgaaggggaaggtctcgtgctgccaaagaaaattcgtgtaagaagtgctgtagaacagtggctggtaaatgtagaaaaaagcatgttcgatgtgctaaaaaaagagagatatatatataacattatcttactttttcagagccagatcatgttttataatgattgtgttaaaagttttgtgagttcttattcaagagaaaaattggaaaaagtccacgctggtctgatgtgtcatctagaagaggttgcagacctggtagtgctggatactagtaactctcgaacaaaagctatactaggggcattgcttatcctttatgttcactgcagagatatagtgataaatttactacttaaaaatatcttcaatgcagaggattttgagtggacaagacatttgcaatataaatggaatgaaaaacaaaagttgtgctatgtgtctcaaggaaatgccagctttacttatggctatgagtacttgggctgtacctcaagattggttattacgcctctcacagaccgatgctggctgactctcatggaagcactacacttgaatctaggaggctgtcctgccggtccagctggtacaggaaaaactgagactgtcaaagatctagcaaaatccttaggcaaacattgtgtggtcttcaactgttttgaggatttggattataagatagtgagaaaatttttctttggactagttcagtcaggagcatggagttgttttgatgaattcaatctaattgatttggaagttctctctgtcattgcctcacagatcctaacaattaaggctgcaaaagacaactattctgccaggtttgtactggaaggaaaagaaattcgtatcaatatgtcttgtgcggtatttatcaccatgaatcccagatacggaggtggagtagagctcccagataacttaaaatctctgtttcgcccagtggcaatgatggtgccccattatcaaatgattgctgaaataatattgttttcatttggtttcaaatctgcaaattcactctctggaaagctaactaacctttatgaattagcgcgcaaacagctctcacaacaggatcattataattttggcttgagatctctgaagatagttttaataatggctggaacgaagaaacgggagtttaaatgtctttctgaagcagatgaaaccttgattgttatcgaggctataagagaagctagtttgccaaaatgtcctcctgaagatgtcccactttttgaaaatattataggagatatttttccagaagtgacagttttgaaagtaaatcaacttgccttggagaaagtaatatatactgcaactcagcaattgggtttacaaaactggtcatctcagaaagagaagattatacagttttataatcaacttcaggtttgtgttggtgtgatgttagtgggcccaacaggtggaggaaagacaacagtcagaagaattttggaaaaagcattaacgctattaccaattgcagacttcttatcagttgcagaaagaaaatctgcttcaaagatttcagaaagaaaaggaaaagtagatatttgtgttttaaatccaaagtgtgtcactctcagtgaactatatggacaactggatcctaatactatggaatggactgatggattattatcagcaacaattcgaagttatgtatattttaacacaccaaagaacacaaagaaagacattgatctcagactaaagtcaagaatctcagatttatccaatgttttcaaacttgattcctctgatacaacagagactgatgataatatttttgaggagatagagaaagttgttaaaattccagaaaatcacaattttgattggcagtggattatcctagatggcccagtggacaccttttgggtagaaaatctgaactctgtgctagatgatactagaacattgtgcctagcaaacagtgagagaatagctttaactaataaaataagagtgatttttgaagtggacaatctctctcaggccagtcctgctactgtcagccgatgtgccatggtctatatggatcctgttgatctgggatgggaaccttatgttaagtcatggcttctgaaaacttctaaaattataagtcaatcaggagtggattgtcttgaattcatgattaaaaatagtgtcacagacggactacaatttataaggaatcgtcagaaatttcagccatatcctatggaggacataacagtcgtcataaccctctgcagaattcttgatgctttctttgacttcatgggtaaaaatggaggatttgaacaaagtgatgatttgaatgacacgtcatctaaggaggcaaattcccaaagagagtctgtcacattcaaggatatagaaaagagggatgaaaatacatggtatccagagaaaaatcctgataaattaacaaaaattattcaaaagctttttgtgtttgcctttacttgggcatttggaggagctttaaaccgtgaagatgaacacagagaaaatataccattttgtcccagtcttgaacctgattctcttgcaaaagtaacatacgattttgacaaacttgttcatgaattatttggaaacagttcacaagtaggatggaagcactggggtcagtcacagggcagacggagaaaggggaactgcatcaacctaccaactggtgaatgttccatctttggatattttgtggatatagagcaatgtgaattcataccttggtcagatttagttcctaatgatcagacactaattcaaagaggaacttcattactaactaatcttcaaagatctggcggaaacttcttgaagataacagaatgtggagaatgcattaattataccgctaccagagacacaacatgcctttcttttctcatgagccttcttttaaagaattcctgccctgtacttctcacaggagaatctggtgttgggaaaactgctgccattaatcaaatgcttgaaaagctagagggtccaggagcatttgacataaaacatggttcaattttaggagacaccctattatatagtgaaataaaaaaatcaagtagcctaaaacagaatatcaccatcttgattcctgaaactcataagacagcaactggaagttcagataatcccactaaaaagccagaagttagaactaataaaaagttacttaaaaataatgatcataaaggagttgtagtctctacaataaattttagcaccaatgtaacagctgccaaaaccaaggagatgattcttaagaagttaataagaagaactaaagatactcttggagcaccaaaaaacaaccggattctaatatttattgatgatatgaatatgccagtatcagatatgtatggagcacagccacccctggaattgataagacaattgttagatttgggaggagtttatgatactgaaaaaaatacatggaagaatattcaagatctgtctatagttgcagcttgtgttccagttgtgaatgatatcagcccacgtcttctcaaacacttttccatgctggtattacctcatccttcacaagacatcttatgtactattttccaggctcatttgggaatttatttctccatcaataacttcacacctgaagttcagaaaagtaaggatcagataatatcttgttccctagctatataccatcaagtacgtcagaatatgttaccaactccaacaaaatgtcactacatgtttaatcttcgagatatgtttaagcttctcctaggattgctgcaagctgacaggactgttgttaactccaaagagatggctgctctgctctttgttcatgaagccacccgagtatttcacgatcgcttaattgatttcactgataaaagccttttctatcggttgctttcaagggaacttgagaactgttttcagattggaatagatggatgtgggaaaaaaacatgtgcaaccttggcctgttatttgacagataataaactataccgagtgcctatatctcacaaatgtgcctacatcgaattcaaagaagtctttaaaaaggtgtttattcacgcaggattaaaagggaaacccactgttctgatggttcccaatttaaacatagaacaagactcatttttagaagatttgaactacatcatcagttcaggaagaatacctgacctgtttgaaaatgttgagctggattctattgcaatgaaaatcagatatcttactgaacaatctggtcatatggataataggcaatctttactttcattctttcaaaagagaatatataaaaatcttcatatttttgtgatcatgagtcctgaaggacctagcttccgccaaaattgtagagtgtatccttctatgattagctcctgcacgatcgattggtatgagaggtggccagaagaagctctccttattgtagctaactcattcttaaaagaaaaggtcaattttgagaacagagagaacttgaaagaaaaacttgccccaacatgtgtccaaatccacaaaagcatgaaagacttgaacagaaaatactttgaagaaactggaagattttattataccactcccaatagctacttgcaatttatggaaacatttgcacacattttgagggcacgagaggaagagatgcaaacaaagagggatcgcttccatatgggtctatccacaatcctggaagcaaccactctagttacagaaatgcaagaagagctcttgattcttggccctcaagtagaacaaaaaacaaaggaaacagaaactctaatggaaaaactacggaaagattcacaagtagttgagaaagttcagatgcttgttaaacaggatgaagaaattgtggcagaagaagtaagaattgtggaagattatgctcagaaaactgccaatgaactaaaaagtgtgctgccagcctttgacaaggcaattgtggctctgaatgccctggataaagctgatgtcgctgaattaagagtatacacacggcctcccttccttgtactgactgtcatgaatgcagtgtgtattcttctgcaaaagaaacctaactgggcaacggcaaagttacttctttcagaaactggtttcctgaaaaaattgattaaccttgacaaggacagcatacctgataaggttttcgtgaagctaaaaaaaattgtaaccttacctgatttcaacccacacaagatttcgctggtttctgttgcttgttgctccctgtgccagtgggttatagctttgaataactaccatgaagtacagaaggttgtgggccctaaacaaatccaagtagctgaagctcaaaacgtccttaaaattgcgcgacaaagacttgctgagaaacaaagaggtttacagctggttgaagaacatttgctgtttttacaggcagcttacaaagataccgttgctgaaaaacaactattagcaaatcggaaaacaatggccagcaggcgctttcagtgtgcgtcagtcttactaactgtcctggaagatgagaagactcgatggcaagaaacaatcaatcaaatagataacaaattagaaggaattttgggtgacatacttctttcagcagcgtgcattgtctacagtggaattttaacaccagaatttcgccagttgattgtgaataaatgggagacattctgcattgaaaatggcatttctttgtcttccaaattctctttaattaaagttatggcacaaaaatatgagatcagccgatggcataatcagggactgcctcatggtcagtattcagtagagaatgccatcttgatcaagaatggccagcagtggccactgctgattgacccacataggcaagctcacaaatggatccgtcagatggaaggatccaggctgcagaagctctccattgaagacagcaattataccaaaaaaattgaaaatgctatgaagacaggagggagtgtcctcctgcagaatctccttgagacattagctccaggcttaaaggcaattctgaaaaaggatatctatcagaaaaaaggacactatttcataagggttggtgatgctgagttcgaatacaattcaaattttaggttatacttatctacagaaatagacaacccccattttcttccatcagtttataactttgttactatgatcaacttcactgtaacattccaaggtttgcaagatcaactcttgtctactgtggtaactcatgaagttcctcatttagaagatcaacgttccaagttactggagagtatttcccttgatgccataactcttgaagaactagaggaaaaaacattaaatttactgcagaaagcactaggatccatattagatgatgacaaaattgtagataccttaagaaaatccaaaatgacatcaaacgaaatttcaaagcgcatcgaagcaacaaaaaaagctgaaagtgaaatccaagcaatacgtaaaaactatctccccattgcgacccgaggcgccctgctctacttcctagtagctgatctcacacaaatcaactacatgtaccagttctccctagactggtttcatcaggtttttgtttcatcagtagtttccaaaagcaaagaacaagaacatagttttaaaagggagaaagtgtctccaaaagaagttcatgagtttataagtatttcaaaagaacccaacctggaaaatgagaaaaatctcttagataagcatattaaaagtgcaatagacatgttgacaaaaagtatttttaaggtggtttcttcagctctatttaatgaagataaactttgcttctcttttcggctttgcactgtaatcatgcaaaacaatgctaatggaaatctaatacaggatgacattggattcctaccagaagaagaatggaacatctttttatattctggcatattgataaatattaaaagtgcattatcccagtctagacttactagcacatttgaaataggtgaaagtcaacatcttcagtggctgtcagattccaggtggaggcagtgccaatatgtcagcactcacctggaaccattttcacttctgtgcaaatcccttttatcaaacgtatcacaatgggatacttttaagaacagtaaagcagtttattctctgatcagcacacctttctcttcagaaaatgcttcattggaggaaaatacaaaaccaccagaggaaactgaacttttgaatgaaaataaagaaacgtgtaatcctataaattttccctgggagaaactcacttcatttcaaagacttattttggtaaaagttcttagaccagaaagtttaaacaattcagtgagaaagtttataactgaaaaaatgggaaataagtatcttcaaagaactggagttaatttgaaagatgcatataaaggatccaatgccagaactccgctgatacttattcaaactcatgggatcgaccttaccaatatcctcctgagatttgcacaagagttaaaaggaacaacacatcatgtgaccataatttctctgggccgtgaccaagcagctaaagctgaagacctcattttaaaggcactaacaaaaacacaacaatgggtcttcctccagaactgccatcttgcaacatcatttatgccaaggctttgcacaattgtagaatcttttaatagtccaaacgtgacaatagaccctgagtttcggctatggttaagctcaaaatcatacagttcttttccaattcctgttcttaaaaagggtttaaagattgccgtggaatctccccagggattgaaaagtaacttacttcagacatttggatgtactgggagtggagaggtaacagaagagatatttgaaaatcctgactgtggacaatggtggaaaaaacttttatttagcctatgttttttcaatgctgtaatcaatgaaagaaaaaattacggaatattgggctggaatattgcttataaatttaattcttcagacttgggggttgccattaaggtgttggaaaattccctgagaggacagcccagcatttcgtggcaagcactgcgctacctgattggagaagtgatttacggtggccgggtgattgataattgggacaagcgatgcttgaagaccctactctacaaattttgtaatcctgaagtgctgaaagatgacttcagtttctccagatctgcaagcataaaggactacatacacattatccagtccttacctgatgatgaccttcccgaggtcttaggaatacacccagaggccatcaggagctgctgggagacccagggcgaaaagtttattgaaaatctgattgccatgcaaccaaaaactaccactgccaacctcatgatcagacctgagcagagtaaggatgaactggtgatggaaattctatccgacttgctaaagcggctgccactgacagtggagaaagaagaaattgctgttggaactccaagcacattgaagagcatgatgtcaagctccatttgggagtctctttctaaaaatctcaaagatcacgacccccttatccattgtgtcttgctaacctttttgaagcaagaaattaaacgatttgataagttattatttgtcatacataaatccttaaaagatcttcagcttgctataaaaggagagatcatcctcacccaagaattggaggaaatatttaactcttttcttaatatgagagtgcctacattgtggcagaaacacgcctacagatcttgtaagccactgagttcctggattgatgatctcatccagcgactgaatttcttcaatacttgggccaaagtggcttatactgcaatacagcgtcggtatatgagatttgtcacagtttggaagcagtctattccatcaactagccaaaaatgcaaacaccctgaggattcagagaacaatttctttgaagggtttccttcaagatactggctcccagctttcttctttccacaagcctttcttgctgctgtgcttcaagactatgggaggtcccgaggaatcgctgtggatgccctcaccttcacccaccatgtgatttccaacaccactgacaaggatgagaagttctccgtatttatgccaaagaaactcaacatagtcaggagagcgtttaagggctcagcttcctctcacactggagtttacatttttggtttattcatcgagggggcaagatggaatcgtgaacagaaaatactggaagactcgctgcctctggagatgtgctgtgattttcccgacatatactttttgccaacaaagatttctaccaaaacaccaaatgcttccaaccagacagattcagaactctatgcttttgaatgcccagtttaccagacacctgagaggtcaagaattttggcaactaccggtttaccaacaaactttttaacatcagtgtatttatcaacgaagaaacctcctagtcactggatcacaatgcgggttgcattgctttgtgagaagaatgaaaaataa

SEQ ID NO: 8989 - DNA, 10524 bp, Homo sapiens
atggggaggcgatcacagtggatctgggctatgaggtgtcagatgctggtaccagtcctaagtctgcacataggactggctcgtgctctgggatgtggctgcattgcttccaagatagaatgcctcataagatgtaatgcaccctttcctctgctggatgctgttggttctgtggcatcacaggagttgcagtctctgactggcaccgtcggtgtcacatcgggggccgccgcgtacccgcggtggaatctcgcaagagccagggcccctcctcacctgcccggcacccaggatcccttgcgccgcgttcgggaccccacccccattgtggcctcttcgccagggcgcaggcgtggctcttggtcaggcggttacggccaggaggcgtcggagcctggcgtggtagggctgtgctgcgcggtccttcccattcaccctagtctggcgctcgccggcgtgggcgggccggaccttcgccgcttccaggaagggccacaacggccgtcggaccacggcgcggcggaaaaacatatggagacgtttatacccattgatttgacaactgaaaatcaagagatggacaaggaggaaaccaagacaaaaccaagacttttaagatatgaagagaaaaaatatgaagatgtgaaaccattagagactcaaccagctgaaatagcagaaaaggaaacattggaatataaaacagttagaacattctctgaatctttgaagtcagagaaaacagaagaaccaaaagatgatgatgtgataagaaatattattaggctacgagaaaagcttggttggcaaactatattaccgcagcacagtttgaaatacggaagctccaaaattgcaattcagaagattactttaaagaaacctttggaagatgatggagaatttgtttattgccttcctcggaaaagtcctaaatccctttacaatccatatgatcttcaggtagtatcggctcatactgctaaacattgcaaagaattttgggttattactgcttcatttatctcaaagctggatagttctcgaacatattctctagatgaattttgtgaagagcagttacagcaagctacccaggcattgaaacaacttgaggacatcaggaataaagcaatttcagagatgaaaagtacttttctaaaggttgcagaaaagaatgaaatcaaagagtattttgagtcaaaactctctgaagatgacacaacacatttcaagctgcctaaatatagacgtttattagaaacatttttcaagtttgtaatgctggttgactacatatttcaggaactcattcgtcaacttatgaacactgcagtcacactacttttggaattatttaatggttctgctggaatgccattttcagtggaaaaaaagaatgaaaatcttatcagaacattcaaggacaactcttttcctactggaaagacaacaaatgattgtgaagaacttgttgataattcaaagttacatgctatttctgttcaaaagtcagaagtaaaaacagacactgatattaatgagattttgaatagtgttgaagtggggaaggatttgagaaaaacatatgcaccaatatttgaagtaaatctatgcttgagaattcctgctgagagtgattcttcagaaaattctaaagagaactttcatgagtctgaccagtgccctgaagagtgtgtgatgtttgaagatgaaatgtcagaaaataaagacaattgtgtcaaaaaacactcaagtgaagaattgctcccaaaagccaagaaatcaaaagaaattagttacaatcttgaagatattatttcagccacaattactcctctttgccaagatccccagctgtctatcttcattgatttggtttcaataatggatttacctaataagacaggaagcataatacattataaagagcagaccagatggccagattgtcacatcctttttgaaacagatcctgcctaccaaaatataattgtgaatctcctgactattattggtaattcaatgggcctagttaatgcttacagccacaagtttataaagtattgtaccatgacagaaaaggccaaaatcatgagtatgaaaatatcatctatgggagaattaacttcaaaagaatttgaagctattctaaatagattcagaaactattttagacatattgtgaatatggccattgagaagcgtattggtattttcaacgttgttgtggaatcatcattgcagcagctggaatgtgatcccactgaaatagaagaatttctggagcattttatttttttgaatgcaatttcctcaaaaatatctaaattagaaaaagagttcttaacaatgtctcagctatattctgttgcaaagcatcaccagatccatatttcagaagagcaaattgccatattccaagttcttcttcttaagtttagtcaactaaaatcatctatgaagttaagtaaaataaataaagacactgctataactaaattcagagataacttggaagcatgtatcagtggtctacatgttgatgttggcaatttaaaagccaagataagaactcctcttctgttatgtgctggtactcaagtgtcaacagcaatggaaatgatccagactctctcaggggaagctgcaagtttaactaacaaagctaaagcatattcacattatcaggattgtttcagtgattctcaatctcatatgcattctgttaatgtggaagaaattacacagattgtgctttcagagatctctgacattgaaggtgacttgactttgaggaaaaaactatgggaagcacaagaggagtggaagcgagcctcttgggaatggaggaatagttctcttcaaagtattgatgtagaatcagtacagagaaatgtttcaaaactgatgcacataatctcggtactagaaaaagagatttactctatcttcataattccatctatagatgacatatcagctcagttagaagagtctcaagtcatacttgcaacaattaaaggatctccccacattgggcccattaagagccagatcatgttttataatgattgtgttaaaagttttgtgagttcttattcaagagaaaaattggaaaaagtccacgctggtctgatgtgtcatctagaagaggttgcagacctggtagtgctggatactagtaactctcgaacaaaagctatactaggggcattgcttatcctttatgttcactgcagagatatagtgataaatttactacttaaaaatatcttcaatgcagaggattttgagtggacaagacatttgcaatataaatggaatgaaaaacaaaagttgtgctatgtgtctcaaggaaatgccagctttacttatggctatgagtacttgggctgtacctcaagattggttattacgcctctcacagaccgatgctggctgactctcatggaagcactacacttgaatctaggaggctgtcctgccggtccagctggtacaggaaaaactgagactgtcaaagatctagcaaaatgtgctctgtttgcatttaaatgtaacacagccttaataaagcttccaaactcacttatagttttaacatgctttggactagagaaaacagtgctagtgatgaatactgtaatgtcttttaggtttgtactggaaggaaaagaaattcgtatcaatatgtcttgtgcggtatttatcaccatgaatcccagatacggaggtggagtagagctcccagataacttaaaatctctgtttcgcccagtggcaatgatggtgccccattatcaaatgattgctgaaataatattgttttcatttggtttcaaatctgcaaattcactctctggaaagctaactaacctttatgaattagcgcgcaaacagctctcacaacaggatcattataattttggcttgagatctctgaagatagttttaataatggctggaacgaagaaacgggagtttaaatgtgataccagtgacagtctttctgaagcagatgaaaccttgattgttatcgaggctataagagaagctagtttgccaaaatgtcctcctgaagatgtcccactttttgaaaatattataggagatatttttccagaagtgacagttttgaaagtaaatcaacttgccttggagaaagtaatatatactgcaactcagcaattgggtttacaaaactggtcatctcagaaagagaagattatacagttttataatcaacttcaggtttgtgttggtgtgatgttagtgggcccaacaggtggaggaaagacaacagtcagaagaattttggaaaaagcattaacgctattaccaattgcagacttcttatcagttgcagaaagaaaatctgcttcaaagatttcagaaagaaaaggaaaagtagatatttgtgttttaaatccaaagtgtgtcactctcagtgaactatatggacaactggatcctaatactatggaatggactgatggattattatcagcaacaattcgaagttatgtatattttaacacaccaaagaacacaaagaaagacattgatctcagactaaagtcaagaatctcagatttatccaatgttttcaaacttgattcctctgatacaacagagactgatgataatatttttgaggagatagagaaagttgttaaaattccagaaaatcacaattttgattggcagtggattatcctagatggcccagtggacaccttttgggtagaaaatctgaactctgtgctagatgatactagaacattgtgcctagcaaacagtgagagaatagctttaactaataaaataagagtgatttttgaagtggacaatctctctcaggccagtcctgctactgtcagccgatgtgccatggtctatatggatcctgttgatctgggatgggaaccttatgttaagtcatggcttctgaaaacttctaaaattataagtcaatcaggagtggattgtcttgaattcatgattaaaaatagtgtcacagacggactacaatttataaggaatcgtcagaaatttcagccatatcctatggaggacataacagtcgtcataaccctctgcagaattcttgatgctttctttgacttcatgggtaaaaatggaggatttgaacaaagtgatgatttgaatgacacgtcatctaaggaggcaaattcccaaagagagtctgtcacattcaaggatatagaaaagagggatgaaaatacatggtatccagagaaaaatcctgataaattaacaaaaattattcaaaagctttttgtgtttgcctttacttgggcatttggaggagctttaaaccgtgaagatgaacacagagaaaatataccattttgtcccagtcttgaacctgattctcttgcaaaagtaacatacgattttgacaaacttgttcatgaattatttggaaacagttcacaagtaggcatcaacctaccaactggtgaatgttccatctttggatattttgtggatatagagcaatgtgaattcataccttggtcagatttagttcctaatgatcagacactaattcaaagagataatcccactaaaaagccagaagttagaactaataaaaagttacttaaaaataatgatcataaaggagttgtagtctctacaataaattttagcaccaatgtaacagctgccaaaaccaaggagatgattcttaagaagttaataagaagaactaaagatactcttggagcaccaaaaaacaaccggattctaatatttattgatgatatgaatatgccagtatcagatatgtatggagcacagccacccctggaattgataagacaattgttagatttgggaggagtttatgatactgaaaaaaatacatggaagaatattcaagatctgtctatagttgcagcttgtgttccagttgtgaatgatatcagcccacgtcttctcaaacacttttccatgctggtattacctcatccttcacaagacatcttatgtactattttccagattggaatagatggatgtgggaaaaaaacatgtgcaaccttggcctgttatttgacagataataaactataccgagtgcctatatctcacaaatgtgcctacatcgaattcaaagaagtctttaaaaaggtgtttattcacgcaggattaaaagggaaacccactgttctgatggttcccaatttaaacatagaacaagactcatttttagaagatttgaactacatcatcagttcaggaagaatacctgacctgtttgaaaatgttgagctggattctattgcaatgaaaatcagatatcttactgaacaatctggtcatatggataataggcaatctttactttcattctttcaaaagagaatatataaaaatcttcatatttttgtgatcatgagtcctgaaggacctagcttccgccaaaattgtagagtgtatccttctatgattagctcctgcacgatcgattggtatgagaggtggccagaagaagctctccttattgtagctaactcattcttaaaagaaaaggtcaattttgagaacagagagaacttgaaagaaaaacttgccccaacatgtgtccaaatccacaaaagcatgaaagacttgaacagaaaatactttgaagaaactggaagattttattataccactcccaatagctacttgcaatttatggaaacatttgcacacattttgagggcacgagaggaagagatgcaaacaaagagggatcgcttccatatgggtctatccacaatcctggaagcaaccactctagttacagaaatgcaagaagagctcttgattcttggccctcaagtagaacaaaaaacaaaggaaacagaaactctaatggaaaaactacggaaagattcacaagtagttgagaaagttcagatgcttgttaaacaggatgaagaaattgtggcagaagaagtaagaattgtggaagattatgctcagaaaactgccaatgaactaaaaagtgtgctgccagcctttgacaaggcaattgtggctctgaatgccctggataaagctgatgtcgctgaattaagagtatacacacggcctcccttccttgtactgactgtcatgaatgcagtgtgtattcttctgcaaaagaaacctaactgggcaacggcaaagttacttctttcagaaactggtttcctgaaaaaattgattaaccttgacaaggacagcatacctgataaggttttcgtgaagctaaaaaaaattgtaaccttacctgatttcaacccacacaagatttcgctggtttctgttgcttgttgctccctgtgccagtgggttatagctttgaataactaccatgaagtacagaaggttgtgggccctaaacaaatccaagtagctgaagctcaaaacgtccttaaaattgcgcgacaaagacttgctgagaaacaaagaggtttacagctgatcagccgatggcataatcagggactgcctcatggtcagtattcagtagagaatgccatcttgatcaagaatggccagcagtggccactgctgattgacccacataggcaagctcacaaatggatccgtcagatggaaggatccaggctgcagaagctctccattgaagacagcaattataccaaaaaaattgaaaatgctatgaagacaggagggagtgtcctcctgcagtcctgtcaagcttctacatggaggaaaaagttatacttatctacagaaatagacaacccccattttcttccatcagtttataactttgttactatgatcaacttcactgtaacattccaaggtttgcaagatcaactcttgtctactgtggtaactcatgaagttcctcatttagaagatcaacgttccaagttactggagagtatttcccttgatgccataactcttgaagaactagaggaaaaaacattaaatttactgcagaaagcactaggatccatattagatgatgacaaaattgtagataccttaagaaaatccaaaatgacatcaaacgaaatttcaaagcgcatcgaagcaacaaaaaaagctgaaagtgaaatccaagcaatacgtaaaaactatctccccattgcgacccgaggcgccctgctctacttcctagtagctgatctcacacaaatcaactacatgtaccagttctccctagactggtttcatcaggtttttgtttcatcagtagtttccaaaagcaaagaacaagaacatagttttaaaagggagaaagtgtctccaaaagaagttcatgagtttataagtatttcaaaagaacccaacctggaaaatgagaaaaatctcttagataagcatattaaaagtgcaatagacatgttgacaaaaagtatttttaaggtggtttcttcagctctatttaatgaagataaactttgcttctcttttcggctttgcactgtaatcatgcaaaacaatgctaatggaaatctaatacaggatgacattggattcctaccagaagaagaatggaacatctttttatattctggcatattgataaatattaaaagtgcattatcccagtctagacttactagcacatttgaaataggtgaaagtcaacatcttcagtggctgtcagattccaggtggaggcagtgccaatatgtcagcactcacctggaaccattttcacttctgtgcaaatcccttttatcaaacgtatcacaatgggatacttttaagaacagtaaagcagtttattctctgatcagcacacctttctcttcagaaaatgcttcattggaggaaaatacaaaaccaccagaggaaaaacatactttctgcctgcttctccgtgccataaaccatacaggaacagaccttggtcctgtagggagaggccaatggctgaccagcactgcttgtgacaggcacactgacgtgtgtagcttcagttttgctttaaatgatggagtcccagatgttgaacatgttcaggacatattttatggtcattgtgtagacaaatatcatgtaaaagttcttagaccagaaagtttaaacaattcagtgagaaagtttataactgaaaaaatgggaaataagtatcttcaaagaactggagttaatttgaaagatgcatataaaggatccaatgccagaactccgctgatacttattcaaactcatggatctgcaagcataaaggactacatacacattatccagtccttacctgatgatgaccttcccgaggtcttaggaatacacccagaggccatcaggagctgctgggagacccagggcgaaaagtttattgaaaatctgattgccatgcaaccaaaaactaccactgccaacctcatgatcagacctgagcagagtaaggatgaactggtgatggaaattctatccgacttgctaaagcggctgccactgacagtggagaaagaagaaattgctgttggaactccaagcacattgaagagcatgatgtcaagctccatttgggagtctctttctaaaaatctcaaagatcacgacccccttatccattgtgtcttgctaacctttttgaagcaagaaattaaacgatttgataagttattatttgtcatacataaatccttaaaagatcttcagcttgctataaaaggagagatcatcctcacccaagaattggaggaaatatttaactcttttcttaatatgagagtgcctacattgtggcagaaacacgcctacagatcttgtaagccactgagttcctggattgatgatctcatccagcgactgaatttcttcaatacttgggccaaagtggcttatactgcaatacagcgtcggtatatgagatttgtcacagtttggaagcagtctattccatcaactagccaaaaatgcaaacaccctgaggattcagagaacaatttctttgaagggtttccttcaagatactggctcccagctttcttctttccacaagcctttcttgctgctgtgcttcaagactatgggaggtcccgaggaatcgctgtggatgccctcaccttcacccaccatgtgatttccaacaccactgacaaggatgagaagttctccgtatttatgccaaagaaactcaacatagtcaggagagcgtttaagggctcagcttcctctcacactggagtttacatttttggtttattcatcgagggggcaagatggaatcgtgaacagaaaatactggaagactcgctgcctctggagatgtgctgtgattttcccgacatatactttttgccaacaaagatttctaccaaaacaccaaatgcttccaaccagacagattcagaactctatgcttttgaatgcccagtttaccagacacctgagaggtcaagaattttggcaactaccggtttaccaacaaactttttaacatcagtgtatttatcaacgaagaaacctcctagtcactggatcacaatgcgggttgcattgctttgtgagaagaatgaaaaataa

SEQ ID NO: 8990 - DNA, 2633 bp, Homo sapiens
gttttgcctgcacgatgtccagcaaagctgagaagaagcagcgattgagtggccgaggaagctcccaggcaagctggtcagggcgggccactcgggctgctgtggccacacaggagcaggggaatgccccggctgtcagtgagccagagctgcaggctgagctccccaaggaggagcctgagccacggttggagggacctcaagcacagagtgaagaatcagtggagcccgaggcagatgtgaagcccctcttcctttcccgagctgcgctgacaggactggcggatgcagtgtggacacaggagcatgatgccattctggaacactttgcccaggaccctacagaatccatcctcaccatcttcattgacccttgttttgggctgaagctagagctgggcatgcctgtacagacccagaaccagcttgtctacttcattcgccaagcaccagttcccatcacctgggagaacttcgaggcaactgtgcagtttgggacggtgcggggcccctatatcccggccctgcttcggctgctcggtggagtctttgcccctcagatctttgcaaacacaggctggcctgagagcattagaaatcattttgcttctcatctgcacaagttcttggcctgcctgacagacactcggtacaaactggaggggcacacggtcctctacatccctgcagaggccatgaacatgaagcctgagatggtgataaaggacaaagagctggtgcaacggctagagacctccatgatccactggacccggcagataaaggagatgctcagtgcccaggagactgtggagacaggagaaaatttaggtcctctggaggagattgagttctggcgcaaccgatgcatggacctgtctggcatcagtaagcagctggtgaagaagggagtgaagcacgttgaatccatcctgcaccttgccaagtcgtcctacttggcgccctttatgaaactggcacagcagatccaggatggctctcgtcaagcacagtcaaacctgacctttttgtcaatcctgaaggaaccttaccaggagttggctttcatgaagcccaaggacatctctagcaagctccctaagctgatcagtctcatccgcatcatctgggtcaactctccccactacaacactcgggagagactgacctcgctcttccgaaagatgagcaatgagatcatccgcttatgctgccacgccatctccctggaccggatctttgagggatatgtctcttccagcaaggaggacctgcaaggctgcattctctgttgtcacgcttggaaagatcactacgtacaggctgtgcagatgcacatccagttctccagtcggggctgggtcctagatcagaccagcatctttgctcaggttgatgcctttgtgcagcgctgcaaggaccttattgaggtatgtgactgtcagtatcacttcgcccgctgggaagatggcaagcagggtccccttccttgcttctttggtgcccaggggccacagataacacggaacttgctggagattgaggacatctttcataaaaatctgcacacgctgcgagccgttcgcgggggtatcctggatgtcaagaacacctgttggcatgaagactacaataagttccgtgccggaatcaaggacctggaggtgatgacccagaacctgatcacctcagccttcgagttggtgcgggacgtgccgcacggcgtgcttctgctggacaccttccacaggcttgcctcccgcgaggctatcaagcggacttatgacaagaaggcggtggatctctacatgctgttcaatagcgagctggccctggtgaaccgtgaacggaacaagaaatggccagacctggagccctacgtggcccagtattccggaaaggcgcgctgggtgcacatcctccggcgtcgcatcgacagagtcatgacctgccttgctggtgctcatttcctgccccgtattgggactggaaaggagagtgtgcacacctatcagcagatggtccaggccattgatgagctggttcgaaaaaccttccaagagtggacatcaagtctggacaaggattgcattcggcggttggataccccattgctgcgaatcagccaggagaaggcgggcatgctggatgtcaactttgacaagtacaggagccacctggccccttttccctatactccccttctgcagctctcccaagaatttcactcccatcttttgactcctctcttcattattctctctctttctcatacaatatgtttgctatcgtcattttacttttttttttcttcttttatttttgtctctccccacctcccaccctgctatcaacattttaattttacaacttatcttaaaacacaacaaaacaaaacaatgatcggccaggcacggtggctcacacctgtaatcccagcactttgggaggctgaggtgggcgcatcgcttgagcccaggagtttgagaacagcctgggcaacatggcaaaacccagtctctgcaaaaaatacaaagattagctgggcgtggtggcacaagcctgtagtctcagctacttgggagggtgaggtgggaggatcgcctgagcccgggaggcagaggctgcagtga

SEQ ID NO: 8991 - DNA, 12602 bp, Homo sapiens
gttttgcctgcacgatgtccagcaaagctgagaagaagcagcgattgagtggccgaggaagctcccaggcaagctggtcagggcgggccactcgggctgctgtggccacacaggagcaggggaatgccccggctgtcagtgagccagagctgcaggctgagctccccaaggaggagcctgagccacggttggagggacctcaagcacagagtgaagaatcagtggagcccgaggcagatgtgaagcccctcttcctttcccgagctgcgctgacaggactggcggatgcagtgtggacacaggagcatgatgccattctggaacactttgcccaggaccctacagaatccatcctcaccatcttcattgacccttgttttgggctgaagctagagctgggcatgcctgtacagacccagaaccagcttgtctacttcattcgccaagcaccagttcccatcacctgggagaacttcgaggcaactgtgcagtttgggacggtgcggggcccctatatcccggccctgcttcggctgctcggtggagtctttgcccctcagatctttgcaaacacaggctggcctgagagcattagaaatcattttgcttctcatctgcacaagttcttggcctgcctgacagacactcggtacaaactggaggggcacacggtcctctacatccctgcagaggccatgaacatgaagcctgagatggtgataaaggacaaagagctggtgcaacggctagagacctccatgatccactggacccggcagataaaggagatgctcagtgcccaggagactgtggagacaggagaaaatttaggtcctctggaggagattgagttctggcgcaaccgatgcatggacctgtctggcatcagtaagcagctggtgaagaagggagtgaagcacgttgaatccatcctgcaccttgccaagtcgtcctacttggcgccctttatgaaactggcacagcagatccaggatggctctcgtcaagcacagtcaaacctgacctttttgtcaatcctgaaggaaccttaccaggagttggctttcatgaagcccaaggacatctctagcaagctccctaagctgatcagtctcatccgcatcatctgggtcaactctccccactacaacactcgggagagactgacctcgctcttccgaaaggtatgtgactgtcagtatcacttcgcccgctgggaagatggcaagcagggtccccttccttgcttctttggtgcccaggggccacagataacacggaacttgctggagattgaggacatctttcataaaaatctgcacacgctgcgagccgttcgcgggggtatcctggatgtcaagaacacctgttggcatgaagactacaataagttccgtgccggaatcaaggacctggaggtgatgacccagaacctgatcacctcagccttcgagttggtgcgggacgtgccgcacggcgtgcttctgctggacaccttccacaggcttgcctcccgcgaggctatcaagcggacttatgacaagaaggcggtggatctctacatgctgttcaatagcgagctggccctggtgaaccgtgaacggaacaagaaatggccagacctggagccctacgtggcccagtattccggaaaggcgcgctgggtgcacatcctccggcgtcgcatcgacagagtcatgacctgccttgctggtgctcatttcctgccccgtattgggactggaaaggagagtgtgcacacctatcagcagatggtccaggccattgatgagctggttcgaaaaaccttccaagagtggacatcaagtctggacaaggattgcattcggcggttggataccccattgctgcgaatcagccaggagaaggcgggcatgctggatgtcaactttgacaagtcccttctgattctctttgcggaaattgactactgggagcggctgctgtttgagacgccccattacgtggtgaacgtagctgagcgagccgaggacctgcgcattctgcgtgaaaatctgctactcgttgctagagactacaataggattattgccatgctgtccccagatgagcaggccctattcaaagagcgtattcggctcctggataagaagatccacccgggactcaagaaactgcactgggccttgaagggggccagtgccttcttcatcacggagtgccgtatacatgccagcaaggtgcagatgattgtgaatgagttcaaggcatccactctgaccattggctggcgagcccaagagatgtcagagaagctgctggtacgcattagtggcaaacgggtatacagggacctggaatttgaagaggaccaaagagagcatcgggcagctgtacagcagaaattgatgaacctgcaccaggatgtggtgaccatcatgaccaactcctatgaggtcttcaagaatgatggtcctgagattcagcagcagtggatgctgtacatgattcggctggaccgcatgatggaggatgccctgcgcctgaatgtgaagtggtcactgctagaactatccaaggctatcaacggggatggaaagaccagcccaaacccactcttccaagtccttgtcattttgaagaatgatctgcaaggaagtgtggcacaggtggaattctcacccactctgcagactttggcaggtgtggtcaatgacattggcaaccacctcttttccaccatctctgtcttctgccacctccctgacattctcaccaagcgcaagttacatcgtgaacccatccaaacagttgtggagcaagatgaggacatcaagaagatccagacccaaatcagcagcggcatgactaacaacgcaagcctgctgcagaactacctcaagacctgggacatgtaccgggagatctgggagatcaacaaggactccttcattcatcgctaccagcgcctcaaccctcctgtctcttcttttgttgccgacattgcccgctacacggaagttgctaataacgtgcagaaggaggagacagtcaccaacatccagtttgtgctgctggactgttcgcacctcaagttctccctggtgcagcactgcaatgaatggcagaacaagttcgcgactctgctcagggagatggctgctgggcgcctcctggagctgcacacctacctgaaggagaacgcagagaaaatcagccgccctccgcagacactggaggaactgggggtcagcttgcagctcgtggatgccctgaagcacgacttggccaacgtggagactcagatccctcccatacacgagcaatttgccattcttgaaaagtacgaggtgccagtcgaggacagtgtcctggagatgctggacagtctcaacggggagtgggttgtcttccaacaaactctgctggacagtaagcaaatgctgaagaaacacaaggagaaattcaagacaggcctgatccactcggcagatgacttcaagaagaaagcacatacacttctggaagatttcgaattcaaaggccatttcaccagcaacgtgggatacatgtctgccttagaccagattacacaagtgcgggccatgctgatggccatgcgggaagaggaaaatagtctccgagccaacctgggcatcttcaagatcgagcagccaccctccaaggaccttcagaacctggagaaggagctcgatgccctccagcaaatctgggagatcgcacgagactgggaggagaactggaatgagtggaagactggccggttcctgatcctgcagacggaaaccatggagaccacggcccacgggctgtttcgtcgcctcacaaaattagccaaagagtataaggaccgaaactgggaaattattgaaaccactcgctcaaaaatagagcagttcaagaggaccatgcctctcatctcagacctgcggaaccctgcccttagagagaggcactgggaccaggtccgggatgagatccagcgggagtttgatcaggaatctgaaagcttcaccttggagcagattgtggagcttgggatggatcagcatgtggagaaaattggggagatctctgcttcagcaactaaagagctggctatagaagtggctttacaaaacattgccaagacctgggatgtgactcagctcgacatagtaccctacaaggataagggccatcatcggctcagaggtacagaagaagtattccaggcactggaagataaccaggtagctctgtctaccatgaaggcatcacgctttgtcaaggcctttgagaaggatgtggaccactgggaacgctgcctctccctcattttggaggttattgagatgattctcacagtgcagcgtcagtggatgtacttagagaatatcttcctaggagaagacatccgcaagcagctgcccaatgaatcgaccttatttgaccaggtcaacagcaactggaaagccatcatggacaggatgaacaaggacaacaatgctctccggagcacccatcacccaggcctcctggacacattgatagaaatgaatacaatcctggaagatattcagaaatctctggatatgtatttagagaccaagcgacatattttcccccgcttctacttcttgtccaatgatgacctgctggagattctgggccagtcccgaaacccagaggctgtgcagccacacctcaaaaaatgctttgacaacatcaagttgctgagaatccagaaggttggagggcccagcagcaaatgggaagctgtggggatgttctcgggcgacggcgagtacattgacttcctccactcagtatttttagaaggccctgtggagtcctggcttggcgatgtggaacagaccatgagggtgaccctgcgggaccttctccggaactgccacctggccctcaggaagttcctcaacaagagggacaaatgggtgaaggagtgggctggccaggtggtgatcactgccagtcagatccagtggacggctgatgtcaccaagtgcctgctgacagcgaaggagcgggcagacaagaaaatcctcaaggtcatgaagaagaaccaggtgtcaatcctgaataagtattcagaagccatcagggggaacttgaccaagatcatgcggcttaaaattgtggctctggtgacgatagaaattcatgcccgggatgtgttggagaagctttacaagagtggcctcatggatgtcaattcctttgactggctcagccaacttcggttctactgggagaaggatcttgatgactgtgtcatccgccagaccaacacgcaatttcagtataattatgagtacttgggtaactcgggccggctcgtcatcacccccctgacggacaggtgttacatgacactgaccacggcattgcacctgcaccgagggggctcccccaaaggccctgcaggcacaggcaagaccgagaccgtcaaggacctgggcaaggccctgggcatatatgtcattgtggtcaactgctctgagggcctggactacaagtccatgggccgaatgtactcaggtctggcccagactggagcttggggctgctttgatgagtttaaccgcatcaacatcgaggtgctgtcagtggtggcccaccagatcctgtgcatcctgtctgccctggctgccggcctcacccatttccattttgatggctttgaaataaatctggtgtggtcctgtgggatcttcattaccatgaatcctggctatgctggccgcacagagcttcccgaaaatcttaaatccatgttccgcccaattgccatggtggtgcctgactccaccctcattgcagaaatcattctctttggagagggctttggcaactgcaagattctggccaagaaggtgtacacactctactcactggctgtgcagcagctgtccagacaggaccactatgactttggcctgcgtgccctcacctcccttctgcgctatgctggcaagaagcgccgcctacagccggatctgactgatgaagaggttctgctgctctcaatgagagatatgaacatcgccaagctcacttcagttgatgcacccctgttcaatgccatcgtgcaagatctgtttcccaacattgagctgcctgtcattgactatggcaagctgcgggagaccgttgagcaggagattcgagacatgggcctgcaaagcacgccgttcaccctcaccaaggttttccagttgtatgaaaccaagaactcccgccactccaccatgatcgtgggctgcacgggcagcggcaagactgcctcatggcgcattctacaggcctccctgtcctctctgtgccgcgccggagaccctaacttcaacattgttagagagttccctttgaaccccaaggcattgtccctaggggaactgtatggggaatatgacctcagcaccaatgaatggacagatggcatcttgtccagtgtcatgcggacggcatgtgcagatgagaaacccgacgagaagtggatcctgttcgatggccccgtggacacactgtggatcgagaacatgaactccgtcatggacgataacaaggtgttgaccctcatcaacggcgagcgcatcgcgatgcccgagcaggtgtctctcctgtttgaagtggaggacctggcaatggcctctccggccactgtatcccgctgcgggatggtctacactgactacgctgacctgggctggaagccctatgttcagtcatggctggagaagaggccaaaggctgaggtggagccccttcaacgcatgttcgaaaagctcatcaacaagatgctggcctttaagaaggacaactgcaaggagctggtgcccctgcccgagtacagcggtatcacctccctctgcaagctgtactctgccctggccacgccagagaatggggtgaacccagctgacggcgagaactatgtcaccatggtagagatgacatttgtgttcagcatgatctggtctgtgtgtgcctctgtggatgaggagggccggaagaggatcgacagctacctccgagagatcgagggctcctttcccaataaggacacggtatatgagtattttgtggaccccaaaatacggagttggacatcatttgaggacaagctccctaagagttggcgctaccctccaaacgcccccttctataagatcatggtgcccaccgtcgacactgttcgctacaactacctggtgagcagcttggtggccaaccagaatcccattctgctggtgggtcccgtggggactgggaagacctccatcgcccagagcgttctgcagtccctgccctccagccagtggtcggtgctcgttgtcaacatgtccgcacagaccacatccaataacgtgcagagcatcattgagagcagggttgagaagcgaaccaagggtgtctacgtgccattcgggggcaaaagcatgatcacctttatggatgacctaaatatgcccgctaaggacatgtttgggtcccagccacccctggagctgatccgcctctggattgactatggcttctggtatgaccgtacgaagcagaccatcaagtacattcgagaaatgttcctgatggctgccatgggcccccctgggggtggacggactgtcatctccccaaggctacggagtcgcttcaacattatcaacatgaccttccccacaaagtcccagatcatccgcatattcggcaccatgatcaatcagaagcttcaggactttgaggaagaggtgaagcccattgggaacgtggtgacagaggccaccctggacatgtacaacaccgtggtacagcgcttcctgcccacgcccaccaagatgcattacctcttcaaccttcgagacatctccaaggtgttccagggcatgcttagagccaacaaggacttccatgataccaagtccagcatcacacggctctggatccatgaatgtttcagagtcttctctgaccggctggttgatgcggcagacacagaagccttcatgggcatcataagcgacaagctcggctccttctttgacctcacatttcatcatctctgtcccagcaagcgtcctcctatctttggggatttcctgaaggagcccaaggtgtatgaagacctcacggatctgacagtgctgaagacagtcatggagacagctctaaatgagtataacctgtcaccctctgtcgtgcccatgcagctagtgctcttccgagaggctattgaacacatcacacggatcgtgcgggtcattggacagcctcggggcaacatgctcctggtgggtatcgggggcagcggacgccagagtctggcccgcctggcttcatccatctgcgactacaccaccttccagatcgaggtcaccaaacattatcggaagcaggagttccgagatgatatcaagcgtctgtatcgccaggctggggtggagctcaagaccacgtccttcatttttgtggacacccaaatagctgatgagtccttcctagaggacatcaacaacatcctcagctcaggcgaggtgcccaatctctacaagcctgatgaatttgaagagatccagtcgcatatcatagaccaggcccgggtggagcaggtgcctgagtcatcggacagcctcttcgcctacctcattgaacgcgtgcagaacaacctgcacatcgtgctctgcctcagccccatgggggatcccttcaggaactggatccgccagtacccagccttggtgaactgcacaaccatcaactggttctcagagtggccccaagaggccctgctcgaggtggctgagaagtgcctcataggagtagacctgggaactcaggagaatatccacaggaaggtggcccagatctttgtcactatgcactggtcagtagctcagtattcccagaagatgctgttggaactgcggagacacaactatgtcacacccaccaaatacctggaactcctgtctggatataagaagttgctgggagaaaaacggcaggagctgctggcccaagccaataaactgcggacaggcttgttcaagatcgacgaaactagggaaaaggtgcaagtgatgtcgttggagctggaggatgccaagaagaaggtggctgagttccagaagcagtgtgaggagtacctggtcatcattgtgcagcagaagcgggaggcagatgagcagcagaaggccctggagtctctgaacaagaaggatataggagagatcaagtcttatggacggcccccagcccaagtggagatagtgatgcaggcagttatgattcttcgaggcaacgagcccacatgggcagaggccaagaggcagctaggggaacagaacttcatcaagtcactgatcaactttgataaagacaatatctcagataaggttctgaagaagattggggcctactgcgcccagcctgacttccagcctgatatcatcggccgcgtctccctggctgccaagtccctctgcatgtgggtgcgggccatggagctgtatgggcggctatatcgggtggtggagcccaagcgaatccgaatgaacgctgccttggctcagcttcgggagaagcaagccgcgctcgctgaggcccaggagaagctgcgggaggtagctgagaaactggagatgctaaagaaacagtatgatgagaagctggcacagaaggaggagcttcgcaagaagtctgaagagatggagctgaagctggagcgagctgggatgctcgtgtcggggttggctggcgagaaggccagatgggaggagacagtccagggcctggaggaggacctgggctacctggtgggggactgtctcctggcagctgccttcctgtcctacatgggacccttcctgaccaactaccgggatgagattgtcaaccaaatctggatcgggaagatctgggagcttcaggttccttgctccccttctttcgccatcgataacttcctgtgcaatcctaccaaagtccgggactggaacatccaagggttgccctcagacgccttctccactgagaatggcatcatcgtcacccgaggcaacaggtgggcactgatgatcgaccctcaggcccaggccctgaaatggattaagaacatggaaggaggccagggcctgaagatcatcgacctgcagatgagcgattacctgcgaatcctagaacacgccattcactttggatacccggtgctacttcagaacgtgcaggaatatctggaccccacactgaaccccatgctcaacaaatctgtagcccgaatcggtggtcggctgttgatgcgcattggcgataaggaggtggaatataataccaatttccgtttctacatcaccaccaagctctccaacccccactacagcccagagacctcagccaagaccaccatcgtcaactttgctgttaaagaacagggcctggaggcccagctgctgggcattgtggtgcggaaggagcggcctgagctggaggagcagaaggactcactggtcatcaacatcgcggctggtaaaaggaagctcaaggagctggaggatgagatcctgcggctgctgaatgaggccaccggctccctgctggatgatgtgcagctggtgaacacgctgcatacctccaagatcacagccacagaggtgactgagcagctggagaccagtgagaccacagagatcaacactgacttggcgcgggaggcttaccgcccatgcgcccagcgggcatcaatcctgttcttcgtgctcaatgatatgggctgcatcgaccccatgtaccagttctcactggatgcctacatcagcctctttattctcagcattgacaaaagccaccgcagcaataagctggaggaccgcattgactacctgaatgactaccacacctacgctgtctacaggtacacctgccgtacccttttcgaacgccacaaactactattcagttttcatatgtgtgccaaaatcttggagacttctggcaagctcaacatggatgaatacaacttctttctacgtgggggtgtggtcttggatcgggagggccaaatggacaatccatgtagtagctggcttgcagatgcctactgggataacatcacagagctagacaaactgaccaacttccacggactcatgaactcctttgagcagtaccctcgtgactggcacctgtggtataccaatgctgccccggagaaggcgatgctgccaggtgagtgggaaaatgcctgcaatgaaatgcaacggatgctgatcgttcgctccctgcgccaggaccgcgtggccttctgcgtgacctccttcatcatcaccaaccttggctcccgcttcatcgagccgcctgtgctgaatatgaagtcggtgctggaggattcaaccccacgatccccactcgtgttcatcctgtcccctggtgtggaccccaccagtgccctgctgcagctggcagagcacatgggcatggcccagcgcttccacgccctgtccctgggccagggccaggcccccatcgctgctcggctcctccgagagggtgtgactcagggacactgggtgttcctggcaaactgccacctgtcactgtcttggatgcctaatctggacaagctggtggagcagctgcaggtggaggatcctcatccatccttccgcctctggctcagctccatcccccacccagacttccctatctcaatcttgcaggtcagcatcaagatgaccacagagccaccaaagggcctaaaggccaacatgacacgtctttaccaactgatgtcagaaccacagttttcccgctgctccaaacctgccaaatataagaagctgctgttttcactctgtttcttccactctgtgttacttgaacgcaaaaagttcctgcagcttggctggaacatcatctatggcttcaatgactccgactttgaggtgtcagaaaacttgctgagcctctatctcgatgagtacgaggagacaccttgggacgcacttaagtacctcattgccggcatcaactatggtggacatgtcacagatgactgggaccggcgcctgctgaccacctacatcaatgattatttctgtgaccagtctctatcaactcccttccaccggttgtcagcactggagacttatttcatccccaaggatggcagcctcgcttcttacaaggaatacatcagcttattgcctggcatggacccccctgaggcctttggccagcaccccaatgctgatgtggcctctcagatcactgaggcacaaaccctctttgatactttgctttccttgcaacctcagattacacccaccagggctggaggccagacccgggaagagaaggtccttgagttggccgctgatgtgaagcagaagatccctgaaatgatcgactatgaggggactcaaaaactgctagctctcgacccctcccccctcaatgtggtccttctgcaggagatccagagatacaacacactgatgcagaccatcctgttctcactgacagacctagagatacctagttgtgttagccataaaagtgaaagagttgtattggagctcagtgctgtaaaacacccgcgacaa
